United States Patent 11,931,406 (FLAVIVIRUS VACCINE) - sequence listing, part 53

SEQ ID NO: 19210 - RNA, 9879 nt, Artificial Sequence
  derived and/or modified CDS sequence (opt5) from DENV-1__GU131770__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagagcaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccccccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauuccggggggaggacggaugcugguauggcauggagauuagaccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaauccggccuauguuugcggucggacuccuguuccgcagacucaccagccgggaggugcugcuucugacaaucggccucucccugguggcuucugucgaacugcccaacagccuugaggaacugggggauggacucgccaugggcauuaugauccugaagcuccugaccgacuuucaaucccaucagcuuugggccacacugcucagccugaccuucauuaaaacgacauuuucucugcacugugcuuggaagaccauggccaugguucuuuccaucgugagccuguucccccucugccugucuaccacaucccagaaaaccacauggcucccugugcugcuugggagccugggauguaagccgcugacgauguuucucauugcugagaauaagaucuggggccgcagaucuuggccccugaacgaaggcaucauggccgucgggauuguguccauccuucugagcucccuccugaaaaacgauguuccucucgcgggaccccugauugccggcgggaugcuuaucgcuugcuaugugauuagcggaucuagcgccgaccugucccuggagaaggcugccgaggucucuugggaagaggaagccgagcauagcggcgcuucccacaauauccucguggaaguucaggaugacgggaccaugaaaaucaaggaugaggagcgggacgauacacugaccauucuucugaaagcgacacuccuggccgugucuggagucuacccucucagcauccccgcuacccuguucgugugguauuucuggcaaaagaaaaagcagcgcuccggcguccuuugggacacgccuucucccccggaaguggagagagccguucuggaugacggcauuuaccggaucaugcagcgcgggcugcucggaagaagccaggugggcgucgggguguuucaagaaaacguuuuccauaccauguggcacgugacacggggagccguccugauguaucagggcaagagacuugagccuuccugggcuagcgugaaaaaggaccugauuucuuacgggggaggcuggcgccuccagggcuccuggaauaccggggaggaagugcagguuaucgccgucgagcccggaaaaaacccuaagaaugugcaaacagcgcccggcaccuuuaaaacaccggaaggggaggugggagcuauugcccuggauuucaagccuggcacgagcgggucucccaucgucaaccgggaaggaaagaucgugggccucuacggcaaugggguugugaccacauccggaaccuaugucagcgccauugcucaggccaaagcgucccaggagggcccucugcccgagaucgaagacgagguguuuagaaagcgcaaccuuaccauuauggaucugcaccccgggucuggaaaaacacggagauaccugccugcuaucguucgcgaagccauuaagcggaaacucagaacgcugauccuugccccgacccgcguggucgcuagcgagauggccgaagcucugaagggcaugcccauccgguaucaaacaaccgccgugaaguccgagcauacagggaaagagauuguugaccucaugugucacgcgaccuucacgaugagacugcugagcccugugcggguccccaauuacaacaugaucauuauggaugaagcccauuuuacagacccuucuuccaucgcugcccgcggcuauauuagcaccagagugggaaugggcgaggcugccgccaucuucaugaccgcuacacccccugggucuguggaagcguuuccgcagagcaaugccgucauccaggaugaggaacgggacauucccgagcgcuccuggaacucuggauacgaguggaucaccgauuucccuggcaagacaguuugguuugugcccagcauuaaauccgggaaugacaucgcuaacugccucagaaagaauggaaaacgggugauucagcuuucuagaaagaccuucgauacggaauaucaaaagacaaaaaacaacgacugggacuacgucgugaccacagauaucagcgagaugggcgccaauuuccgcgccgaccggguuauugauccuagacgcugccugaagcccgugauccugaaagacgggccggaacgggucauccucgcuggcccuaugcccgugaccguugccuccgcggcucagagacgcggacggauuggcagaaaccacaauaaggagggggaucaguacaucuauaugggacagccccugaacaaugacgaggaucaugcccacuggacggaagccaaaaugcuucuggacaacauuaauaccccugagggcaucauucccgcucucuuugaaccugagcgcgaaaagagcgccgcgaucgauggggaguacagacugcggggagaggcccgcaagacauucguggaacugaugagacggggcgaccucccggucuggcuuucuuauaaaguggcuuccgagggguuucaauacagcgaucgcagaugguguuucgacggcgaacggaacaaucagguccuggaggaaaacauggauguggagaucuggaccaaggagggagaaagaaaaaagcugcgcccccgguggcucgacgccagaacauauuccgacccucuggcucuucgcgaguuuaaagaauucgccgcuggccggagaucuguuagcggggaucugauucucgagaucggaaagcugccccagcaccugacccagcgggcccaaaaugcgcucgacaaccuugugaugcugcauaauuccgaacagggcgggcgcgccuacagacacgcuauggaggagcugccugauacaauugaaacccucaugcugcuugcccugaucgcugugcucacgggaggcgucacacuguuuuuccugucuggccgggggcucggaaaaaccagcauuggccuucugugcguuauggccuccagcgugcugcucuggauggccucuguggagccccauuggaucgcugcguccaucauucuggaauuuuuccuuaugguccugcucaucccggagccugacaagcagcgcaccccccaggauaaccaacuggccuaugugguuauugggcugcucuuuaugauccuuacaguggcugccaaugagaugggacugcuggaaaccacaaagaaagaccucggcauugggcacgucgccguggagaaccaccaucacgcugccaugcuggaugucgaccuucauccugcgagcgccuggacgcuguacgcuguggccaccacaaucauuacccccaugaugagacacacaaucgaaaacaccacggcuaauaucucucucaccgccauugcgaaccaggccgcuauccugaugggacuggauaagggcuggccuauuuccaaaauggacaucggcguuccccuccuugcccugggguguuacagccaggugaauccgcugacacucaccgcugccguccugaugcuuguggcucauuaugccauuaucggaccuggccugcaagcgaaggccacacgggaggcucagaaacgcaccgccgcugggaucaugaagaaccccacgguugauggaauuguggccaucgaccucgaucccgucguguacgacgccaaguucgaaaaacagcugggccagauuaugcugcucauccuuugcacaucucaaauucugcugaugagaaccacaugggcgcucugugagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguugaccgcuccgaagcgaaagaggggcucaagcggggagagacgacaaaacacgccgucucuagaggcaccgcuaagcugcgcugguucguggaacggaaucuugugaaacccgaggggaaggucauugaucugggaugcggcagagggggauggagcuauuacugugccggccucaagaaaguuaccgaagugaagggcuauacaaaagggggaccuggccacgaggaacccaucccuauggcuaccuacggguggaaccuggugaagcugcauuccggaaaagacgucuuuuucauucccccugagaagugcgauacacuccuuugugacaucggcgagucuagcccgaaucccacgauugaagaggggcgcacccugcgggugcugaaaaugguugaaccuuggcucagaggaaaccaauuuugcaucaagauccugaaucccuacaugccuuccguggucgagacacuugagcagaugcagcgcaagcacggcggcaugcuggugcggaacccccucagcagaaauucuacccaugaaauguauuggguuuccugugggacaggaaacauugugagcgccgucaauaugaccucucgcaugcugcugaaccgguucacgauggcgcacagaaaaccgaccuacgagcgcgauguggaccucggcgccgggacaagacacguggcugucgaaccugagguugccaaccuggauaucauuggacagcggaucgaaaauauuaagcaugagcacaaauccaccuggcauuaugacgaggauaaccccuacaagacaugggcuuaucacggcagcuacgaagugaaacccucuggguccgccagcuccauggugaauggagucgugaagcuucugaccaagccuugggacguuauccccauggugacacaaaucgcuaugaccgauacgacaccuuuuggccagcagcgcgucuucaaagagaagguggacaccagaaccccgaaagccaagcggggcacagcgcaaauuauggaaguuacggccaaauggcucuggggguuucugagcagaaacaagaagccccggaucugcacccgcgaggaauucacaagaaaagugcggucuaaugcugccauuggagcugucuuuguggacgagaaccaguggaauagcgccaaggaggccguugaagaugagcgcuucugggaccuugugcauagagaacgggagcugcacaaacagggcaagugcgcgaccugugucuauaacaugauggggaaacgcgaaaagaagcucggagaguuuggcaaagcuaagggguccagagccaucugguacauguggcugggcgcccgguuccuggaguucgaagcucucggauuuaugaaugaggaucacugguucucucgcgaaaacagccuguccggcguggagggggagggacuucauaaacugggcuacauucucagagacaucucuaagaucccugggggaaauauguaugccgaugacacagcuggcugggauacccggauuacagaagacgaucugcagaacgaggcccgcaucaccgacauuauggaacccgagcacgcgcuucuggccaaaagcaucuuuaagcucacguaccaaaauaaagucgugagaguucagcggccugcuaagaacgggaccgugauggaugucauuucccgcagagaccagcggggcucuggacaggugggcacauaugggcugaauaccuucacaaacauggaagcccaacugaucagacagauggagagcgagggaaucuuuucccccagcgaacucgagaccccgaaccuggcugaacgcgugcuugauuggcuggagaaguacggcguugaacggcucaaaagaauggccauuucuggggacgacugcguggucaagccuaucgaugaccgcuucgcgacggcccugacagcucuuaaugauaugggaaaagugcggaaggacauuccccagugggagccuuccaaaggcuggaacgauuggcagcaaguucccuuuuguagccaucacuuccaccagcugaucaugaaggacgggagagagauuguggucccuugccgcaaucaggaugaacucgugggccgggccagagucucucagggagcuggcuggucccugcgcgagaccgccugucuggggaagagcuaugcucaaauguggcagcucauguacuuucaucggagagaccugcgccuugccgcgaacgccaucugcuccgcugugcccguugauuggauuccgacaucucggaccacguggagcauccacgcccaucaccaguggaugaccacagaagacaugcuguccguguggaauagagucuggaucgaggaaaacccuuggauggaggauaaaacccauauuagcucuuggggagacgugcccuaucucggcaagcgggaggaccaauggugugggucccugaucggacuuacagccagagcuaccugggccacaaauauucagguugcgaucaaccaggugcgccggcugauuggcaaugaaaacuaccucgauuacaugaccagcaugaaaagauucaagaaugagucugaccccgaaggggcucugugguga

SEQ ID NO: 19211 - RNA, 9879 nt, Artificial Sequence
  derived and/or modified CDS sequence (opt5) from DENV-1__GU131773__SS-prME
agcgugaccaugcugcugaugcugaugcccacagcccuugcuuuccaccugacgaccagaggaggggagccucauaugaucgucuccaagcaggaacggggaaaaucucuccuguuuaagaccagcgccggaguuaacaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcaugacaaaacuggaaggaaagauugugcaguacgagaaccucaaauauuccguuaucgugacgguccacaccggcgaucagcaucaaguggggaaugaaagcacagagcacggaaccacagcuaccaucacgccccaggccccuaccacagaaauucagcugaccgacuacggcgcccugacacucgacuguucuccccggaccggccuggauuucaacgagaugguucuucugacgaugaaggagaaauccuggcucgugcauaagcagugguuucuggaccuuccucugcccuggacaagcggggcuuccaccucucaagaaacauggaaucgccaggaucuccuggucaccuucaaaaccgcgcacgccaagaagcaggagguggucgugcugggaagccaagaaggcgcuaugcacacagcccucacgggggccaccgagauccagacauccggaaccacaaccauuuuugcuggccaucugaaaugcagacuuaagauggacaaacugacgcucaaggggaugagcuauguuauguguacaggcucuuucaaacuggaaaaggagguggccgagacccagcacggaaccguccuggugcagaucaaguacgaaggcacagaugcgccgugcaaaauuccuuucuccacccaagacgagaaggggguuacacagaacggacggcuuaucacggcuaaucccaucgugaccgauaaagaaaagccugucaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguguuuacaagcguuggcaaacucguccaucagaucuucgggaccgcuuacggagugcuguuuuccggcgugagcuggacgaugaagauugggaucggcguccuucugaccuggcucggacucaauucuagauccacaagccugucuaugaccuguauugccgugggccuuguuacacucuaccugggggugaugguccaggcugacuccggaugcgugaucaacuggaaaggccgcgagcugaagugugggagcggaauuuucguuaccaaugaagugcacacauggaccgagcaauauaaguuucaggccgauuccccuaaacggcucucugcggccaucggcaaggcuugggaggaaggggucugcggcauuagaagcgccacgcgccuggagaacaucauguggaaacagaucuccaacgaacuuaaucauauucugcucgagaacgacaugaaguucacagugguugugggagacgucgcuggcauccuggugcaggggaaaaagaugauucggccgcaacccauggaauacaaauauucuuggaaaagcuggggaaaggccaaaaucauuggcgccgaugugcaaaauuccaccuuuaucaucgacgggccuaacacccccgaguguccugaugaccagagagcuuggaauauuugggaggucgaagauuacggauucggcaucuuuacaaccaacauuuggcugaaacuucgcgacagcuauacgcagguuugcgaucaccggcucaugucugcggccaucaaagacuccaaggcugugcacgccgauaugggcuacuggauugagagcgagaagaaugagacauggaagcuggccagagcuucuuucaucgaagugaagaccuguaucuggcccaaaucccauacacuguggagcaacgggguccucgagucugagaugauuaucccgaagauucacggaggcccuaucagccaacauaauuaucgccccggguacuucacccagacagccggaccuuggcaccugggcaaacuugaacuggacuuugaucucugcgaggggaccacggugguuguggacgaacacugcggaaaccggggccccucccugagaaccacaaccgucacaggcaagauuauccaugagugguguugccggagcuguacccugccuccccuucgcuucagaggggaggauggaugcugguacggcauggaaauccggccggugaaagagaaggaagagaaucucguuaagucuaugguguccgcggggagcggagaagucgacuccuuucugcugggccuccuguguauuucuaucaugauugaggaggugaugagaagccgcuggucccggaaaaugcuuaugacggggacacuggcuguuuucuuucuccugaucaugggacagcugaccuggaacgaccuuauuagacugugcaucauggugggcgccaaugccucugaucgcaugggcauggggacaaccuaucucgcucugauggccaccuucaagaugagaccuauguuugcggucggacuccuguuccggcgccuuacaagcagagaagugcugcuccugacgauuggccugucccuuguggcuucugucgagcugcccaacagccucgaagaacugggggacggacucgccaugggcaucaugauccugaaacuucugaccgauuuucaauccuaccagcucugggccacacugcugagccuuaccuucauuaagacaaccuuuucucugcacuaugcuuggaaaacgauggccaugguucucuccaucgugagccuguucccccucugucugucuacaaccucccagaagaccacauggcuuccugugcugcuggggagccucggaugcaagccgcugaccauguuucuuauugcugaaaauaaaaucuggggccggaagucuuggccccugaacgagggcauuauggccgucgggaucguguccauccuccugagcucccuccugaaaaacgacguuccucuugcgggaccccugauugccggcgggaugcugaucgcuuguuacgugauuagcggaucuagcgccgaucucucccuggagaaggcugccgaagucucuugggaggaagaggccgaacauagcggcgcuucccacaauauccuuguggagguucaggacgaugggacaaugaaaauuaaggacgaggaacgcgaugacacgcugaccauccuccugaaagcgacacuccuggccgugucuggagucuauccucuuagcauccccgcuacccuguucguguggcauuucuggcaaaagaagaaacagagauccggcguccugugggauacaccuucucccccggagguggaacgggccguucucgacgauggcauuuaccgcaucaugcagagagggcugcuuggacggagccaggugggcgucgggguguuucaagagaacguuuuccacaccauguggcacgugacgcgcggagccguccugauguaucagggcaagagacucgagccuuccugggcuagcgugaaaaaggaccugauuucuuacgggggaggcuggcgguuucagggcuccuggaauaccggggaagaggugcagguuaucgccgucgaacccggcaagaauccuaagaaugugcaaacagcgcccggcaccuucaagacaccggagggggaagugggagcuauugcccucgacuuuaaaccuggcaccagcgggucucccaucgucaacagagagggaaagauugugggccuguacggcaaugggguugugacaacguccggaaccuaugucagcgccaucgcucaggccaaagcgucccaggagggcccucuucccgaaaucgaggaugaaguguuccgcaagcggaaccugacaauuauggaccugcaucccgggucuggaaaaaccagacgcuaccucccugcuaucguucgggaggccauuaagagaaagcugcgcacccuuauccuggccccgacacggguggucgcuagcgaaauggccgaggcucucaaaggcaugcccauuagauaucaaacgaccgccgugaaguccgagcacacagggaaagaaaucguugaucugaugugccaugcgaccuuuacaaugcgccugcucagcccugugcggguccccaauuacaacaugaucauuauggacgaggcccacuucaccgauccuucuuccaucgcugccagaggcuauauuagcacgcgggugggaaugggcgaagcugccgccaucuuuaugacagcuacacccccugggucuauggaggcguucccgcagagcaaugccgugauucaggacgaagaaagagauauccccgagagauccuggaacucuggauacgaauggaucaccgacuuuccuggcaagacagucugguucguucccagcauuaaagcugggaaugauaucgccaacugucuucggaagaauggaaagcgcgugauucagcuguccagaaaaaccuucgacacagaguaucaaaagaccaaaaacaacgauugggacuacguggucacgacagacaucucugaaaugggcgccaauuuucgggcugauagagugauugacccucgccggugccugaagcccguuauccucaaagaugggccggagagagugauucuggccggcccuaugcccgucaccguggcgagcgcugcccagcgccggggaagaaucggccgcaaccauaauaaggagggggaccaguacaucuauaugggacagccccuuaacaaugaugaagaccacgcccacuggacagaggcuaagaugcugcucgauaacauuaauaccccugaaggcaucauucccgcccuguucgagccugaacgggagaaauccgcggccaucgacggggaguacagacugcgcggagaagcuagaaagacguuuguugagcucaugcggcgcggcgaucuuccgguguggcugagcuauaaagucgccucugaaggguuccaauacuccgacagacgguggugcuuugauggcgagcgcaacaaucaggugcuggaagagaacauggacgucgagauuuggaccaaggaaggagagcgcaagaagcuccggcccagauggcuggaugcucgcacauauagcgacccucuugcccugcgggaguucaaagaguuugcugccggcagacgcuccgugucuggggaccucauccuggaaaucggaaagcugccccagcaucucacccagcgggcgcaaaaugcccuugauaaccugguuaugcugcacaauagcgagcagggcgggagagcuuaccggcaugccauggaggaacucccugacacaauugagacccugaugcuucuggcucucaucgccgugcugacaggaggcgugacccuguucuuucucuccggcaaggggcuuggaaaaacgucuauuggccugcugugugucauggccagcuccguucuccuguggauggcuagcguggaaccccacuggaucgcggccucuauuauccuugaguucuuucugauggugcuccugaucccggagccugaucgccagagaacaccccaggacaaccaacuggcuuaugucgugauugggcuccuuuucaugauccugaccguugccgccaaugaaaugggacugcucgagaccacaaagaaagaucugggcauugggcacguggcugucgaaaaccaucaccaugccgcgaugcuugacguggaucugcacccugccuccgcuuggacccucuacgccgucgcuacaacgaucauuacccccaugaugcggcauacaaucgagaacaccacagccaauauuagccugaccgcgaucgccaaccaggcugccauccugaugggacucgacaagggcuggccuauuucuaaaauggauaucggcgugccccuucuggcucuggggugcuacucccagguuaauccgcucacgcugaccgccgcugugcuuaugcuggucgcccacuaugcgauuaucggaccuggccuccaagccaaggcuacacgcgaagcccagaagagaaccgcugccgggauuaugaaaaaccccacaaucgacggaaucguggccauugaucuggaccccguuguguacgaugcgaaguuugagaaacagcugggccagaucaugcuccuuauucuguguaccagccaaauccugcucaugcggacgacaugggcucugugcgagucuauuacccuugccacagggccucugaccacccucugggaaggaagcccgggcaaguucuggaauacaacgaucgcugucuccauggccaacaucuuccgcggcucuuaucuggccggggcuggacuggccuuuagccucaugaaaucccuuggcgggggaagacggggcaccggggcgcagggagagacacugggcgaaaaguggaagcgccagcugaaucagcucagcaaauccgaguucaacaccuacaagagaucuggcauuauggaaguggaccggagcgaggccaaagaggggcugaagagaggagaaacaaccaaacacgcugugucccgcggcacggccaaacuucggugguuuguugagagaaaucuggucaagcccgaagggaaagugaucgaccucggauguggccgcgggggauggucuuauuacugcgcuggccugaagaaagugacagaggucaagggcuauaccaaagggggaccuggccaugaggaacccauuccuauggccaccuacggguggaaccugguuaagcuccacagcggaaaagauguguucuuuauucccccugagaagugugacacacuucugugcgauaucggcgaauccucuccgaaucccaccaucgaggaagggcggacacugagagugcucaagauggucgagccuuggcugcgcggaaaccaauucuguauuaaaauccuuaaucccuacaugccuagcgugguugagacgcuggaacagaugcagcggaagcauggcggcaugcucgugagaaacccccugucccgcaauagcacccacgagauguauugggucucuugcgggacaggaaacaucguguccgcgguuaauaugaccagccggaugcugcucaacagauuuacaauggcccaccgcaaaccgaccuacgaacgggacguggaucugggcgcugggacgagacaugucgccguggagccugaaguggcuaaccuugacauuaucggacagcgcauugagaauaucaagcacgagcauaaaucuaccuggcacuaugaugaagacaaccccuacaagacaugggccuaucauggcuccuacgaggucaagcccagcgggucugcuuccagcaugguuaauggaguggugaaacugcucaccaagccuugggaugucauucccauggugacacaaaucgccaugaccgacacaaccccuuucggccagcagagaguuuuuaaagaaaagguggauacgcggacaccgaaagcgaagcgcggcaccgcccaaaucauggaggucaccgcuagauggcuguggggguuccuuucccggaacaagaaacccagaauuuguacacgggaagaguuuacgcgcaaggugagaagcaaugccgcuaucggagccguuuucguggacgagaaccaguggaacucugccaaagaagcggucgaggacgaucgguuuugggaccuggugcaccgcgaaagagagcuccacaagcagggcaaaugcgcuaccugcguuuauaacaugauggggaagcgggaaaagaaacugggagaguucggcaaggccaaagggagccgcgccauuugguacauguggcugggcgcuagauuccucgaguuugaagcccugggauucaugaaugaggaucauugguuuucccgggaaaacucucuuagcggcguggagggggagggacugcacaagcucggcuacauccugcgcgacauuuccaaaaucccugggggaaauauguaugcugaugacacagccggcugggauaccagaaucacagaagacgaucuucagaacgaggcgaagauuaccgacaucauggaacccgagcaugcccugcucgcuaaaucuauuuucaagcugacauaccaaaauaaggucgugcggguccagcgcccugccaaaaacgggaccgugauggauguuaucagcagacgggaccagcgcggcuccggacaggugggcacguaugggcugaauaccuuuacaaacauggaagcucaacucauuagacagauggagucugagggaaucuuccugcccaacgaacuugagaccccgaaucuggccggccggguccucgauuggcuggaaaaguacgggguggagagacuuaaacgcauggcgaucagcggagacgacugugugguuaagccuauugaugaccgguuugccacagcucugaccgcccucaacgauaugggcaaagugagaaaggacaucccccagugggaaccuuccaagggguggaaugauuggcagcaaguccccuucugcagccaccacuuucaucagcugauuaugaaagacggccgcgagaucgugguuccuugucggaaccaggaugagcuggugggcagagcucgcgucucucagggcgccggguggucccuccgggaaacggcuugccugggaaagagcuaugcccaaauguggcagcuuauguacuuccacagacgcgaccugcggcucgcggccaaugcuauuuguucugccgugcccgucgauugggugccgacauccagaaccacauggagcauccaugcccaccaucaguggaugaccacggaggacaugcuguccguuuggaaccgcguguggauugaagagaauccuuggauggaagauaaaacccggaucucuagcugggaggacguccccuaucuuggcaagagagaggaccaauggugcgggucccugaucggacucacagcucgggccaccugggcgacaaacauucagguggcuaucaaucagguuagacgccugauuggcaacgaaaauuacagcgauuacaugaccucuaugaaacgguuuaagaacgaguccgaacccgagggggcccugugguga

SEQ ID NO: 19212 - RNA, 9879 nt, Artificial Sequence
  derived and/or modified CDS sequence (opt5) from DENV-1__GU131775__SS-prME
agcgugaccaugcugcucaugcugaugcccaccgcccuugcuuuccaccugacgacccggggaggggagccucauaugaucgugacaaagcaggaacggggaaaaucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuguggucaccgugcacacaggcgaccagcaucaaguugggaaugaguccaccgaacacggaacaaccgcuacgaucacaccccaggccccuacaagcgagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggaggcaaagcucuuaagcucucuugguucaagaaagggagcuccaucggcaagauguuugaagccacagcuagaggagcccgccggauggcgauucugggcgauaccgccugggacuucgggucuguuggaggcgucuuuacaagcguggggaaacuggugcaucagaucuucggaaccgcuuacggcguccucuuuuccggggugagcuggacgaugaagaucggcauuggaguucugcuuaccuggcugggccucaauucuagauccacaagccugucuaugaccuguaucgccguggggcuggucacacuuuaccucggagugaugguucaggcugauuccggcugcgugauuaacuggaaagggcgcgagcugaaguguggaagcggcaucuucgucaccaaugaagugcacacauggaccgagcaauauaaguuucaggccgacuccccuaaacggcugucugcggccauugggaaggcuugggaagagggcguuugcggaaucagaagcgccacgcgccucgagaacauuauguggaaacagaucuccaacgaacugaaucauauccuucuggagaacgacaugaaguucacaguggucgugggcgauguggucgggauucucgcucagggcaaaaagaugauccggccgcaacccauggaacacaaauacucuuggaaaagcuggggcaaggccaagauuaucggggccgacguucagaauaccaccuuuauuaucgauggaccuaacacacccgaguguccugacgaucagagagcuuggaauaucugggaaguggaggacuauggcuucggcauuuuuaccacgaacaucuggcugaagcugcgcgauuccuacacacaggugugcgaccaccggcuuaugagcgcggccauuaaagauucuaaggcuguccaugccgacaugggguauuggaucgaguccgagaaaaaugagaccuggaagcucgccagagcuagcuucauugaagugaagacauguaucuggcccaaaucucacacccugugguccaacggaguucuggagagcgaaaugaucauuccgaagaucuacggcgggccuauuucucaacauaauuaucgccccggauacuucacacagaccgccggcccuuggcaccucgggaaacuggagcuugauuuugaccugugcgagggaacgaccguggucguggaugaacacugcggcaaccggggccccagccucagaacaaccacaguuaccgggaagaucauucaugagugguguugccgguccuguacgcugccuccccugcgcuucaaaggagaagacggcugcugguacgggauggagaucagaccggugaaggagaaggaagagaaucuugucaaaagcauggugucugcgggauccggcgaaguugacagcuuuucccucgggcugcuguguaucucuauuaugaucgaggaagugaugcggagcagauggucccgcaagaugcucaugacaggaacccuggcugucuuccuucugcucauuaugggccagcugacauggaacgaucugauccggcuuugcauuauggugggcgccaaugccucugacagaauggggaugggaaccaccuaucuggcucucauggccacauuuaaaaugcgcccuauguucgcggugggccugcucuuuagacggcugacgagccgcgagguccuucugcucaccaucgggcugucccugguugcuucuguggagcuucccaacagccuggaagaacugggagauggccuggccauggggauuaugauccucaagcugcuuacagacuuccaaucccaccagcugugggccacccuccugagccugacauuuaucaaaaccacgcuuucucugcauuacgcuuggaagacaauggccauggugcucuccauugucagccuguucccccucugucugucuaccaccucccagaagacaaccuggcuuccugugcugcugggaagccucggcugcaaaccgcugacaauguuucuuaucacggaaaauaagauuuggggcagaaaaucuuggccccugaacgaggggaucauggcuguuggaguggucuccauucuccugagcucccuccugaagaacgaugugccucuugccggcccccugaucgccgggggaaugcugaucgccuguuauguuauuagcggcucuagcgcugaccucucccuggaaaaagccgcugaggugucuugggaggaagaggccgaacacagcggggccucccauaauauccuugucgaggugcaggaugacggaaccaugaagauuaaagaugaggaacgggacgauacacugaccauccuccugaaggcuacacuccuggcggucucuggcguguacccucuuagcauucccgccacccuguucguuugguauuuuuggcaaaagaaaaagcagcgcuccggcgugcugugggacacgccuucucccccggaggucgaaagagcugugcucgaugacgggaucuaccggaucaugcagcgcggacugcuuggcagaagccagguuggggugggagucuuccaagagaacguguuccacaccauguggcacgugacacggggcgccguucugauguaucaggggaaacgccucgaaccuuccugggccagcgucaagaaagaccugauuucuuacggaggcggcuggagacuccagggguccuggaauaccggagaggagguccaggugaucgcugucgaacccggcaagaacccuaagaaugugcaaacagcccccgggaccuuuaaaacaccggagggagaaguuggcgcgauugcucuggauuucaagccugggacgagcggaucucccaucgugaaccgggagggcaaaauugucggccuuuacgggaauggagugguuaccacauccggcaccuaugugagcgccaucgcccaggcuaaggccucccaggaagggccucugcccgagauugaggacgaagucuuuagaaaacgcaaccugaccaucauggaucuccaucccggaucuggcaagacacggagauaccugccugcgaucgugcgcgaggcuauuaagcggaaacuuagaacgcugauccucgccccgacccgcguuguggccagcgaaauggcugaggcccugaaggggaugcccauucgguaucaaacaaccgcugucaaauccgaacacacaggcaaggagaucguggaccugaugugccaugccaccuucacgaugagacuccuuagcccugugcgcguccccaauuacaacaugauuaucauggaugaggcgcacuuuacagacccuucuuccaucgccgcucggggauauauuagcaccagaguuggcaugggggaagccgcugccaucuucaugaccgccacacccccuggaucuguggaggcuuuuccgcagagcaaugcggugauucaggaugaggaacgggacauccccgaacgcuccuggaacucuggcuacgaguggauuaccgauuucccugggaaaacagucugguuugugcccagcaucaaguccggaaaugacaucgccaacugucugagaaagaauggcaaacggguuauucagcugucucgcaagaccuucgauacggaguaucagaaaaccaagaacaacgacugggacuacguggucaccacagauaucagcgaaaugggggcuaauuuuagagccgaccgggugauugauccuagacgcugccucaaacccguuauccugaaggacggcccggagcgggugauucuugccggaccuaugcccgucaccguggcuuccgccgcgcagagacgcggccggaucgggagaaaccauaauaaggaaggagaucaguacauuuauaugggccagccccugaacaaugacgaggaucacgcucacuggacggaggccaaaaugcuccuggacaacaucaauaccccugaagggaucauucccgcccuguucgagccugaacgcgaaaagagcgcugccaucgauggagaauaccggcucagaggcgaggcgcgcaaaacauucgucgagcuuaugagaagaggggaccugccgguguggcugucuuauaagguugccuccgaaggcuuucaauacagcgaucgcagauggugcuucgacggagagcggaacaaucaggugcucgaagagaacauggauguggaaauuuggaccaaagagggcgagcgcaagaaacugagaccccgguggcuugacgcuagaacauauuccgacccucuggcccuccgcgaauuuaaggaguucgcugccgggcggagaucugucagcggagaucugauccuggaaauuggcaagcucccccagcaucuuacccagcgcgcucaaaaugcccuggacaaccugguuaugcuccacaauuccgagcaagggggacgggcguacagacaugccauggaggaacugccugauacaaucgagacccuuaugcugcucgcucugaucgccgugcugacgggcggcgugacacucuuuuuccuuucugggcggggacugggcaaaaccagcauugggcugcucugugucauggcuuccagcgugcugcuuuggauggccucuguugaaccccacuggaucgccgcuuccauuauccuggaguuuuuccucauggugcugcugauuccggaaccugaccgccagagaacaccccaggauaaccaacucgcguaugucgugaucggacuucuguuuaugauccugacagucgccgcuaaugagaugggccuccuggagaccacaaagaaagaccuugggauuggacacguggccguugaaaaccaucaccaugccacgaugcuggauguggaccuccacccugcuagcgccuggacccuguacgcggucgccacaaccaucauuacacccaugaugcggcauaccaucgagaacacgaccgcuaauauuucucugacagccaucgcuaaccaggccgcgauucucaugggccuugauaagggcuggccuaucuccaaaauggacaucggggugccccugcuggcccucggaugcuacagccagguuaauccgcugacccuuacagcugccgugcugaugcucgucgcucacuaugccauuaucggcccugggcugcaagcuaaggccacccgcgaagcgcagaagagaacggccgcuggaauuaugaaaaaccccacaguggauggcaucguggccauugaccuggaucccguugucuacgacgcuaaguucgagaaacagcucgggcagaucaugcuucugauccuguguaccucucaaauucuccugaugcggacaaccugggcccuuugcgaaagcaucacccuggccacaggaccucucacgacccugugggagggcuccccgggcaaguuuuggaauacaaccauugcggugucuauggcuaacaucuuccgcgggagcuaucuggccggagcuggccucgccuuuucccuuaugaaaagccucgggggaggcagacgggggacaggagcccagggcgagacccugggcgaaaaguggaagcgccagcucaaucagcuguccaaaucugaguucaacauuuacaagagaagcgggaucauggaaguggaccgguccgaggcuaaagaaggacuuaagagaggcgagacgacacgccacgccgucucucgggggaccgcgaaacugagaugguucguugagcgcaaucucgugaagcccgaaggaaaggugaucgaucugggcugugggcggggaggcuggagcuauuacugcgccggccugaaaaaggucaccgaggugaaaggguauacaaagggaggcccugggcaugaggagcccauuccuauggcuaccuacggauggaaccucguuaaacuucacuccggcaaggacguguuuuucacacccccugaaaaaugugauacgcugcugugcgacaucggggagucuagcccgaaucccaccauugaggaaggaagaacacuccgcguccugaagaugguggagccuuggcuucggggcaaccaauuuuguaucaagauucugaaucccuacaugccuuccguuguggaaacccucgagcagaugcagagaaaacauggcgggaugcugguccgcaacccccugagcagaaauucuacacacgagauguauuggguguccugcggaaccggcaacaucgugagcgccgucaauaugacgucuagaaugcuccugaaccgcuucaccauggcucaccggaagccgacauacgaaagagauguugaccuuggggccggaacccgccauguggcgguggagccugaagucgccaaccuggauauuaucggccagagaaucgagaauauuaaacacgaacauaaguccacauggcacuaugacgaggauaaccccuacaaaaccugggcuuaucaugggagcuacgaggugaagcccucuggauccgccagcuccaugguuaauggcguggucaagcuccugacaaaaccuugggacgugauccccaugguuacccaaauugcuaugacggauacaaccccuuuuggccagcagcggguguucaaggaaaaagucgacacccgcacaccgaaggccaaaagagggacggcucaaaucauggaggugaccgcccgguggcuuuggggauuucugagcagaaacaagaagccccggauuuguacacgcgaagaguucaccagaaaaguucggucuaaugcggccaucggcgcuguguuugucgacgaaaaccaguggaauagcgccaaggaggcuguggaggaugaacgcuucugggaccucguccagaaagagagagaacugcacaagcaggggaaaugcgccacaugcguguauaacaugaugggaaagcgggagaagaaacugggcgaauuugggaaggccaaaggcucccgcgcgaucugguacauguggcucggagcuagauuccuggaguuugaggcccuuggcuucaugaaugaagaucacugguucucucgggagaacagccuguccgggguugaaggagagggccuccauaagcugggguacauucuucgcgacaucucuaaaauuccuggaggcaauauguaugccgaugacaccgcugggugggauacaagaaucaccgaggacgaucugcaaaacgaagccaagauuacggacaucauggagcccgaacacgcucuccuggccaccagcaucuuuaaacugacauaccagaauaaggugguccgggugcagcgcccugcgaagaacggcaccgugauggauguuauuuccagacgggaccagcgcggaucuggccaaguggggacauauggacucaauaccuucacgaacauggaggcccagcugaucagacagauggaaagcgagggcauuuuucuucccuccgagcuggaaacaccgaaccucgcugagcggguccuggauuggcuugaaaaauacgggguggagagacugaagcgcauggccaucagcggagacgacuguguugugaaaccuauugaugaccgguucgcuaccgcccucacagcgcugaaugauaugggcaaggucagaaaagacaucccccagugggaaccuucuaagggguggaacgauuggcaacaggugcccuuuugcucccaucacuuccaccagcugaucaugaaggacggccgcgagauugucgugccuugucggaaucaggaugagcucguuggacgggcgcgcgugagccaaggcgcuggguggucucugcgggaaaccgccugccuuggaaaauccuaugcucagauguggcagcugauguacuuucauagacgcgaccuccggcuggccgcuaacgccaucuguagcgcgguccccguggauuggguuccgacguccagaaccacauggucuauucacgcccaucaccaauggaugaccacagaggacaugcuuagcguguggaaucgcgucuggaucgaagagaacccuuggauggaagauaagacccauguguccagcuggggcgacgugcccuaucuggggaaacgggaggaccaguggugcggaucucucauuggccugacagcuagagccaccugggccuccaauauccagguugcuauuaaccagguccggagacugaucgggaaugagaacuaccucgauuacaugacgagcaugaagcgcuucaaaaaugaaggcgaccccgagggagcccugugguga

SEQ ID NO: 19213 - RNA, 9879 nt, Artificial Sequence
  derived and/or modified CDS sequence (opt5) from DENV-1__GU131777__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccaucucuggaguuuauccucugagcauucccgcuacccuuuuugugugguacuucuggcagaagaagaagcagcgguccggcguccugugggacacgccuucucccccggaaguggagcgcgccguccuggaugacggcaucuauagaauuaugcagcgggggcuccugggacgcagccaggugggcguugggguguuccaagaaaacgucuuucauaccauguggcacgugacaagaggagccguucuuauguaccagggcaaacggcuggagccuuccugggcuagcgugaagaaagaccucaucucuuacgggggaggcuggagacugcagggcuccuggaauaccggggaggaaguccaggugauugccguggagcccggaaagaacccuaaaaauguucaaacaacccccggcacauucaagacgccggaaggggaggucggagcgaucgcucucgauuuuaagccuggcaccagcgggucucccaucgugaaccgcgaaggaaaaauugugggccuguauggcaauggggucgugacaaccuccggaaccuacguuagcgccaucgcccaggcuaaggccucccaggagggcccucuucccgagauugaagacgagguguuccggaaaagaaaccugacaaucauggaucugcaccccgggucuggaaagacgcgccgguaucucccugcgauugucagagaagcuaucaaacgcaagcugcggacccuuauccuggccccgacaagagugguugccagcgagauggcugaagcccucaagggcaugcccauucgcuaccaaaccacagcugugaaauccgagcauaccgggaaggagaucgucgaccugaugugccacgccacguuuacaaugcggcugcucagcccugugagaguucccaauuauaacaugauuaucauggaugaagcgcauuucaccgacccuucuuccauugccgcucggggcuacaucagcacccgcgugggaaugggcgaggccgcugccaucuuuaugacagccacacccccugggucugucgaggcuuucccgcagagcaaugcggugauucaggaugaggaaagagacauccccgagcgguccuggaacucuggauaugaguggauuacagauuuuccuggcaaaaccgugugguucguccccagcaucaaguccgggaaugacauugccaacugucuucgcaaaaauggaaagagaguuauccagcugucucggaagacguuugauacagaauaccagaaaaccaagaacaacgacugggacuacguggugacaaccgauauuagcgagaugggcgcuaauuucagagccgaccgcgucaucgauccucggagaugccugaaacccgugauccucaaggacgggccggaacgcguuauucuggccggcccuaugcccgugacggucgcuuccgccgcgcagcggagaggacgcaucggccggaaccacaauaaagagggggaucaguauauuuacaugggacagccccuuaacaaugacgaggaucaugcucacuggaccgaagccaagaugcugcucgacaacaucaauacaccugagggcauuauccccgcccuguucgaaccugagagagaaaagagcgcugccaucgauggggaguaucgccugagaggagaggcgcggaaaaccuuuguggaacucaugcgcagaggcgaccuuccgguuuggcugucuuacaagguggccuccgagggguuccaauauagcgaucggcgcuggugcuuugacggcgaaagaaacaaucagguccuggaggaaaacauggauguggagauuuggacaaaagagggagaacggaagaaacucagaccccgcuggcuggacgcucggaccuacuccgacccucuugcccugagagaguucaaggaauuugcugccggccgccggucugucagcggggaucucauccuggagauuggaaaacugccccagcaccucacacagagagcucaaaaugcccuugacaaccuggugaugcugcauaauuccgaacagggcgggcgggcguaucgccacgccauggaggagcucccugauaccaucgaaacgcugaugcuucuggcucucauugccguucugacaggaggcgugacccuguucuuucucucuggcagagggcuuggaaagaccagcaucggccugcugugugugauggcuuccagcguccuccuguggauggccucuguugagccccauuggaucgccgcuuccauuauccuugaguucuuucugauggugcuccugauuccggagccugaccggcagcgcacaccccaggauaaccaacuggcguacguggucaucgggcuccuuuucaugauucugaccguggccgcuaaugagaugggacugcucgaaacaacgaagaaagaccugggcaucgggcacguugccgugggaaaccaccaucacgccgcuaugcuugaugucgaccugcauccugccagcgcguggacccucuacgccguggcuacaaccauuaucacacccaugaugagacacaccaucgagaacacgaccgccaauauuucucugacagcuaucgccaaccaggcggccauucugaugggccucgauaagggcuggccuaucuccaaaauggacauuggggucccccuucuggcucugggaugcuauagccaggugaauccgcucacccugacagccgcuguucuuaugcugguggcccauuacgcuaucaucggcccugggcuccaagccaaggcgacccgggaagcccagaaacgcacggcugccggaauuaugaagaaccccacagucgauggcaucguggcuauugaccuggaucccguuguguaugacgccaaguuugagaaacagcuggggcagaucaugcuccuuauucuguguaccucucaaauccugcucaugagaacaaccugggcccugugcgaaagcaucacccuugcgacaggaccucugacgacccucugggagggcuccccgggcaaguucuggaauacaaccauugcugucucuauggccaacaucuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggauuauggaaguggaccgcuccgaggccaaagaaggacugaagcggggcgagacaaccaaacacgcggugucuagagggaccgccaaacuucgcugguuuguugagcggaaucuggucaaacccgaaggaaaggugaucgaucucggcugugggagaggaggcuggagcuacuauugcgcuggccugaagaaagugacagaggucaagggguacaccaaaggaggcccugggcacgaagaacccauuccuauggccacauacggauggaaccugguuaagcuccauuccggcaaagacguguucuuuauucccccugaaaagugugauacgcuucugugcgacauuggggagucuagcccgaaucccaccaucgaggaaggacgcacacugcgggugcucaaaauggucgagccuuggcugagaggcaaccaauucuguaucaagauucuuaaucccuauaugccuuccgugguugaaacccuggagcagaugcagcgcaagcacggcgggaugcucgugcggaacccccugagcagaaauucuacacaugagauguacugggucuccugcggaaccggcaacaucgugagcgcuguuaauaugacgucucgcaugcugcucaaccgguuuaccauggcccacagaaaaccgacauaugaacgcgauguggaccugggggcgggaaccagacacgucgccguggagccugaaguggcuaaccuugauauuaucggccagcggauugagaauaucaagcaugaacacaaauccacauggcauuacgacgaggauaaccccuauaagaccugggccuaccacgggagcuaugaggucaaacccucuggauccgcuagcuccaugguuaauggcguggugaagcugcucacaaagccuugggacgucauccccauggugacccaaauugccaugacggauacaaccccuuucggccagcagcgcguuuuuaaagaaaagguggacaccagaacaccgaaagcuaagcgggggacggcccaaaucauggaggucaccgcgaaauggcuguggggauuccuuagcagaaacaagaagccccggauuuguacacgcgaagaguuuaccagaaaagugcggucuaaugccgcuaucggcgccguuuucguggacgaaaaccaguggaauagcgcuaaggaggccgucgaggaugaacgcuuuugggaccuggugcauagagagcgggaacuccacaaacaggggaagugcgccacaugcguuuacaacaugaugggaaaacgcgagaagaagcugggcgaguucgggaaagcgaagggcuccagagcuauuugguacauguggcugggagcccgguuucucgaguucgaggcccugggcuucaugaaugaagaucacugguuuucucgcgagaacagccuuuccgggguggaaggagagggccugcauaaacucggguauauccugagagacaucucuaagauuccuggaggcaauauguacgcugaugacaccgccgggugggauacacggaucaccgaggacgaucuucagaacgaagcucgcauuacggacaucauggagcccgaacacgcccugcucgcgaaaagcauuuucaagcugaccuaucaaaauaaagucgugagaguccagcggccugccaagaacggcacagugauggauguuaucucccgcagagaccagcggggaucuggccagguggggaccuacggacugaauacauuuaccaacauggaggcucaacucaucagacagauggaaagcgagggcauuuucucccccagcgagcuggaaacgccgaaccuugccgagcgcguccuggauuggcucgaaaaguaugggguggagcggcugaaaagaauggcuaucucuggagacgacugugugguuaagccuauugaugaccgcuuugccacagcgcuuaccgcccugaaugauaugggcaaagugcggaaggacaucccccagugggaaccuuccaaaggguggaacgauuggcagcaaguccccuucugcagccaucacuuucaccagcucauuaugaaggacggcagagagaucgugguuccuugucgcaaucaggaugagcuggugggacgggcuagagucucucagggcgccggguggucccugcgcgaaacagcuugccucggaaagagcuacgcccaaauguggcagcugauguauuuccaucggagagaccuucgccuggcugccaacgcgauuuguuccgccgugcccgucgauuggaucccgaccucucggacgaccuggagcauccacgcucaucaccaguggaugacaaccgaggacaugcucuccguguggaauagaguuuggauugaagagaacccuuggauggaagauaaaacacauaucagcucuuggggcgacgugcccuaccuggggaagcgggaggaccaauggugcggaucccuuauuggccugaccgccagagccacaugggcuaccaauauccaggucgccauuaaccaggugcgccggcucaucgggaaugagaacuaccuggauuauaugacgagcaugaaaagauuuaagaaugaaucugaccccgagggcgcgcugugguga

SEQ ID NO: 19214 - RNA, 9879 nt, Artificial Sequence
  derived and/or modified CDS sequence (opt5) from DENV-1__GU131778__SS-prME
agcgugaccaugcugcugaugcugaugcccaccgcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcaccggcgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggccccgcucccauacccucuggagcaacgggguccuggaaucugagaugauuaucccgaagauuuauggaggcccuaucagccagcacaauuaccggcccggguacuuuacacaaaccgcgggaccuuggcaucugggcaaacucgagcuggauuucgaccuuugcgaagggacgaccgugguuguggaugagcacugcggaaacagaggccccucccugcggacaaccacagucaccggcaagauuauccacgaaugguguugccgcagcuguacgcucccuccccugagauuuaaaggggaggacggaugcugguauggcauggagauccggccggugaaggaaaaggaggaaaaucugguuaaaucuaugguguccgcugggagcggagaggucgacuccuucucucuuggccuccuguguauuagcaucaugauugaagaggugaugagaucccgcuggucucggaagaugcugaugacagggacccucgccgucuuuuuccugcuuaucaugggacagcugacauggaacgaucucauuagacugugcaucauggugggcgccaaugcuagcgaccgcaugggcauggggaccaccuaccuggcccuuauggcgacauuuaaaaugagaccuauguucgcugucggacugcucuuucggcgccugacguccagagaggugcuccugcuuaccauuggccugucucucguggccagcgucgaacugcccaacucccuggaggaacuuggggauggacuggccaugggcaucaugauccucaagcugcucacagacuuccagagccaucaacugugggcuacccuucugucucucacauuuauuaaaaccacguucucccugcacuaugccuggaagacaauggcuaugguucugagcaucgugucucuuuuuccccugugucucuccaccaccagccagaagacaaccuggcugccugugcuccuggggucucuuggaugcaaaccgcugacaauguuccugauugccgagaauaagaucuggggccggaaauccuggccccucaacgaaggcauuauggcggucgggaucgugagcauccugcuuuccagccugcucaagaacgauguuccucuggccggaccccucauugcuggcgggaugcugaucgccuguuacgugauuucuggaagcuccgcugaccuuucucuggagaaagccgccgaggucagcugggaagaggaagcugagcauuccggcgcgucucacaauauccugguggaaguucaggaugacgggacgaugaagauuaaagaugaggagcgcgacgauacccucacaauccugcuuaaggccacccugcucgcugugagcggagucuauccucuguccauccccgccacacucuucgugugguacuuuuggcagaagaaaaagcaaagaucuggcguccugugggacauuccuuccccucccgaaguggagcgggccguucuugaugacggcaucuaucgcauuaugcagagagggcugcugggacggucccaggugggcgucgggguguuccaggaaaacguuuuucauaccauguggcacgugacgcgcggagcuguccucauguaccaaggcaaaagacuggagcccagcugggccucugugaagaaagaccuuaucuccuacgggggaggcuggcggcugcagggcagcuggaauaccggggaggaagugcagguuauugcggucgagcccggaaagaacccuaagaaugugcagacagcucccggcaccuucaaaacaucugaaggggaggugggagccaucgcccucgauuuuaagccgggcaccuccgggagcccuauugucaacagagaaggaaaaaucgugggccuguauggcaaugggguugugacaacguccggaaccuacgucucugcuaucgcccaagcgaaggcuagccaggagggcccccucccugagauugaagacgagguguuccgcaaacggaaccugacaaucauggaucuucaccccggguccggaaagaccagacgcuaucugcccgccauuguucgggaagccaucaagagaaaacugcgcacccucauucuggcuccuacacggguggucgccagcgagauggcugaagcccuuaagggcaugccgaucagauaccagacgaccgcggugaaaucugagcauacagggaaggagaucguugaccugaugugccacgccaccuuuacaaugcgccuccugucccccgugcgggucccuaauuauaacaugauuaucauggaugaagcucauuucaccgaccccagcucuauugccgcuagaggcuacaucagcacgcgggugggaaugggcgaggccgccgcuauuuuuaugacagcgaccccucccggguccguggaagccuucccucaaucuaaugcugucauccaggaugaggaacgcgacaucccggagagaagcuggaacuccggauaugaguggauuaccgauuuucccggcaaaacaguuugguucgugccuucuaucaagagcgggaaugacauugccaacugucugcggaagaauggaaaacgcgugauccagcucuccagaaagaccuucgauacagaauaccagaaaaccaagaacaacgacugggacuacgucgugacgacagauauuagcgagaugggcgccaauuuucgggcugacagaguuaucgauccccgccggugccuuaaaccugugauucugaaggacgggcccgaaagagucauccuggccggcccgaugccugugaccguugcgucugcugcccaacgccggggaagaaucggccgcaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgggaaaaguccgcggccauugauggggaguauagacuccgcggagaggcuagaaaaacguuuguggaacugaugcggcgcggcgaccugccugucuggcucagcuacaagguggccuccgagggguuccaguauucugauagacgguggugcuuugacggcgaacgcaacaaucaaguccuugaggaaaacauggauguggagaucuggaccaaagagggagaaagaaagaaacugcggccgagauggcuggacgcucgcacauacagcgacccccucgcccugcgggaguucaaggaauuugcugccggcagacgcuccguuucuggggaucuuauccuggagauuggaaagcucccucagcaccugacccagcgggcgcagaaugcccuggacaaccucgugaugcuucauaauagcgaacaaggcgggagagcuuaucggcacgccauggaggagcugcccgauacaaucgaaacccugaugcuccuggcucuuauugccgugcugacaggaggcgucacccucuucuuucuguccggccgcgggcugggaaaaacgagcaucggccuccuuuguguuauggccucuuccgugcugcuguggauggcuagcguggagccucauuggauugcggccucuaucauccucgaguucuuucugaugguccuucugauucccgagccggacagacagcggacaccucaggauaaccagcucgcuuacgugguuaucgggcugcuguucaugauucucaccguggccgccaaugagaugggacuucuggaaaccacaaagaaagaccugggcaucgggcacgucgcuguggagaaccaccaucacgccgcgaugcucgaugucgaccugcaucccgccuccgcuuggacccuuuacgccguggcuacaacgauuaucaccccuaugaugcgccacacaauugaaaacaccacagccaauaucagccugaccgcgaucgccaaccaagcugccauucucaugggacuggauaagggcuggcccaucucuaaaauggacauuggcguuccucugcucgcucuugggugcuauagccaggugaauccccugacgcugaccgccgcuguccucaugcugguggcccauuacgcgaucauuggaccgggccuucaggccaaggcuacaagagaggcccaaaagcggaccgcugccgggaucaugaaaaacccuacaguugauggaaucguggccauugaccuggaucccgucguguaugacgcgaaguuugaaaaacagcucggccagaucaugcugcugauucucuguaccucccagauccuucugaugcgcacgacaugggcucugugcgagucuauuacccucgccacagggccccugaccacccuuugggagggaagcccuggcaaguucuggaauacaacgaucgcuguguccauggccaacaucuucagaggcagcuaccuggccggggcuggacucgccuuuucccugaugaaaucucugggcgggggacggcgcggcaccggggcgcaaggagaaacacucggcgagaaguggaagagacagcuuaaucagcugagcaaauccgaguucaacaccuauaagcggucuggcauuauggagguugacagaagcgaagccaaagaggggcugaagcgcggagagacaaccaaacacgcugucucccggggcacggccaagcucagaugguuuguggaacgcaaucuggugaagccggaggggaaagucaucgaucuuggauguggcagagggggauggucuuacuauugcgcuggccugaagaaaguuacagaagugaagggcuacaccaaagggggacccggccacgaggaaccuauucccauggccaccuacggguggaaccucgugaagcugcauagcggaaaagacgucuucuuuaucccucccgagaagugugauacacugcucugcgacauuggcgaguccagcccuaauccgaccaucgaagaggggagaacacuucgcgugcugaagaugguugaacccuggcugcggggaaaccaguucuguauuaaaauccucaauccuuauaugcccucuguggucgagacgcuggagcaaaugcagagaaagcacggcggcaugcuugugcgcaacccucugucccggaauagcacccaugaaauguacuggguuucuugcgggacaggaaacaucguguccgcggucaauaugaccagcagaaugcuccugaaccgcuuuacaauggcccaccggaaacccaccuaugagagagauguggaccugggcgcugggacgcgccacguggccgucgaaccggagguugcuaaccucgauauuaucggacagagaauugaaaauaucaagcaugagcacaaaucuaccuggcauuacgacgaggauaacccuuauaagacaugggccuaccacggcuccuaugaagugaagcccagcggguccgcuagcucuauggugaauggagucgugaaacugcuuaccaagcccugggacguuauuccuauggugacacagaucgccaugaccgauacaacccccuucggccaacagcgggucuuuaaagagaagguggacacgcgcacaccuaaagcgaagagaggcaccgcccagaucauggaaguuaccgcuaaguggcuguggggguuccucagccggaacaaaaagccgagaauuuguacacgggaggaauuuacgcgcaaagugagauccaaugccgcuaucggagccgucuucguggacgagaaccaauggaacucugccaaggaggcgguugaagaugagcgguuuugggaccuggugcaucgcgaaagagagcuucacaaacagggcaagugcgcuaccugcgucuacaacaugauggggaagcgggagaagaagcugggagaguucggcaaagccaaggggagccgcgccauuugguacauguggcucggcgcuagauuccuggaguuugaagcccugggauucaugaaugaggaucacugguuuucccgggaaaacucucucagcggcguggagggggagggacugcauaaacuuggcuauauccugcgcgacauuuccagaauccccgggggaaauauguacgcugaugacacagccggcugggauacccggaucacagaagacgaucuccagaacgaggcgaagauuaccgacaucauggaaccugagcacgcccugcuugcuaaaucuauuuucaagcugacauaucagaauaaggucgugcgcguucaaagacccgccaaaaacgggaccgugauggaugucaucagccggcgcgaccagagaggcuccggacaggugggcacguacgggcucaauaccuuuacaaacauggaagcucagcugauucggcaaauggagagcgagggaaucuucucuccuuccgaacuggagacccccaaccucgccggcagagugcuggauuggcuugaaaagcaugggguugagcgccugaaacggauggcgaucagcggagacgacuguguggucaagccgauugaugacagauuugccacagcucucaccgcccugaaugauaugggcaaagugcgcaaggacaucccucagugggaacccucuaagggguggaacgauuggcagcagguuccuuucugcucccaccacuuucaucaacuuauuaugaaagacggccgggagaucgugguccccuguagaaaucaggaugagcuggugggacgcgcucgggucagccagggcgccggguggucccucagagaaacggcuugccugggaaagucuuaugcccagauguggcaacugauguacuuccaccgccgggaccucagacuggcggccaacgcuauuuguagcgccgugccuguugauugggugcccacaucccgcaccacauggagcauccaugcccaccaucaguggaugaccacggaggacaugcuuucugucuggaaucggguguggauugaagagaacccguggauggaagauaaaacccacaucuccagcuggggcgacguuccuuaucuggggaagagagaggaccaguggugcggaucucucaucggccugacagcucgggccaccugggcgacaaauauucaaguggcuaucaaccaggucagacgccuuauugggaaugagaacuaccuggauuacaugaccagcaugaaacgguuuaagaaugaauccgaccccgagggcgcccucugguga

SEQ ID NO: 19215 - RNA, 9879 nt, Artificial Sequence
  derived and/or modified CDS sequence (opt5) from DENV-1__GU131779__SS-prME
agcgugaccaugcugcucaugcugaugcccacagcccuugcuuuccaccugacgaccagaggcggggagccucauaugaucguguccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggugucugucgaacuucccaacagccuggaggaacucggggauggacuggcuaugggcauuaugauccucaaacugcuuaccgacuuccaaucccaucagcugugggccacacuccugagccugaccuuuauuaagacgacauucucucuucacuaugccuggaaaaccauggcuaugguucuguccaucgugagccucuuuccccugugucucucuaccacaucccagaagaccacauggcugccugugcuucuggggagccugggaugcaagccgcucacgauguuccugauugccgagaauaaaaucuggggccggcgcucuuggccccuuaacgaaggcaucauggcugucgggauuguguccauccugcucagcucccugcucaagaacgauguuccucuggccggaccccuuauugcgggcgggaugcugaucgccuguuacgugauuagcggaucuagcgcugaccugucccucgagaaagccgcugaggucucuugggaagaggaagccgagcauagcggcgccucccacaauauccugguggaaguucaggaugacgggaccaugaagaucaaagaugaggagagagacgauacacuuaccauucugcucaaggcuacacugcucgcggugucuggagucuauccucugagcauccccgccacccuuuuugugugguacuucuggcagaagaagaagcagcgguccggcguccugugggacacgccuucucccccggaaguggagcgcgcuguucuggaugacggcauuuauagaaucaugcagcgggggcuccugggacgcagccaggugggcgucgggguguuccaagaaaacguuuuucauaccauguggcacgugacaagaggagccguccuuauguaccagggcaaacggcuggagccuuccugggccagcgugaagaaagaccucauuucuuacgggggaggcuggagacugcagggcuccuggaauaccggggaggaagugcagguuaucgcugucgagcccggaaagaacccuaaaaaugugcaaacaacccccggcacauucaagacgccggaaggggaggugggagccauugcgcucgauuuuaagccuggcaccagcgggucucccaucgucaaccgcgaaggaaaaaucgugggccuguauggcaaugggguugugacaaccuccggaaccuacgucagcgcuauugcccaggccaaggcuucccaggagggcccucuucccgagaucgaagacgagguguuccggaaaagaaaccugacaauuauggaucugcaccccgggucuggaaagacgcgccgguaucucccugccaucguuagagaagcgauuaaacgcaagcugcggacccuuauccuggcuccgacaagaguggucgccagcgagauggccgaagcucucaagggcaugcccauccgcuaccaaaccacagccgugaaauccgagcauaccgggaaggagauuguugaccugaugugccacgcuacguuuacaaugcggcugcucagcccugugagaguccccaauuauaacaugaucauuauggaugaagcccauuucaccgacccuucuuccaucgcggcccggggcuacauuagcacccgcgugggaaugggcgaggcugccgcuaucuuuaugacagccacacccccugggucuguggaagccuucccgcagagcaaugcugucauccaggaugaggaaagagacauucccgagcgguccuggaacucuggauaugaguggaucacagauuuuccuggcaaaaccguuugguucgugcccagcauuaaguccgggaaugacaucgcgaacugucuucgcaaaaauggaaagagagugauucagcugucucggaagacguuugauacagaauaccagaaaaccaagaacaacgacugggacuacgucgugacaaccgauaucagcgagaugggcgccaauuucagagcugaccgcguuauugauccucggagaugccugaaacccgugauccucaaggacgggccggaacgcgucauccuggccggcccuaugcccgugacgguugccuccgcugcccagcggagaggacgcauuggccggaaccacaauaaagagggggaucaguauaucuacaugggacagccccuuaacaaugacgaggaucaugcgcacuggaccgaagcuaagaugcugcucgacaacauuaauacaccugagggcaucauucccgcccuguucgaaccugagagagaaaagagcgccgcuaucgauggggaguaucgccugagaggagaggcccggaaaaccuuuguggaacucaugcgcagaggcgaccuuccggucuggcugucuuacaagguggcguccgagggguuccaauauagcgaucggcgcuggugcuuugacggcgaaagaaacaaucagguccuggaggaaaacauggauguggagaucuggacaaaagagggagaacggaagaaacucagaccccgcuggcuggacgcccggaccuacuccgacccucuugcucugagagaguucaaggaauuugccgcuggccgccggucuguuagcggggaucucauucuggagaucggaaaacugccccagcaccucacacagagagcccaaaaugcucuugacaaccuggugaugcugcauaauuccgaacagggcgggcgggccuaucgccacgcgauggaggagcucccugauaccauugaaacgcugaugcuucuggcccucaucgcugugcugacaggaggcgucacccuguucuuucucucuggcagagggcuuggaaagaccagcauuggccugcuguguguuauggccuccagcgugcuccuguggauggcuucuguggagccccauuggaucgccgccuccaucauucuugaguucuuucugaugguccuccugaucccggagccugaccggcagcgcacaccccaggauaaccaacuggcuuacgugguuauugggcuccuuuucaugauccugaccguggcggccaaugagaugggacugcucgaaacaacgaagaaagaccugggcauugggcacgucgcugugggaaaccaccaucacgccgccaugcuugaugucgaccugcauccugcuagcgccuggacccucuacgcgguggccacaaccaucauuacacccaugaugagacacaccaucgagaacacgaccgcuaauaucucucugacagccauugcuaaccaggccgcgauccugaugggccucgauaagggcuggccuauuuccaaaauggacaucgggguuccccuucuggcccugggaugcuauagccaggugaauccgcucacccugacagcugccguccuuaugcugguggcucauuacgccauuaucggcccugggcuccaagcuaaggccacccgggaagcgcagaaacgcacggccgcuggaaucaugaagaaccccacaguugauggcauuguggccaucgaccuggaucccgucguguaugacgcuaaguuugagaaacagcuggggcagauuaugcuccuuauccuguguaccucucaaauucugcucaugagaacaaccugggcccugugcgaaagcaucacccuugccacaggaccucugacgacccucugggagggcuccccgggcaaguucuggaauacaaccaucgcggugucuauggcuaacauuuuucgggggagcuaccuggccggagcuggccuggccuucucccucaugaaaagccuugggggaggccgcagagggacaggagcccagggcgagacccugggcgaaaaguggaaacggcagcugaaucagcucuccaagucugaguucaacacguauaagagaagcgggaucauggaaguugaccgcuccgaggcuaaagaaggacugaagcggggcgagacaaccaaacacgccgucucuagagggaccgcgaaacuucgcugguuuguggagcggaaucuggugaaacccgaaggaaaggucauugaucucggcugugggagaggaggcuggagcuacuauugcgccggccugaagaaaguuacagaggugaagggguacaccaaaggaggcccugggcacgaagaacccaucccuauggcuacauacggauggaaccuggugaagcuccauuccggcaaagacgucuucuuuauucccccugaaaagugugauacgcuucugugcgacaucggggagucuagcccgaaucccaccauugaggaaggacgcacacugcgggugcucaaaaugguugagccuuggcugagaggcaaccaauucuguaucaagauccuuaaucccuauaugccuuccguggucgaaacccuggagcagaugcagcgcaagcacggcgggaugcucgugcggaacccccugagcagaaauucuacacaugagauguacuggguuuccugcggaaccggcaacauugugagcgccgucaauaugacgucucgcaugcugcucaaccgguuuaccauggcucacagaaaaccgacauaugaacgcgauguggaccugggggccggaaccagacacguggcggucgagccugaaguugccaaccuugauaucauuggccagcggaucgagaauauuaagcaugaacacaaauccacauggcauuacgacgaggauaaccccuauaagaccugggcuuaccacgggagcuaugaggugaaacccucuggauccgccagcuccauggugaauggcgucgugaagcugcucacaaagccuugggacguuauccccauggugacccaaaucgcuaugacggauacaaccccuuucggccagcagcgcgucuuuaaagaaaagguggacaccagaacaccgaaagccaagcgggggacggcucaaauuauggagguuaccgccaaauggcuguggggauuccuuagcagaaacaagaagccccggaucuguacacgcgaagaguuuaccagaaaagugcggucuaaugcggccauuggcgcugucuucguggacgaaaaccaguggaauagcgccaaggaggcuguugaggaugaacgcuuuugggaccuggugcauagagagcgggaacuccacaaacaggggaagugcgccacaugcgucuacaacaugaugggaaaacgcgagaagaagcugggcgaguucgggaaagccaagggcuccagagcgaucugguacauguggcugggagcucgguuucucgaguucgaggcccugggcuucaugaaugaagaucacugguuuucucgcgagaacagccuuuccgggguggaaggagagggccugcauaaacucggguauauucugagagacaucucuaagaucccuggaggcaauauguacgccgaugacaccgcugggugggauacacggauuaccgaggacgaucuucagaacgaagcccgcaucacggacauuauggagcccgaacacgcucugcucgccaaaagcaucuucaagcugaccuaucaaaauaaagucgugagaguucagcggccugcgaagaacggcacagugauggaugucauuucccgcagagaccagcggggaucuggccagguggggaccuacggacugaauacauuuaccaacauggaggcccaacucaucagacagauggaaagcgagggcaucuucucccccagcgagcuggaaacgccgaaccuugcugagcgcgugcuggauuggcucgaaaaguaugggguugagcggcugaaaagaauggccauuucuggagacgacuguguggucaagccuaucgaugaccgcuuugcuacagcccuuaccgcgcugaaugauaugggcaaagugcggaaggacauuccccagugggaaccuuccaaaggguggaacgauuggcagcaaguucccuucugcagccaucacuuucaccagcucaucaugaaggacggcagagagauuguggucccuugucgcaaucaggaugagcuggugggacgggccagagucucucagggcgcuggguggucccugcgcgaaacagccugccucggaaagagcuacgcucaaauguggcagcugauguauuuccaucggagagaccuucgccuggccgcuaacgccaucuguuccgcggugcccguugauuggauuccgaccucucggacgaccuggagcauccacgcccaucaccaguggaugacaaccgaggacaugcucuccguguggaauagagucuggaucgaagagaacccuuggauggaagauaaaacacauauuagcucuuggggcgacgugcccuaccuggggaagcgggaggaccaauggugcggaucccuuaucggccugaccgcuagagccacaugggccaccaauauucagguugcuaucaaccaggugcgccggcucauugggaaugagaacuaccuggauuauaugacgagcaugaaaagauuuaagaaugaaucugaccccgagggcgcccugugguga

SEQ ID NO: 19216 - RNA, 9879 nt, Artificial Sequence
  derived and/or modified CDS sequence (opt5) from DENV-1__GU131780__SS-prME
agcgugaccaugcugcucaugcugaugcccaccgcccuugcuuuccaccugacgaccagaggaggggagccucauaugaucgucuccaagcaggaacggggaaagucucuccuguuuaagacaagcgccggcguuaacaugugcacccuuauugccauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaagcagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucucuggccaucugaagugcagacucaaaauggauaagcugacgcuuaaagggauguccuaugugauguguacaggcagcuucaagcuggagaaggaagucgcugagacccagcacggaaccgugcucguucagaucaaauacgagggcacagacgccccgugcaagauuccuuuuucuacccaggaugaaaaaggggugacacaaaacggacggcugaucacggcgaaucccaucgucaccgacaaggagaaaccugugaacauugaagcugagccgcccuucggcgagagcuauaucgugauuggggccggagaaaaggcccugaaacuuuccugguuuaaaaagggcucuagcaucgggaaaauguucgaggcuacagccagaggcgcucgccggauggccauucucggagauaccgcgugggacuuuggcuccaucgggggaguuuucacaagcgucggcaagcuggugcaucagaucuuugggaccgccuacggagugcuguucucuggcgucuccuggacgaugaaaauugggaucggcgugcuccugaccuggcuuggacugaauagcagaucuacaucccucagcaugaccuguauugcuguuggccuggugacacuguaccuuggggucauggugcaggccgauuccggaugcguuaucaacuggaagggccgcgaacucaagugugggucuggaauuuuugugaccaaugagguccacacauggaccgaacaguauaaauuccaagcugacagcccuaagcggcuguccgccgcgaucggcaaagccugggaggagggggugugcggcauuagaucugcuacgcgccuggaaaacaucauguggaagcagaucagcaacgagcucaaucauauucugcuugaaaacgacaugaaauuuacaguuguggucggagauguggccggcauccuggcucaggggaagaaaaugauucggccgcagcccauggaguacaaguauuccuggaaaagcuggggaaaagccaagaucauuggcgccgacgugcaaaauaccaccuucaucaucgaugggccuaacacacccgaauguccugacgaucagagagcuuggaauauuugggaggucgaggacuacggauuuggcaucuucaccacgaacauuuggcucaaacugcgcgauucuuauacacagguuugcgaccaccggcugauguccgcggccaucaaggauagcaaagcugugcacgccgacaugggcuacuggauugaaucugagaagaaugaaaccuggaaacuugccagagcuuccuucaucgaggugaaaacauguaucuggcccaagagccauacccucuggucuaacgggguccuggaaagcgagaugauuaucccgaaaauuuauggaggcccuaucucccagcacaauuaccgccccggguacuuuacacaaaccgccggaccuuggcaucugggcaagcucgagcuggauuucgaccuuugcgaagggacgaccgugguuguggaugagcacugcggaaaccggggccccagccugagaacaaccacagucaccggcaaaauuauccacgaaugguguugccggucuuguacgcucccuccccugcgcuuuaagggggaggacggaugcugguauggcauggagaucagaccggugaaggaaaaagaggaaaaucugguuaaguccauggugagcgcgggguccggagaggucgacucuuucagccuuggccuccuguguauuuccaucaugauugaagaggugaugcggucuagauggagccgcaaaaugcugaugacagggacccucgcugucuuuuuccugcuuaucaugggacagcugacauggaacgaucucauucggcugugcaucauggugggcgccaaugccuccgacagaaugggcauggggaccaccuaccuggcucuuauggccacauuuaagaugcgcccuauguucgcggucggacugcucuuuagacggcugacgucucgcgaggugcuccugcuuaccauuggccugagccucguggcuuccgucgaacugcccaacagccuggaggaacuuggggauggacuggccaugggcaucaugauccucaaacugcucacagacuuccagucucaucaacugugggccacccuucugucccucacauuuauuaagaccacguucagccugcacuaugcuuggaagacaauggccaugguucugucuaucgugucccuuuuuccccugugucucagcaccaccucucagaaaacaaccuggcugccugugcuccuggggucccuuggaugcaagccgcugacaauguuccugauugcugagaauaaaaucuggggcagaaagagcuggccccucaacgaaggcauuauggccgucgggaucguguccauccugcuuagcucucugcucaaaaacgauguuccucuggcgggaccccucauugccggcgggaugcugaucgcuuguuacgugauuagcggauccucugccgaccuuagccuggagaaggcugccgaggucuccugggaagaggaagccgagcauucuggcgcuagccacaauauccugguggaaguucaggaugacgggacgaugaaaauuaaggaugaggagcgggacgauacccucacaauccugcuuaaggcgacccugcucacaguguccggagucuauccucugucuauccccgccacccucuucgugugguacuuuuggcagaaaaagaaacaacgcagcggcguccugugggacacgccuagcccucccaagguggaaagagcuguucuugaugacggcauuuaucggaucaugcagcgcgggcugcugggaagaagccaggugggcgucgggguguuccaggagaacguuuuucauaccauguggcacgugacacggggagccguccucauguaccaaggcaaacgccuggaacccucuugggccuccgugaagaaggaccuuauuagcuacgggggaggcuggagacugcagggcucuuggaauaccggggaggaggugcagguuaucgcugucgaacccggcaagaacccuaagaaugugcagacagcccccggcaccuucaaaacauccgagggggaagugggagcgauugcucucgauuuuaagccgggcacgagcggguccccuaucgucaaccgggagggaaaaauugugggccuguauggcaaugggguugugaccacaucuggaaccuacgucagcgccaucgcccaagcuaaggccucccaggaaggcccccucccugagaucgaggacgaaguguucagaaagcgcaaccugaccauuauggaucuucaccccgggagcggaaaaacacggagauaucugcccgcgaucguucgcgaggcuauuaagcggaaacugagaacgcucauccuggccccuacccgcguggucgccucugaaauggcugaggcccuuaagggcaugccgauucgguaccagacaaccgcugugaaauccgaacauacagggaaggagaucguugaccugaugugccacgccaccuuuacgaugagacuccugagccccgugcgcgucccuaauuauaacaugaucauuauggaugaggcgcauuucacagaccccucuagcaucgccgcucggggcuacauuuccaccagagugggaaugggcgaagccgcugccaucuuuaugaccgccacaccucccgggucuguggaggcuuucccucaaagcaaugcggucauucaggaugaagaacgggacaucccggaacgcuccuggaacucuggauaugaguggaucaccgauuuucccggcaagacaguuugguucgugccuagcauuaaauccgggaaugacaucgccaacugucugagaaagaauggaaaacgggugauucagcucagccgcaagaccuucgauacggaguaccagaaaacaaagaacaacgacugggacuacgucgugaccacagauaucucugaaaugggcgcuaauuuuagagccgaccggguuauugaucccagacgcugccuuaagccugugauccugaaagacgggcccgagcgggucauucuggccggcccgaugccugugaccguugcuuccgccgcgcaaagacgcggacggaucggcagaaaccacaauaaggaaggggaucaguauaucuacaugggacagccccucaacaaugacgaggaucaugcucacuggacggaggccaaaaugcugcuugacaacauuaauacccccgaaggcaucauuccugcccuguucgagcccgaacgcgaaaaguccgcugccaucgauggggaauaucggcucagaggagaggcgcgcaaaacauuuguggagcugaugagacggggcgaccugccugucuggcucuccuacaagguggccucugaaggguuccaguauagcgaucgcagauggugcuuugacggcgagcggaacaaucaaguccuugaagagaacauggauguggaaauuuggaccaaagagggagagcgcaagaagcugagaccgcgguggcuggacgcuagaacauacuccgacccccucgcccugcgcgaguucaaagaguuugcugccggccggagaucuguuagcggggaucuuauccuggaaaucggaaagcucccucagcaccugacccagcgcgcucagaaugcccuggacaaccucgugaugcuucauaauuccgagcaaggcgggcgggcguauagacacgccauggaggaacugcccgauacaauugagaccaugaugcugcucgcucugaucgccgugcuuacgggaggcgucacacuguucuuucucagcggccgggggcugggaaaaaccucuauuggccugcucuguguuauggcuuccagcgugcuucuguggauggccucuguggaaccucauuggaucgccgcuuccauuauccuggaguucuuucucaugguccugcuuauccccgaaccggaccgccagagaaccccucaggauaaccagcuggcguacgugguuauugggcuccuguucaugauccugacaguggccgcuaaugagaugggacuccuugagaccacaaagaaagaccugggcauugggcacgucgccguggaaaaccaccaucacgccgcuaugcuggaugucgaccuccaucccgccagcgcguggacgcuguacgccguggcuaccacaaucauuaccccuaugaugcggcacacaaucgagaacaccacggccaauauuucucuuaccgcuaucgccaaccaagcggccauccugaugggacucgauaagggcuggcccauuagcaagauggacaucggcguuccucugcuggcucucgggugcuauucccaggugaauccccuuacacugaccgccgcuguccugaugcucguggcccauuacgcuauuaucggaccgggccugcaggccaaagcgacacgcgaagcccaaaagagaaccgcugccgggauuaugaaaaacccuacgguugauggaaucguggcuaucgaccuugaucccgucguguaugacgccaaguuugagaaacagcugggccagauuaugcuccugauccuguguacaucucagauucuccuuaugcggaccacaugggcccugugcgaaagcaucacccuggcgaccgggccccucacaacgcugugggagggauccccuggcaaguucuggaauaccacaauugcugugagcauggccaacaucuuccgcggcuccuaccuugcuggggccggacuggccuuuucucucaugaagucccugggcgggggaagacggggcaccggggcucaaggagagacacugggcgaaaaauggaagcgccagcucaaucagcuuuccaaaucugaguucaacaccuauaagagaagcggcaucauggaaguugaccgguccgaggccaaagaagggcugaagagaggagagacgacaaagcacgcggucucucgcggcaccgccaaacugcggugguuuguggagagaaaucucgugaagccggaagggaaagucauugaucugggauguggccgcgggggauggagcuacuauugcgcuggccuuaagaaaguuaccgaggugaagggcuacacaaaagggggacccggccacgaggagccuauccccauggccaccuacggguggaaccuggugaagcuccauuccggaaaggacgucuucuuuauuccucccgaaaaaugugauacacugcugugcgacaucggcgagagcucuccuaauccgacgauugaggaagggcggacccucagagugcuuaagaugguugagcccuggcugcgcggaaaccaguucuguaucaaaauucugaauccuuauaugcccuccguggucgaaacacucgagcaaaugcagcggaagcacggcggcaugcuggugagaaacccucuuagccgcaauucuacccaugagauguacuggguuuccugcgggacaggaaacaucgugagcgcugucaauaugaccucucggaugcugcucaacagauuuacgauggcccaccgcaaacccaccuaugaacgggauguggaccugggcgcggggacaagacacguggccgucgagccggaaguugcuaaccuggauaucauuggacagcgcaucgagaauauuaagcaugaacacaaguccaccuggcauuacgacgaggauaacccuuauaaaacaugggccuaccacggcagcuaugaggugaagcccuccgggagcgcuucuagcauggugaauggagucgugaaacuccugaccaagcccugggacguuaucccuauggugacacagauugccaugaccgauacgacacccuucggccaacagagagucuuuaaagaaaagguggacacccggaccccuaaggcuaaacgcggcacagcccagaucauggagguuacggcgaaguggcuuuggggguuccuguccagaaacaaaaagccgcggaucuguaccagagaagaguuuacacggaaagugcgcucuaaugccgcuauuggagccgucuucguggacgaaaaccaauggaauagcgcuaaggaggccguugaggaugaaagauuuugggaccucgugcaucgggagcgcgaacugcacaagcagggcaaaugcgcgaccugcgucuacaacaugauggggaagagagagaagaaacuuggagaguucggcaaagcgaaggggucccgggcuaucugguacauguggcugggcgcccgcuuccucgaguuugaggcccugggauucaugaaugaagaucacugguuuucuagagagaacagccuguccggcguggaaggggagggacuccauaaacugggcuauauucuucgggacaucucuaagauucccgggggaaauauguacgcugaugacacagccggcugggauacccgcaucacagaggacgaucugcagaacgaagcuaagaucaccgacauuauggagccugaacacgcccuccuggcgaaaagcaucuucaaacuuacguaucagaauaaagucgugagaguucaacggcccgccaagaacgggaccgugauggaugucauuucccgcagagaccagcggggcagcggacaggugggcacauacgggcugaauaccuuuacaaacauggaggcucagcucauccgccaaauggaaucugagggaauuuucuccccuagcgagcuggaaacccccaaccuggccagacgggugcucgauuggcuggagaaacauggcguugaaagacuuaagcgcauggcuaucucuggggacgacuguguggucaagccgaucgaugaccgguuugccacggcgcugacagcccucaaugauaugggaaaagugagaaaggacauuccucagugggagcccuccaaaggcuggaacgauuggcagcagguuccuuucugcagccaccacuuucaucaacugaucaugaaggacgggcgcgaaauugugguccccugucggaaucaggaugagcuugugggcagagcucgcgucucccagggagccggcuggucucugcgggagaccgcuugccucgggaaaagcuaugcccagauguggcaacugauguacuuccacagacgcgaccugcggcucgcugccaacgcgaucuguuccgccgugccuguugauugggugcccacaagcagaaccacguggucuauucaugcucaccaucaguggaugaccacagaagacaugcuguccgucuggaaucgcguguggaucgaggaaaacccguggauggaggauaagacccacauuagcucuuggggagacguuccuuaucuuggcaagcgggaagaccaguggugcgggagccugaucggacucacagccagagccaccugggcuacaaauauccaaguggccauuaaccagguccggagacugaucggcaaugagaacuaccuugauuacaugaccuccaugaaacgcuuuaagaaugagucugaccccgaaggggcgcugugguga

SEQ ID NO: 19217 - RNA, 9879 nt, Artificial Sequence
  derived and/or modified CDS sequence (opt5) from DENV-1__GU131781__SS-prME
agcgugaccaugcugcugaugcugaugcccacggcccuugcuuuccaccugacgaccagaggaggggagccucauaugaucgucuccaagcaggaacggggaaagucucuccuguuuaagacaagcgccggcguuaauaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagauaagccugugaacaucgaggccgaaccgcccuucggcgagucuuauauugugaucggggccggagagaaagcucugaaacuuagcugguuuaagaaaggcuccucuauugggaagauguucgaagccaccgcuagaggcgcccgccggauggcgauccucggagacacagccugggauuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugacagcggaugcguugugaacuggaaaggccgcgagcucaaguguggguccggaauuuuugucacaaaugaagugcacaccuggacagagcaauauaaguuccaggccgacucuccuaaacggcugagcgcggccaucggcaaggcuugggaagaggggguuugcggcauuagauccgccacccgccuggagaacaucauguggaaacagaucucuaacgaacucaaucauauucugcuugagaacgauaugaaguuuacgguggucgugggagacguggcuggcauccuggcccaggggaaaaagaugauucggccgcaacccauggaauacaaauauagcuggaaguccuggggaaaggccaaaaucauuggcgcugauguccagaauacaaccuucaucaucgacgggccuaacacccccgaguguccugaugaccagagagcguggaauauuugggaaguugaggauuacggauuuggcaucuucacaaccaacauuuggcucaagcugcgcgacagcuauacacaggugugcgaucaccggcugaugucugccgcuaucaaagacuccaaggccgugcacgccgauaugggcuacuggauugagagcgagaagaaugagacauggaaacuugcuagagccucuuucaucgaagucaagaccuguaucuggcccaaaucccauacacucuggagcaacggggugcuggagucugaaaugauuaucccgaagauuuauggaggcccuaucagccaacacaauuaccgccccggguacuuuacccagacagcgggaccuuggcaucugggcaaacucgagcuggacuucgaucuuugcgaggggaccacgguuguggucgacgaacacugcggaaaccggggccccucccugagaaccacaaccgugacaggcaagauuauccacgagugguguugccggagcuguacccucccuccccugcgcuuuaaaggggaagacggaugcugguauggcauggagaucagaccgguuaaggagaaggaagagaaucuggugaaaucuauggucuccgcugggagcggagaaguggauuccuucucucuuggccuccuguguauuagcaucaugauugaggaaguuaugcgguccagauggucucgcaagaugcugaugacggggacacucgccguguuuuuccugcuuaucaugggacagcugaccuggaacgaccucauucggcugugcaucauggucggcgccaaugcuagcgauagaaugggcauggggacaaccuaccuggcccuuauggcgaccuuuaaaaugcgcccuauguucgcugugggacugcucuuuagacggcugacaucccgcgaggugcuccugcuuacgauuggccugucucucgucgccagcguugagcugcccaacucccuggaagaacuuggggacggacuggccaugggcaucaugauccucaagcugcucaccgauuuccaaagccaucagcugugggcuacacuucugucucucaccuuuauuaaaacaaccuucucccugcacuaugccuggaagacgauggcuauggugcugagcaucgugucucuuuuuccccuguguauguccacaaccagccagaagaccacauggcucccuguccugcucgggucucugggaugcaaaccgcuuaccauguuccugauugccgaaaauaagaucuggggcagaaaauccuggccccugaacgagggcauuauggcgguggggaucguuagcauccuccuguccagccuucugaagaacgacgugccucucgccggaccccugauugcuggcgggaugcucaucgccuguuacgucauuucuggaagcuccgcugaucugucucuugaaaaagccgccgaggugagcugggaggaagaggcugaacauuccggcgcgucucacaauauccugguugaggugcaggacgaugggacaaugaagauuaaagacgaagaacgggaugacacgcugaccauccuccugaaggccacacuucuggcugucagcggaguguauccucucuccauccccgccacccuguucgucugguacuuuuggcaaaagaaaaagcagcgcucuggcgugcucugggauacaccuuccccucccgagguugaaagagccgugcuggacgacggcauuuaucggaucaugcagcgcgggcuucugggaagaucccaggucggcguggggguuuuccaagagaacguguuucauaccauguggcacgucacgcggggagcugugcugauguaccagggcaaacgccucgaacccagcugggccucugugaagaaagaucugauuuccuacgggggaggcuggagacuucagggcagcuggaauaccggggaggagguucaggucaucgcgguggaacccggaaagaacccuaagaaugugcaaacagcucccggcaccuucaaaacaucugagggggaagucggagccauugcccuggacuuuaagccgggcaccuccgggagcccuaucgugaaccgggagggaaaaauuguuggccucuauggcaaugggguggucacaacguccggaaccuacgugucugcuaucgcccaggcgaaggcuagccaggaaggcccccugccugagaucgaggaugaaguuuucagaaaacgcaaccucacaauuauggaccugcaccccggguccggaaagacccggagauaucuucccgccaucgugcgcgaggccauuaagcggaaacugagaacccugauccucgcuccuacacgcgucguggccagcgaaauggcugaggcccugaagggcaugccgauucgguaccaaacgaccgcgguuaaaucugaacauacagggaaggagaucguggaucuuaugugccacgccaccuuuacaaugagacugcucucccccguccgcgugccuaauuauaacaugaucauuauggacgaggcucauuucaccgaucccagcucuaucgccgcucggggcuacauuagcacgagagugggaaugggcgaagccgccgcuaucuuuaugacagcgaccccucccggguccgucgaggccuucccucagucuaaugcuguuauucaggacgaggaacgggauaucccggaacgcagcuggaacuccggauaugaguggaucaccgacuuucccggcaaaacagugugguucgugccuucuauuaagagcgggaaugauaucgccaacugucugagaaagaauggaaaacgggucauucagcugucccgcaagaccuucgacacagaguaccagaagaccaagaacaacgacugggauuacgugguuacgacagacaucagcgaaaugggcgccaauuuuagagcugaucgggugauugaccccagacgcugccucaaaccugucauccuuaaggaugggcccgagcgggugauucuggccggcccgaugccuguuaccguggcgucugcugcccagagacgcggacggaucggcagaaaccacaauaaggaaggggaccaguaugucuacaugggacagccccugaacaaugaugaggaccaugcccacuggacagaggcuaaaaugcuccuggauaacaucaauacccccgaaggcauuaucccugcccuuuucgagcccgaacgcgagaaguccgcggccauugacggggaauaucggcugagaggagaggcucgcaaaacguuuguggagcucaugagacggggcgaucugccugucuggcugagcuacaagguggccuccgaaggguuccaauauucugaccgcagauggugcuuugauggcgagcggaacaaucagguucucgaagagaacauggacguggaaaucuggaccaaagagggagagcgcaagaaacuuagaccgcgguggcuggacgcuagaacauacagcgauccccuggcccuccgcgaguucaaggaguuugcugccggccggagauccgugucuggggaccugauucuugaaaucggaaagcugccucagcaccucacccagcgcgcgcaaaaugcccuggauaaccuggucaugcuccauaauagcgagcagggcgggcgggcuuauagacacgccauggaggaacuucccgacacaaucgagacccugaugcugcucgcucugauugccguucuuacaggaggcgugacccuguucuuucucuccggccgggggcugggaaaaacgagcaucggccugcucugugugauggccucuuccguccuucuguggauggcuagcguggaaccucauuggauugcggccucuaucauucuggaguucuuucucaugguucugcuuauccccgaaccggaucgccagagaacaccucaggacaaccaacuggcuuacguggucaucgggcuccuguucaugauucugaccguggccgccaaugagaugggacuccuugagaccacaaagaaagaucugggcaucgggcacgucgcuguggaaaaccaccaucacgccgcgaugcuggacguugaucuccaucccgccuccgcuuggacccuguacgccguggcuacaacgauuaucaccccuaugaugcggcacacaauugagaacaccacagccaauaucagccuuaccgcgauugccaaccaggcugccauccugaugggacucgacaagggcuggcccaucucuaaaauggauauuggcgucccucugcuggcucucgggugcuauagccaggugaauccccuuacgcugaccgccgcuguucugaugcucguggcccauuacgcgaucauuggaccgggccugcaagccaaggcuacacgcgaagcccagaagagaaccgcugccgggaucaugaaaaacccuacagucgacggaauuguggccaucgaucuugaccccgugguuuaugacgcgaaguuugagaaacagcugggccagaucaugcuccugauucuguguaccucccaaauccuccuuaugcggacgacaugggcucugugcgaaucuauuacccuggccacagggccccucaccacccugugggagggaagcccuggcaaguucuggaauacaacgaucgcugucuccauggccaacauuuuccgcggcagcuaccuugccggggcuggacuggccuuuucccucaugaaaucucugggcgggggaagacggggcaccggggcgcagggagagacacugggcgaaaaguggaagcgccagcucaaucagcuuagcaaauccgaguucaacaccuauaagagaucuggcaucauggaaguggaucggagcgaggccaaagaagggcugaagagaggagagacaaccaaacacgcugugucccgcggcacggccaagcugcggugguuugucgagagaaaucucguuaagccggaagggaaagugaucgaccugggauguggccgcgggggauggucuuacuauugcgcuggccuuaagaaagugacagaggucaagggcuacaccaaagggggacccggccacgaggaaccuauucccauggccaccuacggguggaaccuggugaagcuccauagcggaaaagauguuuucuuuaucccucccgaaaagugugacacacugcugugcgauauuggcgaguccagcccuaauccgaccaucgaggaagggcggacacucagagugcuuaagauggucgagcccuggcugcgcggaaaccaauucuguauuaaaauccugaauccuuauaugcccucugugguugaaacgcucgagcagaugcagcggaagcacggcggcaugcuggugagaaacccucuuucccgcaauagcacccaugagauguacugggucucuugcgggacaggaaacauuguguccgcggugaauaugaccagccggaugcugcucaacagauuuacaauggcccaccgcaaacccaccuaugaacgggacgucgaucugggcgcugggacgagacacguugccguggagccggaaguggcuaaccuggacaucaucggacagcgcauugagaauaucaagcaugaacacaaaucuaccuggcauuacgaugaggacaacccuuauaagacaugggccuaccacggcuccuaugaggucaagcccagcggguccgcuagcucuauggugaauggaguugugaaacuccugaccaagcccugggaugucauuccuauggugacacaaaucgccaugaccgacacaacccccuucggccagcagagaguuuuuaaagaaaagguggacacgcggacaccuaaagcgaagcgcggcaccgcccaaauuauggaggucaccgcuaaguggcuuuggggguuccugagcagaaacaaaaagccgcggaucuguacaagagaagaguuuacgcggaaagugcgcuccaaugccgcuaucggagccguuuucguggaugaaaaccaguggaacucugccaaggaggcggucgaggacgaaagauuuugggaucucgugcaucgggagcgcgaacugcacaaacagggcaagugcgcuaccugcgucuacaacaugauggggaagagagagaagaaacuuggagaguucggcaaagccaaagggagccgggccauuugguacauguggcugggcgcucgcuuccucgaguuugaggcccugggauucaugaaugaagaccacugguuuuccagagagaacucucugagcggcguggaaggggagggacuccauaaacugggcuauauccuucgggauauuuccaagauccccgggggaaauauguacgcugacgauacagccggcugggacacccgcauuacagaggaugaccugcagaacgaagcgaaaaucaccgauaucauggagccugaacacgcccuccuggcuagaucuauuuucaaacuuacauaucaaaauaagguugugcggguccagcgccccgccaaaaacgggaccgugauggacgugaucagcagacgggaucagcgcggcuccggacagguuggcacguacgggcugaauaccuuuacaaacauggaggcucaacucauuagacagauggaaagcgagggaaucuucucuccuuccgagcuggaaacccccaaccuggccggccgggugcucgacuggcuggagaagcauggggucgaaagacuuaaacgcauggcgauuagcggagacgauugugugguuaagccgaucgacgaucgguuugccacagcucugaccgcccucaaugacaugggcaaagugagaaaggauaucccucagugggagcccucuaagggguggaacgacuggcagcaagucccuuucugcucccaccacuuucaucagcugauuaugaaagauggccgcgaaaucgugguccccugucggaaucaggacgagcuugugggcagagcucgcguuagccagggcgccggguggucccugcgggagacggcuugccucggaaagucuuaugcccaaauguggcagcugauguacuuccacagacgcgaucugcggcucgcggccaacgcuauuuguagcgccgugccugucgacugggugcccacauccagaaccacauggagcauccaugcccaccaucaguggaugaccacggaagauaugcugucuguuuggaaucgcguguggauugaggaaaacccguggauggaggacaaaacccacaucuccagcuggggcgacgucccuuaucuugggaagcgggaagaucaauggugcggaucucugauuggccucacagcuagagccaccugggcgacaaauauccagguggcuaucaaccaggugcggagacugauugggaaugagaacuaccuugacuacaugaccagcaugaaacgcuuuaagaaugaguccgaucccgaaggcgcccugugguga

SEQ ID NO: 19218 - RNA, 9879 nt, Artificial Sequence
  derived and/or modified CDS sequence (opt5) from DENV-1__GU131782__SS-prME
agcgugaccaugcugcucaugcugaugcccaccgcccuugcuuuccaccugacgaccagaggcggggaaccucauaugaucgucacaaagcaggaacggggaaagucccuucuguuuaagaccucugccggcguuaacaugugcacacuuauugcgauggaccugggggaacucugugaagauaccaugacauacaagugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcggggcucggagaggucgacuccuuuagccugggccugcucuguaucuccauuaugaucgaagaggugaugcggucuagauggagccgcaagaugcugauggcugggacacuugccguuuuccugcuccugauuaugggacagcugaccuggaacgaucuuauccggcugugcauuauggugggcgccaaugcuuccgacagaaugggcauggggacaaccuaucucgcccugauggcgaccuuuaaaaugcgcccuauguucgcugucggacuccuguuuagacggcuuacaucucgcgaggugcugcuccugacgaucggccugagccuuguggccuccgucgaacugcccaacucucucgaggaacugggggauggacucgccaugggcaucaugauucugaaacuucugaccgacuuccaaccccaccagcucugggcuacacugcugagccuuaccuuuaucaaaacaacccugucccuccauuacgccuggaagacgauggcuaugguucugagcauugugucucucuucccucugugucuuuccacaaccagccagaagaccacauggcugccggugcugcucgggucucugggaugcaaaccccuuaccauguuucugaucgccgagaauaagauuuggggcagaaaauccuggccucucaacgaaggcaucauggcggucggggugguuagcauccugcucucuucccugcuuaagaacgaugugccccuggccggaccucugauugcuggcgggaugcucaucgccuguuaugucauuagcggauccagcgcugaccugucucuugagaaagccgccgaggugagcugggaagaggaagcugagcacuccggcgcgucucauaauauccugguugaagugcaggaugacgggacaaugaagauuaaagaugaggagcgggacgauacgcucaccauccugcucaaggccacacugcuugcuaucagcggagucuacccccuguccauuccugccacccuguucgugugguauuuuuggcaaaagaaaaagcagcgcucuggcguccucugggacacacccagcccgccugaaguggagagagccguucuggaugacggcaucuaccggauuaugcagcgcgggcuucugggaagaucccaggugggcgucgggguguuccaagaaaacguuuuccacaccauguggcacgugacgcggggagcuguccucauguaucagggcaaacgccuggagcccucuugggccagcgugaagaaagaccucaucuccuacgggggaggcuggagacugcagggcagcuggaauaccggggaggaagugcagguuauugcggucgagccuggaaagaaccccaagaaugugcaaacagcuccgggcaccuuuaaaacaccugaaggggaggugggagccaucgcccuugauuucaagcccggcaccucuggguccccuauugucaaccgggaaggaaaaaucgugggccuguacggcaaugggguugugacaacgagcggaaccuaugucucugcuaucgcccaggcgaaggcuucccaggagggcccccugcccgagauugaagacgagguguuuagaaaacgcaaccucacaaucauggaucugcauccugggagcggaaagacccggagauaccuuccggccauuguucgcgaagccaucaagcggaaacugagaacccucauucuggcucccacacgcguggucgccuccgagauggcugaagcccugaagggcaugccuauccgguaucaaacgaccgcggugaaaucugagcacacagggaaggagaucguugaccucaugugccaugccaccuucacaaugagacuucugagccccgugcgcgucccuaauuacaacaugauuaucauggaugaagcucacuuuaccgaccccuccagcauugccgcucggggcuauaucucuacgagagugggaaugggcgaggccgccgcuauuuucaugacagcgaccccuccgggguccguggaagccuuuccccagagcaaugcugucauccaggaugaggaacgggacaucccugagcgcucuuggaacagcggauacgaguggauuaccgauuuccccggcaaaacaguuugguuugugccuuccaucaagucugggaaugacauugccaacugucugagaaagaauggaaaacgggugauccagcucagccgcaagaccuucgauacagaauaucagaagaccaagaacaacgacugggacuacgucgugacgacagauauuuccgagaugggcgccaauuuuagagcugaccggguuaucgaucccagacgcugccugaaaccggugauucuuaaggacgggccugaacgggucauccuggccggccccaugcccgugaccguugcgucugcugcccagagacgcggacggaucggcagaaaccauaauaaggagggggaucaguacauuuauaugggacagccucucaacaaugacgaggaucacgcccacuggacagaagcuaaaaugcugcuggacaacaucaauacccccgagggcauuaucccugcccucuucgaaccggagcgcgaaaagagcgcggccauugauggggaguaccggcuuagaggagaggcucgcaaaacguucguggaacugaugagacggggcgaccugcccgucuggcucuccuauaagguggccagcgagggguuucaauacucugaucgcagauggugcuucgacggcgaacggaacaaucagguccuggaggaaaacauggauguggagaucuggaccaaagagggagaacgcaagaaacuuagaccucgguggcuggacgcuagaacauauuccgacccccucgcccugcgcgaguuuaaggaguucgcugccggccggagaagcguuuccggggaucugauccucgagauuggaaaacuuccucagcaucugacccagcgcgcgcaaaaugcccuggacaaccucgugaugcugcacaauucugaacagggcgggcgggcuuacagacaugccauggaggagcuucccgauacaaucgaaacccugaugcuccuggcucugauugccgugcucacaggaggcgucacccucuuuuuccugagcggccgggggcugggaaaaacguccaucggccuccuguguguuauggccucuagcgugcuucuguggauggcuuccguggagccgcacuggauugcggccagcaucauccucgaauuuuuccugaugguccugcucauuccugagcccgaccgccagagaacaccucaggauaaccaacuugcuuaugugguuaucgggcugcuguuuaugauucucaccguggccgccaaugagaugggacugcuugaaaccacaaagaaagaccugggcaucgggcacgucgcuguggagaaccaucaccaugccaccaugcucgaugucgaccugcaccccgcgucugccuggacacuguacgcuguggccacgaccauuaucacaccuaugaugcggcauaccauugaaaacacaaccgcuaauaucucccucacggccaucgcgaaccaggccgcuauucuuaugggacuggauaagggcuggcccaucagcaaaauggacauuggcguuccgcugcucgcccuggggugcuacucucaggugaauccucuuacccugacagcugccguccucaugcugguggcucacuaugccaucauuggacccggccugcaagcgaaggccacccgcgaggcucagaagagaacagccgcugggaucaugaaaaaccccaccguugauggaaucguggccauugaccucgauccugucguguacgacgccaaguucgaaaaacagcuuggccagaucaugcugcugauucucuguacgucccaaauccugcuuaugcggacaaccugggcgcugugcgagagcauuacacucgcuaccgggccgcugaccacacugugggagggaucucccggcaaguuuuggaauacgaccaucgccgugagcauggcuaacaucuuccgcggcuccuaucucgccggggccggacuugcuuuuucucugaugaaaagccugggcgggggaagacggggcacaggggcccagggagaaacccucggcgagaaguggaagcgccagcugaaucagcuuuccaaaagcgaguucaacauuuacaagagauccggcaucauggagguugaccggucugaagcgaaagaggggcugaagagaggagagacaacccgccacgccgucagccggggcacggcuaaacucagaugguucguggaacgcaaucuggugaagccugaggggaaggucauugaucugggauguggcagaggcgggugguccuauuacugcgccgggcucaaaaagguuacagaagugaaaggcuauaccaaagggggacccggccaugaggaaccuauccccauggcuaccuacggguggaaccuugugaaacugcacucuggaaaggacgucuuuuucacaccuccggagagaugugauacccugcucugcgacauuggcgagagcucccccaauccuacaaucgaagaggggcgcacgcugcgggugcuuaaaaugguugaacccuggcugagaggaaaccaauuuuguauuaagauccucaauccuuacaugcccucuguggucgagacccuggagcagaugcagcgcaagcauggcggcaugcuggugcggaacccgcucagcagaaauuccacacacgaaauguauuggguuagcugcgggaccggaaacaucgugucugccgucaauaugacaucccgcaugcugcuuaaccgguucaccauggcgcacagaaaaccuacguacgagcgcgauguggaccugggcgccgggaccagacauguggcugucgaacccgagguugccaaccucgauauuaucggacagcggauugaaaauaucaagcacgagcauaaaagcacauggcacuaugacgaggauaaccccuacaagaccugggcuuaucauggcucuuacgaagugaaaccuuccgggagcgccucuuccauggugaauggagucgugaagcugcuuacaaagcccugggacguuauuccuauggugacccaaaucgcuaugacagauaccacgccguuuggccagcagcgcgucuucaaagagaagguggacacaagaacccccaaagccaagcggggcaccgcgcaaaucauggaaguuacagccagauggcuguggggguuucucagccggaacaaaaagccucgcauuuguacgagagaggaguucacccggaaggugcgcuccaaugcugccaucggagcugucuuuguggacgagaaccaguggaauagcgccaaagaggccguugaagaugagagauucugggaccuggugcagaaggaacgggagcugcacaaacagggcaagugcgcgacaugcgucuauaacaugauggggaaacgcgaaaagaagcucggagaguuuggcaaagcuaaggggucuagagccauuugguacauguggcugggcgcccgguuccuugaguuugaagcucugggauucaugaaugaggaucacugguucagccgcgaaaacucccucucuggcguggagggggagggacugcauaaacuuggcuacauccugagagacauuagcaagauccccgggggaaauauguaugccgaugacaccgcuggcugggauacacggaucaccgaagacgaucuccaaaacgaggccaaaauuacagacaucauggaaccugagcacgcgcugcuggccaccuccauuuuuaagcucacguaccagaauaaagucgugcgcguucagagacccgcuaagaacgggaccgugauggaugucaucucucggcgcgaccagagaggcagcggacaagugggcacauaugggcugaauaccuucacaaacauggaagcccagcuuauucggcagauggaguccgagggaaucuuucugccgucugaacucgagaccccuaaccuggcugaaagagugcuugauuggcuggagaagcauggcguugaacgccucaaacggauggccaucagcggggacgacuguguggucaagcccauugaugacagauucgcgacggcccugacagcucugaaugauaugggaaaagugcgcaaggacaucccucagugggagcccuccaaaggcuggaacgauuggcaacagguuccuuuuugcagccaccacuuccaucagcucauuaugaaggacgggcgggagaucgugguccccuguagaaaucaggaugaacuggugggccgcgcccgggucucucaaggagcuggcuggucccuuagagagaccgccugccugggaaagagcuacgcucagauguggcagcucauguauuuucaccgccgggaccugagacuugccgcgaacgccauuuguucugcugugccgguugauugggugccuacaucccgcaccacguggagcauccaugcccaccaucaauggaugaccacagaagacaugcuguccgucuggaaucggguguggauugaggaaaaccccuggauggaggauaaaacccacguuucuagcuggggagacgugcccuaccucggcaagagagaggaccaguggugcgggucccugaucggacugacagcccgggcuaccugggccagcaauauccaggucgcgauuaaccaggugagacgccucaucggcaaugaaaacuaucuggauuacaugacaucuaugaaacgguucaagaaugagggggacccugaaggcgcucuuugguga

SEQ ID NO: 19219 - RNA, 9879 nt, Artificial Sequence
  derived and/or modified CDS sequence (opt5) from DENV-1__GU131784__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcaccaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuaugugauuucuggaagcuccgcugaccuuucucuggagaaggccgccgaggucagcugggaagaggaagcugagcacuccggcgcgucucauaauauccugguggaaguucaggaugacgggacgaugaaaauuaaggaugaggagcgggacgauacccucacaauccugcuuaaggccacccugcucgcugugagcggagucuacccucuguccauccccgccacacucuucgugugguauuuuuggcagaaaaagaaacaacgcucuggcguccugugggacaccccuuccccucccgaaguggagagagccguucuugaugacggcauuuaccggaucaugcagcgcgggcugcugggaagaucccaggugggcgucgggguguuccaggaaaacguuuuucacacgauguggcacgugacccggggagcuguccucauguaucaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguacggcaaugggguugugacgaccuccggaacauaugucucugcuaucgcccaagcgaaagcuagccaggagggcccccucccugagaucgaagacgagguguucagaaagcgcaaccugaccauuauggaucuucaucccggguccggaaagacccggagauaccugcccgccaucguucgcgaagccauuaaacggaagcugagaacacucauccuggcuccuacgcgcguggucgccagcgagauggcugaagcccuuaaaggcaugccgauucgguaucagaccacagcggugaagucugagcacaccgggaaagagaucguugaccugaugugccaugccacauuuaccaugagacuccugucccccgugcgcgucccuaauuacaacaugaucauuauggaugaagcucacuucacggaccccagcucuaucgccgcucggggcuauauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauacgaguggaucacagauuuucccggcaagaccguuugguucgugccuucuauuaagagcgggaaugacaucgccaacugucugcgcaagaauggaaagcgggugauucagcucucccgcaaaacauucgauaccgaauaucagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccauaauaaagagggggaucaguacaucuauaugggacagccccucaacaaugacgaggaucacgcccacuggaccgaagcuaagaugcugcuugacaacauuaauacgcccgagggcaucauuccugcccuguucgaacccgagcgcgaaaaauccgcggccaucgauggggaguaccggcucagaggagaggcucgcaagaccuuuguggaacugaugagacggggcgaccugccugucuggcucagcuauaaaguggccuccgagggguuccaguacucugaucgcagauggugcuuugacggcgaacggaacaaucaaguccuugaggaaaacauggauguggagauuuggacaaaggagggagaacgcaaaaagcugagaccgcgguggcuggacgcuagaaccuauagcgacccccucgcccugcgcgaguucaaggaauuugcugccggccggagauccguuucuggggaucuuauccuggagaucggaaaacucccucagcaucugacacagcgcgcgcagaaugcccuggacaaccucgugaugcuucacaauagcgaacaaggcgggcgggcuuacagacaugccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucacuggaucgcggccucuauuauccucgaguucuuucugaugguccuucugauccccgagccggaccgccagagaaccccucaggauaaccagcucgcuuaugugguuauugggcugcuguucaugauccucaccguggccgccaaugagaugggacuucuggaaacaaccaaaaaggaccugggcauugggcacgcugccgucgagaaccaucaccaugcggccaugcucgauguggaccugcaccccgcuuccgccuggacacuuuacgcugucgccacgaccaucauuacaccuaugaugcggcauaccaucgaaaacacaaccgcgaauauuagccugacggccaucgcuaaccaagccgcuauccucaugggacuggauaaaggcuggcccauuucuaagauggacaucggcgugccucugcucgcccuugggugcuacagccagguuaauccccugacccugacagcugccgugcucaugcuggucgcgcacuaugccauuaucggaccgggccuucaggcuaaggccacccgcgaggcucagaagagaacagccgccgggauuaugaagaacccuaccguggauggaaucguugcgaucgaccuggaucccguggucuacgacgcuaaauuugaaaagcagcucggccagauuaugcugcugauccucuguacgucccagauucuucugaugcggacaaccugggcccugugcgagucuaucacacucgcuaccgggccccugaccacacuuugggagggaagcccuggcaaauucuggaauacgaccauugccguguccauggccaacaucuuccgcggcagcuaucuggcuggggccggacucgcguuuucccugaugaagucucugggcgggggaagacggggcacaggggcccaaggagaaacccucggcgagaaguggaaacgccagcuuaaucagcugagcaaguccgaguucaacacauacaaaagaucuggcaucauggagguggaccggagcgaagcuaaggaggggcugaaaagaggagagaccacgaagcacgccguuucccgcggcacagcuaagcuccggugguuugucgaaagaaaucuggugaaaccggaggggaaggugauugaucuuggauguggccgcgggggauggucuuauuacugcgccggccugaaaaaggucaccgaaguuaaaggcuauaccaaagggggacccggccaugaggaaccuauccccauggcgacauacggguggaaccucgugaaacugcacagcggaaaggacguguucuuuauuccucccgagaagugugauacccugcucugcgacaucggcgaguccagcccuaauccgacaauugaagaggggcggacgcuuagaguccugaaaaugguggaacccuggcugcgcggaaaccaguucuguaucaagauucucaauccuuacaugcccucuguuguggagacccuggagcaaaugcagcggaaacauggcggcaugcuugucagaaacccucugucccgcaauagcacacacgaaauguauugggugucuugcgggaccggaaacaucguuuccgccgugaauaugacaagccggaugcuccugaacagauuuaccauggcucaccgcaagcccacguacgagcgggaugucgaccugggcgccgggaccagacauguggcuguggaaccggaggucgccaaccucgauaucauuggacagcgcaucgaaaauauuaaacacgagcauaagucuacauggcacuaugacgaggauaacccuuacaagaccugggcuuaucauggcuccuacgaaguuaaacccagcggguccgccagcucuauggugaauggaguggucaagcugcuuacaaaacccugggacgugaucccuaugguuacccagauugcgaugacagauaccacgcccuucggccaacagagaguguuuaaggagaaagucgacacacggaccccuaaggccaagcgcggcaccgcucagaucauggaagugacagccaaauggcuguggggguuccucagcagaaacaagaaaccgcggaucuguacgagagaggaauuuacccggaagguucgcuccaaugcugccauuggagccguguucgucgacgagaaccaauggaacucugcgaaagaggcuguggaagaugagagauuuugggaccugguucaccgggaacgcgagcuucacaagcagggcaagugcgccacaugcguguauaacaugauggggaaaagagaaaagaaacugggagaguucggcaaggccaaagggagccgggcuaucugguacauguggcucggcgcccgcuuccuggaguuugaagcucugggauucaugaaugaggaucauugguuuuccagagaaaacucucucagcggcgucgagggggagggacugcacaaacuuggcuacauucugcgggacaucuccaaaauucccgggggaaauauguaugccgaugacaccgcgggcugggauacacgcaucaccgaagacgaucuccagaacgaggccaagaucacagacauuauggaaccugagcaugcucugcuugccaagucuaucuucaaacugaccuaccagaauaagguggucagagugcaacggcccgcuaaaaacgggacgguuauggaugugauuagccgcagagaccagcggggcuccggacaggucggcaccuaugggcucaauacauuuaccaacauggaagcccagcugauccgccaaauggagagcgagggaauuuucucuccuuccgaacuggagacacccaaccucgcgagacgggugcuggauuggcuugaaaagcacggcguggagagacugaaacgcauggccaucagcggggacgacuguguugugaagccgaucgaugaccgguuugcuaccgcccucacggcucugaaugauaugggaaaggucagaaaagacauuccucagugggaacccucuaagggcuggaacgauuggcaacaggugccuuucugcucccaccauuuucaccaacuuaucaugaaagacgggcgcgagauuguugugcccugucggaaucaggaugagcuggucggcagagcccgcgugagccagggagcuggcuggucccuccgggaaacagccugccuggggaagucuuacgcgcagauguggcaacugauguauuuccauagacgcgaccuccggcuggccgcuaacgccaucuguagcgccgucccuguggauuggguucccaccuccagaacaaccuggagcauucacgcucaucaccaguggaugacgaccgaggacaugcuuucuguguggaaucgcgucuggaucgaagagaacccguggauggaagauaaaacacacauuuccagcuggggagacgugccuuaccugggcaagcgggaggaccaguggugcgggucucucaucggacugaccgccagagcgacaugggcuaccaauauccaaguugccauuaaccaggugcggagacuuaucggcaaugagaacuaucuggauuacaugacaagcaugaagcgcuuuaaaaaugaauccgaccccgagggggcccucugguga

SEQ ID NO: 19220 - RNA, 9879 nt, Artificial Sequence
  derived and/or modified CDS sequence (opt5) from DENV-1__JF937612__SS-prME
agcgugaccaugcugcucaugcugaugcccacagcucuugcuuuccaccugacgacccggggcggggaaccucauaugaucgucuccaagcaggaacggggaaaaucucuccuguuuaagaccagcgccggcguuaacaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcaccggcgggacaagcgcucugucgcccuggccccucauguggggcugggacucgagacccggacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaaugcuaccuuuaucauugaugggccuaacacacccgaauguccugacgaucagagagcguggaauaucugggaggucgaggacuacggauucggcauuuuuaccacgaacaucuggcugaagcugcgcgauuccuauacacagguuugcgaccaccggcuuaugagcgccgcuauuagagauucuaaagccgugcacgccgacaugggcuacuggaucgaauccgagaagaaugaaaccuggaaacucgcucgcgccagcuucaucgaggugaagacauguauuuggcccaagucucauacccugugguccaacgggguccuggaaagcgagaugaucauuccgaaaaucuauggaggcccuauuucucaacacaauuaccggcccggguacuucacacaggcggcuggaccuuggcaucucggcaagcuggagcuugauuuugaccugugcgaagggaccacggugguuguggaugagcacugcggaaacagaggccccagccuccggaccacaaccgucacaggcaaaaucauccacgaaugguguugccgcuccuguacccugccuccccugagauucagaggggaagacggaugcugguauggcauggagauuagaccggugaaggaaaaagaggaaaaucuuguuaagagcauggugucugccggguccggagaggucgacagcuuuucccucggccugcuguguaucucuauuaugaucgaagaggugaugcgcagccggugguccagacgcaugcucaugacggggacacuggccguuuucuuucuucugauuaugggacagcucaccuggaacgaucugaucagacugugcauuauggugggcgcuaaugccucugaccggaugggcauggggacaaccuaccuugcgcugauggcuaccuucaagaugcgcccuauguuugccgucggacuccuguucagacggcucacaagccgcgaggugcugcuucugacgaucggccucucccugguggccucugucgaacugcccaacagccuugaggaacugggggauggacucgcuaugggcaucaugauucugaaacuccugaccgacuuucaaucccaucagcuuugggccacacugcucagccugaccuucaucaagacaaccuuuucucugcacuaugcuuggaaaacgauggccaugguucuuuccauugugagccuguucccccucugucugucuacaaccucccagaagaccacauggcucccugugcugcuugggagccugggaugcaaaccgcugaccauguuucucaucgcggagaauaagauuuggggcagacggucuuggccccugaacgaaggcaucauggccgucgggaucguguccauucuucugagcucccuccugaagaacgauguuccucucgcuggaccccugaucgccggcgggaugcuuauugcuuguuacgugaucagcggaucuagcgccgaccugucccuggagaaagccgcugaggucucuugggaagaggaagcggagcauagcggcgccucccacaauauucucguggaaguucaggaugacgggacaaugaagaucaaagaugaggagcgcgacgauacgcugaccauccuucugaaggcuacacuccuggccgugucuggagucuauccucucagcauucccgccacccuguucgugugguacuucuggcagaagaagaaacagagauccggcguccuuugggacacaccuucucccccggaaguggagcgggcuguucuggaugacggcaucuaucgcauuaugcagagagggcugcucggacggagccaggugggcgucgggguguuucaagaaaacguuuuccauaccauguggcacgugacgagaggagccguccugauguaccagggcaagcgccuugagccuuccugggcgagcgugaagaaagaccugaucucuuacgggggaggcuggcggcuccagggcuccuggaauaccggggaggaagugcagguuauugcugucgagcccggaaagaacccuaaaaaugugcaaacagcccccggcaccuuuaagacaccggaaggggaggugggagccaucgcucuggauuucaaaccuggcaccagcgggucucccauugucaacagagaaggaaagaucgugggccucuauggcaaugggguugugacaacguccggaaccuacgucagcgccaucgcgcaggcuaaggccucccaggagggcccucugcccgagauugaagacgagguguuucgcaaacggaaccuuacaaucauggaucugcaccccgggucuggaaagaccagacgcuaucugccugccauuguucgggaagcuaucaaaagaaagcuccgcacccugauucuugccccgacacggguggucgcuagcgagauggccgaagcgcugaaaggcaugcccaucagauaccaaacgaccgccgugaaguccgagcauacagggaaggagaucguugaccucaugugccacgcuaccuucacaaugcggcugcugagcccugugcgcguccccaauuauaacaugauuaucauggaugaagcccauuuuaccgacccuucuuccauugcugccagaggcuacaucagcacgcgggugggaaugggcgaggccgcugcgauuuucaugacagccacacccccugggucuguggaggcuuuuccgcagagcaaugccgucauccaggaugaggaacgcgacauccccgagagauccuggaacucuggauaugaguggauuaccgauuucccuggcaaaacaguuugguuugugcccagcaucaaguccgggaaugacauugccaacugucuccggaaaaauggaaagagagugauccagcuuucucgcaaaaccuucgauacagaauaccaaaagaccaagaacaacgacugggacuacgucgugacgacagauauuagcgagaugggcgcuaauuuccgggccgacagaguuaucgauccucgccggugccugaaacccgugauucugaaggacgggccggaaagagucauccucgcgggcccuaugcccgugaccguugcuuccgccgcccagcgccggggaagaaucggccgcaaccacaauaaagagggggaucaguauauuuacaugggacagccccugaacaaugacgaggaucaugcucacuggacagaagccaagaugcuucuggacaacaucaauaccccugagggcauuauccccgcgcucuuugaaccugagagagagaaaagcgccgcuauugauggggaguaucggcugcgcggagaggccagaaagacguucguggaacugaugcggcgcggcgaccucccggucuggcuuucuuacaagguggcuuccgagggguuucaauauagcgauagacgguggugcuucgacggcgaaagaaacaaucagguccuggaggaaaacauggauguggagaucuggaccaaagagggagaacgcaagaaacugcggcccagauggcucgacgcccgcacauacuccgacccucuggcccuucgggaguuuaaggaguucgccgcgggcagacggucuguuagcggggaucugauccucgagauuggaaaacugccccagcaccugacccagcgcgcccaaaaugcucucgacaaccuugugaugcugcauaauuccgaacagggcgggagagccuaucggcacgcuauggaggagcugccugauacaaucgaaacccucaugcugcuugcccugauugccgugcucacaggaggcgucacccuguuuuuccugucuggccgcgggcucggaaagacgagcaucggccuucuguguguuauggcuuccagcgugcugcucuggauggcgucuguggagccccauuggauugccgcuuccaucauccuggaauuuuuccuuaugguccugcucauuccggagccugacagacagcggacaccccaggauaaccaacuggccuacgugguuaucgggcugcucuuuaugauucuuaccguggccgcuaaugagaugggacugcuggaaaccaccaaaaaggaccucggcaucgggcacgucgccguggagaaccaccaucacgcggccaugcuggaugucgaccuucauccugcuagcgccuggacccuguacgcuguggccacaacgauuaucacccccaugaugcgccacacaauugaaaacaccacagcgaauaucucucucaccgccaucgcuaaccaggccgcuauucugaugggacuggauaagggcuggccuaucuccaaaauggacauuggcguuccccuccuugcccuggggugcuauagccaggugaauccgcugacgcucaccgcugccguccugaugcuuguggcgcauuacgccaucauuggaccuggccugcaagcuaaggccacaagagaggcucagaaacggaccgccgccgggaucaugaagaaccccacaguugauggaaucguggcgauugaccucgaucccgucguguaugacgcuaaauucgaaaagcagcugggccagaucaugcugcucauucuuuguaccucucaaauccugcugaugcgcacgacaugggcccucugcgagagcauuacccuggcuacagggccucuuaccacccugugggagggauccccgggcaaguuuuggaauacaacgaucgccgugucuauggccaacaucuucagaggcagcuaccucgcuggggccggacuggcguucucccugaugaaaagccucggcgggggacggagaggcaccggggcccagggagaaacacuuggcgagaaguggaaacgccagcugaaucagcuguccaagucugaauuuaacaccuauaaacggagcggcauuauggagguugacagauccgaagcuaaggaggggcucaagcgcggagagacaaccaaacacgccgucucucggggcacggcuaagcugagaugguucguggaacgcaaucuugugaaacccgaggggaaggucaucgaucugggauguggcagagggggauggagcuacuauugcgccggccucaaaaagguuacagaagugaagggcuacaccaaagggggaccuggccacgaggaacccauuccuauggcgaccuacggguggaaccuggugaagcugcauuccggaaaagacgucuuuuucauucccccugagaagugugauacacuccuuugcgacauuggcgagucuagcccgaaucccaccaucgaagaggggagaacacugcgcgugcugaaaaugguugaaccuuggcuccggggaaaccaauuuuguauuaagauccugaaucccuauaugccuuccguggucgagacgcuugagcagaugcagagaaaacacggcggcaugcuggugcgcaacccccucagcagaaauucuacccaugaaauguacuggguuuccugcgggacaggaaacaucgugagcgccgucaauaugaccucuagaaugcugcugaaccgcuucacaauggcucacagaaagccgaccuaugagcgggauguggaccucggcgccgggacgcgccacguggcugucgaaccugagguugccaaccuggauauuaucggacagagaauugaaaauaucaagcaugagcacaaauccaccuggcauuacgacgaggauaaccccuauaagacaugggcuuaccacggcagcuaugaagugaaacccucuggguccgccagcuccauggugaauggagucgugaaacuucugaccaaaccuugggacguuauucccauggugacacaaaucgcgaugaccgauacaaccccuuuuggccagcagcgggucuucaaggagaagguggacacgagaacaccgaaagccaagcggggcaccgcucaaaucauggaaguuaccgccaaauggcucuggggguuucugagccgcaacaagaaacccagaauuuguacacgggaggaguucacgcgcaaggugagaucuaaugcugccaucggagccgucuuuguggacgagaaccaguggaauagcgcgaaggaggcuguugaagaugagcgguucugggaccuugugcaucgcgaaagagagcugcacaaacagggcaagugcgcuaccugcgucuacaacaugauggggaaacgggaaaagaaacucggagaguuuggcaaggccaaggggucccgcgcuauuugguacauguggcugggcgccagauuccuggaguucgaagcucucggauuuaugaaugaggaucacugguucucucgggaaaacagccuguccggcguggagggggagggacuucauaaacugggcuauauccuccgcgacauuucuaagaucccugggggaaauauguacgccgaugacacagcgggcugggauaccagaaucacagaagacgaucugcagaacgaggcccggauuaccgacaucauggaacccgagcacgcccuucuggccaaaagcauuuuuaagcucacauaucaaaauaaagucgugcgcguucagagaccugcuaagaacgggaccgugauggaugucaucucccggagagaccagcgcggcucuggacaggugggcacguacgggcugaauaccuucacaaacauggaagcccaacugauucggcagauggagagcgagggaaucuuuucccccagcgaacucgagaccccgaaccuggcggaaagagugcuugauuggcuggagaaauauggcguugaacgccucaagcggauggccaucucuggggacgacuguguggucaagccuauugaugacagauucgcuacagcccugaccgcucuuaaugauaugggaaaagugcgcaaggacaucccccagugggagccuuccaaaggcuggaacgauuggcagcaaguucccuuuugcagccaucacuuccaccagcugauuaugaaggacgggcgggagaucguggucccuuguagaaaucaggaugaacucgugggccgcgcccgggucucucagggagcuggcuggucccugagagagacggccugccuggggaaaagcuacgcgcaaauguggcagcucauguauuuucaucgccgggaccugagacuugccgcuaacgccauuuguuccgccgugcccguugauuggaucccgacaucucggaccacauggagcauucacgcucaucaccaguggaugaccacggaagacaugcuguccguguggaauagagucuggaucgaggaaaacccuuggauggaggauaagacccauaucagcucuuggggagacgugcccuaccucggcaagcgcgaggaccaauggugcgggucccugauuggacuuacagcccgggcgaccugggcuacaaauauccagguugccauuaaccaggugagacgccugaucggcaaugaaaacuaccucgauuauaugaccagcaugaaaagauucaagaaugagucugaccccgaaggggcccugugguga

SEQ ID NO: 19221 - RNA, 9879 nt, Artificial Sequence
  derived and/or modified CDS sequence (opt5) from DENV-1__GU131786__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccccugcuagaggcgcccgccggauggcgauccucggagccaccgcuugggauuuuggcagcaucgggggaguuuucccguccgucggcaaacuggugcaucagauuuuugggacagccuacggagugcuguucagcggcgucucuuggaccaugaagaucgggauuggcgugcuccugacauggcuuggacugaauuccagaagcaccucucucuccaugacguguaucgcuguuggccuggugacccuguaccuuggggucauggugcgcgccgacagcggaugcguuauuaacuggaaaggccgggaacucaaguguggguccggaaucuuugugacaaaugagguccacaccuggacagaacaguauaaguuccaagcggauucucccaaaagacugagcgccgcuauuggcaaggccugggaggagggggugugcggcauccgcuccgcuacccggcuggaaaacaucauguggaaacagauuucuaacgagcucaaucauauccugcuugaaaacgacaugaagcugacaguuguggucggagacguggccggcauucucgcccaggggaaaaagaugaucagaccucagcccauggaguacaaauauagcuggaaguccuggggaaaggcuaaaauuaucggcgcggaugugcaaaauaccacguuuaucauugacgggccuaacacacccgaauguccggaugaccagcgcgccuggaauaucugggaggucgaggauuacggauucggcauuuuuaccaccaacaucuggcugaagcugcgggacagcuauacacagguuugcgaucacagacuuaugucugcugccauuaaagacuccaaggccgugcacgcugauaugggcuacuggaucgaaagcgagaaaaaugaaaccuggaagcucgcccgcgcgucuuucaucgaggugaagacguguauuuggccuaaaucccauacacuguggagcaacgggguccuggaaucugagaugaucauucccaagaucuauggaggcccuauuagccagcacaauuaccggcccggguacuucacccaaacagcuggaccuuggcaucucggcaaacuggagcuugacuuugaucugugcgaagggaccacagugguuguggacgagcacugcggaaacagaggccccucccuccggaccacgaccgucacaggcaagaucauccacgaaugguguugccgcagcuguacccugccgccucugagauucaaaggggaggauggaugcugguauggcauggagauucggcccgugaaggaaaaggaggaaaaucuuguuaaaucuaugguguccgccgggagcggagaggucgacuccuuuucucucggccugcuguguaucagcauuaugaucgaagaggugaugagaucccgcuggucucggaagaugcucaugacagggacccuggccguuuucuuucuucugauuaugggacagcucacguggaacgaccugaucagacugugcauuauggugggcgcuaaugccagcgaucgcaugggcauggggacaaccuaccuugcgcugauggcuacauucaaaaugagacccauguuugccgucggacuccuguuccggcgccucaccuccagagaggugcugcuucugaccaucggccucucucugguggccagcgucgaacugccuaacucccuugaggaacugggggacggacucgcuaugggcaucaugauucugaagcuccugacagauuuucagagccaucaacuuugggccacgcugcucucucugaccuucauccggacaaccuuuucccugcacuaugcuuggaaaacaauggccaugguucuuagcauugugucucuguucccgcucugucuguccaccacgagccagaagacaaccuggcuccccgugcugcuugggucucugggaugcaagccucugaccauguuucucaucgcggagaauaaaauuuggggccgcaaguccuggccccugaacgaaggcaucauggccgucgggaucgugagcauucuucuguccagccuccugaaaaacgacguuccucucgcuggaccccugaucgccggcgggaugcuuauugcuuguuacgugaucucuggaagcuccgccgaucugucucuggagaaggccgcugucgugagcugggaggaagaggcggaacauuccggcgccucucacaauauucucguugaggugcaggacgaugggacaaugaaaaucaaggacgaagagagagaugacacccugacaauccuucugaaagcuacgcuccuggccgucagcggaguguauccucucuccauucccgccacccuguucgucugguacuucuggcagaagaagaaacaacggucuggcgugcuuugggauacaccgagcccucccgagguugaacgcgcugugcuggacgauggcaucuauagaauuaugcagcgggggcugcucggacgcucccaggucggcguggggguuuuucaggagaacguguuccauaccauguggcacgucacaagaggagccgugcugauguaccaaggcaagcggcuugaaccuagcugggcgucugugaaaaaggaccugaucuccuacgggggaggcuggagacuccagggcagcuggaauaccggggaggagguucaggucauugcuguggaacccggaaaaaacccgaagaaugugcagacggccccuggcaccuuuaagacaucugagggggaagucggagccaucgcucuggacuucaaacccggcaccuccgggagcccuauugugaaccgcgagggaaagaucguuggccucuauggcaaugggguggucacaaccuccggaacauacgugucugccaucgcgcaagcuaaagccagccaggaaggcccccugcccgagauugaggaugaaguuuuucggaagagaaaccuuacgaucauggaccugcacccuggguccggaaaaacccgccgguaucugccggccauugugagagaggcuaucaagcgcaagcuccggacacugauucuugcccccaccagagucguggcuagcgaaauggccgaggcgcugaaaggcaugccuauccgcuaccagaccacagccguuaagucugaacauacggggaaagagaucguggaucucaugugccacgcuaccuucacaaugcggcugcugucccccgucagagugccuaauuauaacaugauuaucauggacgaggcccauuuuaccgaucccagcucuauugcugcccggggcuacaucagcacacgcgugggaaugggcgaagccgcugcgauuuucaugaccgccacgccuccgggguccgucgaggcuuuuccccaaucuaaugccguuauccaggacgaagagagagauaucccugaacggagcuggaacuccggauaugaguggauuacagacuuccccggcaagaccgugugguuugugccuucuaucaaaagcgggaaugauauugccaacugucuccgcaagaauggaaagagagucauccagcuuucccggaaaaccuucgacacagaguaccagaagaccaaaaacaacgauugggacuacgugguuacaaccgacauuagcgaaaugggcgcuaauuucagagccgaucgcgugaucgacccccggagaugccugaagccggucauucugaaagaugggccugagcgcgugauccucgcgggccccaugcccguuacgguggcuucugccgcccaacggagaggacgcaucggccggaaccacaauaaggaaggggaccaguauauuuacaugggacagccucugaacaaugaugaggaccaugcucacuggacagaggccaagaugcuucuggauaacaucaauacccccgaaggcauuaucccugcgcucuuugagccggaaagagagaaauccgccgcuauugacggggaauaucgccugagaggagaggcccggaagacauucgucgagcugaugcgcagaggcgaucuccccguguggcuuagcuacaaagucgcuuccgaaggguuucaguauucugaccggcgcuggugcuucgauggcgagagaaacaaucaagugcuggaagagaacauggacguugaaaucuggaccaaggagggagagcggaaaaagcugagaccucgcuggcucgaugcccggacguacagcgacccccuggcucuuagagaauuuaaagaguucgccgcgggccgccgguccgugucuggggaccugauccucgaaauuggaaagcugccucagcaccugacccagagagcccagaaugcucucgauaaccuugugaugcugcauaauagcgagcaaggcgggcgggccuaucgccacgcuauggaagagcugcccgacacaaucgagacccucaugcugcuugcccugauugccguccucacaggaggcguuacccuguuuuuccuguccggcagagggcucggaaagacaagcaucggccuucugugugugauggcuucuuccgugcugcucuggauggcgagcgucgaaccgcauuggauugccgcuucuaucauccuggaguuuuuccuuauggugcugcucauuccugaacccgaucggcagcgcaccccucaggacaaccagcuggccuacguugugaucgggcugcucuuuaugauucuuacggucgccgcuaaugagaugggacugcuggagacaaccaaaaaggaucucggcaucgggcacguggccgucgaaaaccaccaucacgcggccaugcuggacguggaucuucaucccgcuuccgccuggacccuguacgcuguugccacaaccauuaucacaccuaugaugagacacacgauugagaacaccacagcgaauaucagccucaccgccaucgcuaaccaagccgcuauucugaugggacuggacaaaggcuggcccaucucuaagauggauauuggcgugccgcuccuugcccuggggugcuauagccaggucaauccucugacacucaccgcugccgugcugaugcuuguugcgcauuacgccaucauuggacccggccugcaggcuaaagccacgcgggaagcucaaaagcgcaccgccgccgggaucaugaagaaccccacaguggacggaaucgucgcgauugaucucgacccugugguguaugaugcuaaauucgagaagcagcugggccagaucaugcugcucauucuuuguaccucccagauccugcugaugagaacaaccugggcccucugcgaaucuauuacgcuggcuacagggccgcuuaccacacugugggagggaagccccggcaaauuuuggaauaccaccaucgccguuuccauggccaacaucuuccggggcagcuaccucgcuggggccggacuggcguucucccugaugaagucucucggcgggggacgcagaggcacaggggcccaaggagagacgcuuggcgaaaaauggaagcggcagcugaaucagcugagcaaguccgaguuuaacaccuauaaaagaucuggcauuauggaagucgaccgcagcgaggcuaaggaagggcucaaacggggagagacaaccaagcacgccguguccagaggcacagcuaaacugcgcugguucguggagcggaaucuugucaagccugaagggaagguuaucgaccugggauguggcagagggggauggucuuacuauugcgccggccucaaaaaggugaccgaggugaaaggcuacacgaaggggggacccggccacgaagagccuauucccauggcgacauacggguggaaccuggucaaacugcauagcggaaaggauguguuuuucaucccuccggaaaaaugugacacccuccuuugcgauauuggcgaguccagccccaauccuaccaucgaggaagggcgcacacugcggguucugaagaugguggagcccuggcucagaggaaaccaguuuuguauuaagauccugaauccuuauaugcccucugucguggaaacccuugagcaaaugcagcgcaaacacggcggcaugcugguucggaacccgcucuccagaaauagcacacaugagauguacugggugucuugcgggacgggaaacaucgucuccgccgugaauaugaccagccgcaugcugcugaaccgguucacaauggcucacagaaagccuaccuaugaacgcgacguggaucucggcgccgggacaagacacgucgcuguugagcccgaaguggccaaccuggacauuaucggacagcggauugagaauaucaaacaugaacacaagucuaccuggcauuacgaugaggacaaccccuauaaaacgugggcuuaccacggcuccuaugaggugaagccuagcggguccgccagcucuauggucaauggagugguuaagcuucugaccaaacccugggaugugauuccuauggucacacagaucgcgaugaccgacacaaccccguuuggccaacagcgcguguucaaggaaaaaguugauacaagaacccccaaggccaaacggggcacggcucagaucauggaggugacagccaaguggcucuggggguuucugagcagaaacaagaaaccucggauuuguacccgcgaagaguucaccagaaagguccgguccaaugcugccaucggagccguguuuguugacgaaaaccaauggaauucugcgaaagaggcuguggaggacgaacgcuucugggaucuuguccauagagagcgggaacugcacaagcagggcaaaugcgccacaugcguguacaacaugauggggaagcgcgagaagaaacucggagaauuuggcaaggccaaagggagcagagcuauuugguacauguggcugggcgcccgguuccuggaguucgaggcucucggauuuaugaaugaagaccacugguucucccgcgagaacucucugagcggcgucgaaggggagggacuucauaagcugggcuauauccucagagauauuuccaaaauccccgggggaaauauguacgccgacgauacggcgggcugggacacccggaucacagaggaugaccugcagaacgaagccaagauuaccgauaucauggagccugaacacgcucuucuggccaaaucuauuuuuaagcucacauaucagaauaaggugguucgcgugcaaagacccgcuaaaaacgggaccgucauggacgugaucagccggcgcgaucagagaggcuccggacaggugggcacauacgggcugaauaccuucacgaacauggaggcccagcugauucggcaaauggaaagcgagggaaucuuuucuccguccgagcucgaaaccccuaaccuggcgggcagaguucuugacuggcuggagaagcaugggguggaacgccucaaacggauggccaucagcggagaugacugugucgugaagcccauugacgauagauucgcuacagcccugaccgcucuuaaugacaugggcaaaguucgcaaggauaucccucagugggagcccucuaagggguggaacgacuggcagcaggugccuuuuugcucccaccacuuccaucaacugauuaugaaagauggccgggaaaucgucgugcccuguagaaaucaggacgagcucgucggacgcgcccgggugagccagggcgcuggguggucccugagagagacagccugccugggaaagucuuaugcgcagauguggcaacucauguacuuucaccgccgggaucugagacuugccgcuaacgccauuuguagcgccguuccgguggacugggucccuaccucccgcacgacauggagcauccaugcucaccaucaguggaugaccacagaagauaugcugucuguguggaaucggguuuggauugaggaaaaccccuggauggaggacaaaacccacaucuccagcuggggcgaugugcccuaucucgggaagagagaagaccaguggugcggaucucugaucggccuuacggcccgggcgaccugggcuacaaauauucaagucgccaucaaccaggugagacgccugcucgggaaugagaacuaccuggacuacaugaccagcaugaaacgguucaagaaugaguccgauccugaaggcgcccugugguga

SEQ ID NO: 19222 - RNA, 9879 nt, Artificial Sequence
  derived and/or modified CDS sequence (opt5) from DENV-1__GU131787__SS-prME
agcgugaccaugcugcucaugcugaugcccacagcccuugcuuuccaccugacgaccagaggaggggaaccucauaugaucgucuccaagcaggaacggggaaaaucucuccuguuuaagacaagcgccggaguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacggaaugaaguucaccguuguggucggcgacguggccgggauucucgcucagggcaagaagaugauccggccgcaacccauggaguacaaauauucuuggaaaagcuggggcaaggccaagauuaucggggccgaugugcagaauaccacauuuaucauugacggaccuaacacccccgaauguccugaugaccagagagcuuggaauaucugggaggucgaggauuacggcuucggcauuuuuacgacaaacaucuggcugaagcugcgcgacuccuauacccagguuugcgaucaccggcuuaugagcgcggccauuaaagacucuaaggcugugcacgccgauaugggguacuggaucgaauccgagaaaaaugaaacauggaagcucgccagagcuagcuucaucgaggugaagaccuguauuuggcccaaaucucauacacugugguccaacggaguccuggaaagcgagaugaucauuccgaagaucuauggcgggccuauuucucaacacaauuaccgccccggauacuucacccagacggccggcccuuggcaucucgggaaacuggagcuugacuuugaucugugcgaaggaaccacagugguuguggacgagcacugcggcaaccggggccccagccucagaaccacaaccgucacggggaagaucauccacgaaugguguugccgguccuguacacugccuccccugcgcuucagaggagaggauggcugcugguaugggauggagauucggccggugaaagaaaaggaggaaaaucuuguuaagagcauggugucugcgggauccggcgaggucgacagcuuuucccucgggcugcuguguaucucuauuaugaucgaagaggugaugagaagccgcuggucccggaaaaugcucaugaccggaacacuggcuguuuucuuucuucugauuaugggccagcucaccuggaacgaccugaucagacugugcauuauggugggcgccaaugccucugaucgcauggggaugggaaccacauaccuugcucugauggccacguucaagaugagaccuauguuugcggucggccuccuguuccggcgccucaccagcagagaggugcugcuucugacaaucgggcucucccugguggcuucugucgaacugcccaacagccuugaggaacugggagacggccucgccauggggaucaugauucugaaacuccugaccgauuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuuggaagccugggcugcaagccgcugacgauguuucucaucgcugagaauaaaauuuggggccggcgcucuuggccccugaacgaagggaucauggccgucggaaucguguccauucuucugagcucccuccugaagaacgacguuccucucgcgggcccccugaucgccgggggaaugcuuauugcuuguuacgugaucagcggcucuagcgccgaucugucccuggagaaagcugccgaggucucuugggaagaggaagccgagcauagcggggcuucccacaauauucucguggaaguucaggacgauggaaccaugaagaucaaagacgaggagagagaugacacacugaccauccuucugaaggcgacacuccuggccgugucuggcgucuauccucucagcauucccgcuacccuguucgugugguacuucuggcagaaaaagaagcagcgguccggcguccuuugggauacgccuucucccccggaaguggagcgcgccguucuggacgaugggaucuauagaauuaugcagcggggacugcucggccgcagccaggugggggucggaguguuucaagaaaacguuuuccauaccauguggcacgugacaagaggcgccguccugauguaccaggggaaacggcuugagccuuccugggcuagcgugaagaaagaccugaucucuuacggaggcggcuggagacuccagggguccuggaauaccggagaggaagugcagguuauugccgucgagcccggcaagaacccuaaaaaugugcaaacagcgcccgggaccuuuaagacaccggaaggagaggugggcgcuaucgcccuggacuucaagccugggacgagcggaucucccauugucaaccgcgaaggcaaaaucgugggccucuaugggaauggaguugugaccacauccggcaccuacgucagcgccaucgcucaggccaaggcgucccaggaggggccucugcccgagauugaagaugagguguuucggaaaagaaaccuuaccaucauggaccugcaccccggaucuggcaagacacgccgguaucugccugcuauuguuagagaagccaucaaacgcaagcuccggacgcugauucuugccccgaccagaguggucgcuagcgagauggccgaagcucugaaggggaugcccauccgcuaccaaacaaccgccgugaaauccgagcauacaggcaaggagaucguugaucucaugugccacgcgaccuucacgaugcggcugcugagcccugugagaguccccaauuauaacaugauuaucauggacgaagcccauuuuacagauccuucuuccauugcugcccggggauacaucagcacccgcgugggcaugggggaggcugccgccauuuucaugaccgcuacacccccuggaucuguggaagcguuuccgcagagcaaugccgucauccaggacgaggaaagagauauccccgagcgguccuggaacucuggcuaugaguggauuaccgacuucccugggaaaacaguuugguuugugcccagcaucaaguccggaaaugauauugcuaacugucuccgcaaaaauggcaagagagugauccagcuuucucggaagaccuucgacacggaauaccagaaaaccaagaacaacgauugggacuacgucgugaccacagacauuagcgagaugggggccaauuucagagccgaucgcguuaucgacccucggagaugccugaaacccgugauucugaaggauggcccggaacgcgucauccucgcuggaccuaugcccgugaccguugccuccgcggcucagcggagaggccgcaucgggcggaaccacaauaaagagggagaccaguauauuuacaugggccagccccugaacaaugaugaggaccaugcccacuggacggaagccaagaugcuucuggauaacaucaauaccccugaggggauuauccccgcucucuuugaaccugagagagaaaagagcgccgcgauugacggagaguaucgccugagaggcgaggcccggaaaacauucguggaacugaugcgcagaggggaucucccggucuggcuuucuuacaagguggcuuccgagggcuuucaauauagcgaccggcgcuggugcuucgauggagaaagaaacaaucagguccuggaggaaaacauggacguggagaucuggaccaaagagggcgaacggaagaaacugagaccccgcuggcucgaugcccggacauacuccgacccucuggcucuuagagaguuuaaggaguucgccgcugggcgccggucuguuagcggagaccugauccucgagauuggcaaacugccccagcaccugacccagagagcccaaaaugcgcucgauaaccuugugaugcugcauaauuccgaacaagggggacgggccuaucgccacgcuauggaggagcugccugacacaaucgaaacccucaugcugcuugcccugauugcugugcucacgggcggcgucacacuguuuuuccugucugggagaggacucggcaagaccagcaucgggcuucuguguguuauggccuccagcgugcugcucuggauggccucuguggagccccauuggauugcugcguccaucauccuggaauuuuuccuuaugguccugcucauuccggagccugaucggcagcgcacaccccaggacaaccaacuggccuacgugguuaucggacugcucuuuaugauucuuacaguggcugccaaugagaugggccugcuggaaaccacaaagaaagaucucgggaucggacacgucgccguggagaaccaccaucacgcugccaugcuggacgucgaucuucauccugcgagcgccuggacgcuguacgcuguggccaccacaauuaucacccccaugaugagacacacaauugaaaacaccacggcuaauaucucucucaccgccaucgcgaaccaggccgcuauucugaugggccuggacaagggcuggccuaucuccaaaauggauauugggguuccccuccuugcccugggaugcuauagccaggugaauccgcugacacucaccgcugccguccugaugcuuguggcucauuacgccaucauuggcccugggcugcaagcgaaggccacacgggaggcucagaaacgcaccgccgcuggaaucaugaagaaccccacgguugacggcaucguggccauugaucucgaccccgucguguaugaugccaaguucgaaaaacagcuggggcagaucaugcugcucauucuuuguacaucucaaauccugcugaugagaaccacaugggcgcucugcgagagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgaaacacuuggcgagaaguggaaacggcagcugaaucagcuguccaagucugaauuuaacaccuauaagagaagcgggauuauggagguugaccgcuccgaagcgaaagagggacucaagcggggcgagacgacaaaacacgccgucucuagagggaccgcuaagcugcgcugguucguggaacggaaucuugugaaacccgagggaaaggucaucgaccugggcugugggagaggaggcuggagcuacuauugcgccggccucaagaaaguuaccgaagugaagggguacacaaaaggaggcccugggcacgaggaacccauuccuauggcuaccuacggauggaaccuggugaagcugcauuccggcaaagaugucuuuuucauucccccugagaagugugacacacuccuuugcgauauuggggagucuagcccgaaucccacgaucgaagagggacgcacccugcgggugcugaaaaugguugaaccuuggcucagaggcaaccaauuuuguauuaagauccugaaucccuauaugccuuccguggucgagacacuugagcagaugcagcgcaagcacggcgggaugcuggugcggaacccccucagcagaaauucuacccaugaaauguacuggguuuccugcggaacaggcaacaucgugagcgccgucaauaugaccucucgcaugcugcugaaccgguucacgauggcgcacagaaaaccgaccuaugagcgcgacguggaucucggggccggaacaagacacguggcugucgaaccugagguugccaaccuggacauuaucggccagcggauugaaaauaucaagcaugagcacaaauccaccuggcauuacgaugaggacaaccccuauaagacaugggcuuaccacgggagcuaugaagugaaacccucuggauccgccagcuccauggugaauggcgucgugaaacuucugaccaagccuugggauguuauucccauggugacacaaaucgcuaugaccgacacgacaccuuuuggccagcagcgcgucuucaaagagaagguggauaccagaaccccgaaagccaagcgggggacagcgcaaaucauggaaguuacggccaaauggcucuggggauuucugagcagaaacaagaagccccggauuuguacccgcgaggaguucacaagaaaagugcggucuaaugcugccaucggcgcugucuuuguggacgagaaccaguggaauagcgccaaggaggccguugaagacgagcgcuucugggaucuugugcauagagaacgggagcugcacaaacaggggaagugcgcgaccugcgucuacaacaugaugggaaaacgcgaaaagaagcucggcgaguuugggaaagcuaagggcuccagagccauuugguacauguggcugggagcccgguuccuggaguucgaagcucucggcuuuaugaaugaggaccacugguucucucgcgaaaacagccuguccgggguggagggagagggccuucauaaacugggguauauccucagagauauuucuaagaucccuggaggcaauauguacgccgacgauacagcugggugggacacccggaucacagaagaugaccugcagaacgaggcccgcauuaccgauaucauggaacccgagcacgcgcuucuggccagaagcauuuuuaaacucacguaucaaaauaaggucgugcggguucagcgcccugcuaaaaacggcaccgugauggacgucaucuccagacgggaucagagaggaucuggccagguggggacauacggacugaauaccuucacaaacauggaagcccaacugauucgccagauggagagcgagggcaucuuuucccccagcgaacucgagaccccgaaccuggcugaacgggugcuugacuggcuggagaaguaugggguugaaagacucaagcgcauggccaucucuggagaugacuguguggucaaaccuauugacgaucgguucgcgacggcccugacagcucuuaaugacaugggcaaggugagaaaagauaucccccagugggagccuuccaagggguggaacgacuggcagcaaguucccuuuugcagccaucacuuccaccagcugauuaugaaagauggccgcgagaucguggucccuugucggaaucaggacgaacucgugggcagagcccgcgucucucagggcgcuggguggucccugcgggagaccgccugccugggaaagagcuacgcucaaauguggcagcucauguauuuucauagacgcgaucugcggcuugccgcgaacgccauuuguuccgcugugcccguugacuggaucccgacaucuagaaccacguggagcauucacgcccaucaccaguggaugaccacagaagauaugcuguccguguggaaucgggucuggaucgaggaaaacccuuggauggaggacaagacccauaucagcucuuggggcgaugugcccuaccucgggaaaagagaggaccaauggugcggaucccugauuggccuuacagcccgcgcuaccugggccacaaauauccagguugcgauuaaccaggugcggagacugaucgggaaugaaaacuaccucgacuauaugaccagcaugaagcgcuucaaaaaugagucugaucccgaaggcgcucugugguga

SEQ ID NO: 19223 - RNA, 9879 nt, Artificial Sequence
  derived and/or modified CDS sequence (opt5) from DENV-1__HM181968__SS-prME
agcgugaccaugcugcucaugcugaugcccaccgcccuugcuuuccaccugacgacccggggcggggaaccucauaugaucgugaccaagcaggaacggggaaagucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaagggggcuacacagaacggacggcugaucacggccaaucccauuguuaccgacaaagagaagccugugaacaucgaagccgagccgcccuuuggcgagagcuauauugucaucggggcuggagaaaaagcccuuaagcucucuugguucaagaaaggcagcuccauugggaagauguuugaggcuacagccagaggcgcgcgccggauggccauccugggagauaccgcuugggacuucggcucugucgggggaguguuuacaagcguuggcaaacugguccaucagaucuucgggaccgccuacggagugcucuuuuccggcgugagcuggacgaugaagauugggaucggcguccugcuuaccuggcugggacucaauucuagauccacaagccugucuaugaccuguauugcugugggccugguuacacuuuaccucggggugaugguccaggccgauuccggaugcgugaucaacuggaaaggccgcgaacugaagugugggagcggaauuuucguuaccaaugaggugcacacauggaccgaacaauauaaguuucaggcggacuccccuaaacggcugucugccgcuaucggcaaggccugggaggagggggucugcggcauuagaagcgcuacgcgccucgaaaacaucauguggaaacagaucuccaacgagcugaaucauauucuucuggaaaacgacaugaaguucacagugguugugggagaugucgugggcauccucgcccaggggaaaaagaugauucggccgcaacccauggagcacaaauacucuuggaaaagcuggggaaaggccaagaucauuggcgcugacgugcagaauaccaccuuuaucaucgaugggccuaacacacccgaauguccugacgaucagagagcguggaauauuugggaggucgaggacuauggauucggcaucuuugccaccaacauuuggcugaagcugcgcgauuccuacacgcagguuugcgaccaccggcuuaugagcgcugccaucaaagauucuaaggccgugcaugcugacaugggcuauuggauugaauccgagaaaaaugaaacauggaagcucgccagagcgagcuucaucgaggugaagaccuguaucuggcccaaaucucacacacugugguccaacgggguccuggaaagcgagaugauuaucccgaagauuuacggaggcccuaucucucaacauaauuaucgccccggguacuucacccagacagcuggaccuuggcaccucggcaaacuggagcuugauuuugaccugugcgaagggaccacggugguuguggaugagcacugcggaaaccggggccccagccucagaaccacaaccgucacaggcaagauuauccaugaaugguguugccgguccuguacccugccuccccugcgcuucaaaggggaggacggaugcugguacggcauggagaucagaccggugaaggaaaaggaggaaaaucuuguuaaaagcauggugucugccggguccggagaggucgacagcuuuucccucggccugcuguguauuucuaucaugauugaagaggugaugcggagcagauggucccgcaagaugcucaugacggggacacuggccguuuuccuucugcucaucaugggacagcugaccuggaacgaucugauucggcuuugcaucauggugggcgcuaaugccucugacagaaugggcauggggacaaccuaucuggcgcucauggcuaccuuuaaaaugcgcccuauguucgccgucggacugcuccugagacggcuuacaagccgcgaggugcugcuccugacgauuggccugucccuuguggccucugucgaacugcccaacagccucgaggaacugggggauggacucgcuaugggcaucaugauccugaaacuucugaccgacuuucaaucccaccagcucugggccacacugcugagccuuaccuucauuaaaacaacccugucucuccauuacgcuuggaagacgauggccaugguucuguccaucgugagccucuuuccccugugucuuucuacaaccucccagaagaccacauggcugccugugcugcucgggagcuucggaugcaaaccgcugaccauguuucuuauuacagagaauaagaucuggggcagaaaaucuuggccccugaacgaaggcauuauggcggucggggugguuuccauccuccugagcucccuccugaagaacgaugugccucuugccggaccccugaucgcuggcgggaugcugauugccuguuaugucaucagcggaucuagcgcugaccucucccuggagaaagccgccgaggugucuugggaagaggaagcugagcacagcggcgcgucccauaauauucuuguugaagugcaggaugacgggacgaugaagaucaaagaugaggagcgggacgauacccugacaauucuccugaaggccacccuccuggcugucucuggaguguacccucuuagcauccccgccacacuguucgucugguauuuuuggcaaaagaaaaagcagcgcuccggcgugcugugggacaccccuucucccccggaaguugagagagccgugcucgaugacggcaucuaccggauuaugcagcgcgggcugcuuggaagaagccaggucggcguggggguuuuccaagaaaacguguuccacacgauguggcacgucacccggggagcugugcugauguaucagggcaaacgccucgagccuuccugggccagcgugaagaaagaccugaucucuuacgggggaggcuggagacuccagggcuccuggaauacaggggaggaaguucaggucauugcgguggagcccggaaagaacccuaagaaugugcaaaccgcucccggcacauuuaaaaccccggaaggggaggucggagccaucgcccuggauuucaagccuggcacaagcgggucucccauugugaaccgggaaggaaaaaucguuggccuuuacggcaaugggguggucacgaccuccggaacauaugugagcgcuauugcccaggcgaaggcuucccaggagggcccucugcccgagaucgaagacgagguuuuuagaaaacgcaaccugaccaucauggaucuccaucccgggucuggaaagacccggagauaccugccugccauugugcgcgaagccaucaagcggaaacuuagaacacugauucucgcuccgacgcgcgucguggccagcgagauggcugaagcccugaagggcaugcccauccgguaucaaaccacagcgguuaaauccgagcacaccgggaaggagauuguggaccugaugugccaugccacauucaccaugagacuccuuagcccuguccgcgugcccaauuacaacaugaucaucauggaugaagcucacuuuacggacccuucuuccauugccgcucggggcuauaucagcacaagagugggaaugggcgaggccgccgcuauuuucaugaccgcgacacccccugggucugucgaagccuuuccgcagagcaaugcuguuauccaggaugaggaacgggacauucccgagcgcuccuggaacucuggauacgaguggaucacagauuucccuggcaaaaccgugugguuugugcccagcaucaaguccgggaaugacauugccaacugucugagaaagaauggaaaacgggucauccagcugucucgcaagacauucgauaccgaauaucagaagacgaagaacaacgacugggacuacgugguuacaaccgauauuagcgagaugggcgccaauuuuagagcugaccgggugaucgauccuagacgcugccucaaacccgucauucugaaggacgggccggaacgggugauccuugccggcccuaugcccguuacaguggcguccgcugcccagagacgcggacggauuggcagaaaccauaauaaggagggggaucaguacaucuauaugggacagccccugaacaaugacgaggaucacgcccacuggaccgaagcuaaaaugcuccuggacaacaucaauacgccugagggcauuauccccgcccuguucgaaccugagcgcgaaaagagcgcggccauugauggggaguaccggcucagaggagaggcucgcaaaaccuucgucgaacuuaugagacggggcgaccugccgguguggcugucuuauaaggucgccuccgagggguuucaauacagcgaucgcagauggugcuucgacggcgaacggaacaaucaggugcucgaggaaaacauggauguugagaucuggacaaaagagggagaacgcaagaaacugagaccccgguggcuugacgcuagaaccuauuccgacccucuggcccuccgcgaguuuaaggaguucgcugccggccggagaucugugagcggggaucugauucuggagaucggaaagcucccccagcaucuuacacagcgcgcgcaaaaugcccuggacaaccuggugaugcuccacaauuccgaacagggcgggcgggcuuacagacaugccauggaggagcugccugauaccaucgaaacacuuaugcugcucgcucugauugccguccugaccggaggcguuacgcucuuuuuccuuucuggccgggggcugggaaaaacaagcaucggccugcucugugugauggccuccagcgugcugcuuuggauggcuucugucgagccccacuggauugcggccuccaucauucuggaauuuuuccucauggugcugcugaucccggagccugaccgccagagaacaccccaggauaaccaacucgcuuauguugugaucgggcuucuguuuaugauucugaccgucgccgccaaugagaugggacuccuggaaacaaccaagaaagaccuuggcaucgggcacguggcugucgagaaccaucaccaugccacaaugcuggauguggaccuccacccugcgagcgccuggacgcuguacgcuguugccaccacaauuaucacccccaugaugcggcauacaauugaaaacaccacggcuaauaucucucugaccgccauugcgaaccaggccgcuauccucaugggacuugauaagggcuggccuaucuccaaaauggacauuggcgugccccugcuggcccucgggugcuacagccaggucaauccgcugacacuuaccgcugccgugcugaugcucguugcucacuaugccaucauuggaccuggccugcaagcgaaggccacacgcgaggcucagaagagaaccgccgcugggaucaugaaaaaccccacgguggauggaauugucgccaucgaccuggaucccgugguguacgacgccaaguucgaaaaacagcucggccagaucaugcuucugauucuguguacaucucaaauccuccugaugcggaccacaugggcgcuuugcgagagcauuacccuggcuaccgggccucucacaacgcugugggagggauccccgggcaaguuuuggaauaccacaaucgccguuucuauggcuaacauuuuccgcggcagcuaucuggccggggccggacucgcuuuuucccuuaugaaaagccugggcgggggaagacggggcaccggggcccagggagaaacacugggcgagaaguggaagcgccagcucaaucagcuguccaaaucugaguucaacaucuacaagagaagcggcaucauggaggucgaccgguccgaagcgaaagaggggcuuaagagaggagagaccacgcgccacgccgugucucggggcacagcuaaacugagaugguucguggaacgcaaucucgucaagcccgaggggaagguuauugaucugggauguggcagagggggauggagcuauuacugcgccggccugaaaaaggugaccgaagugaaaggcuauaccaaagggggaccuggccaugaggaacccaucccuauggcuacauacggguggaaccucgucaaacuucacuccggaaaggacguguuuuucacacccccugagaaaugugauacacugcugugcgacauuggcgagucuagcccgaaucccacgaucgaagaggggagaacccuccgcguucugaagaugguggaaccuuggcuucggggaaaccaauuuuguauuaagauccugaaucccuacaugccuuccgucguggagacacucgagcagaugcagagaaaacauggcggcaugcugguucgcaacccccugagcagaaauucuacccacgaaauguauuggguguccugcgggacaggaaacauugucagcgccgugaauaugaccucuagaaugcuccugaaccgcuucacgauggcgcaccggaagccgaccuacgagagagauguggaccuuggcgccgggacacgccaugucgcuguugaaccugagguggccaaccuggauaucaucggacagagaauugaaaauaucaaacacgagcauaaguccaccuggcacuaugacgaggauaaccccuacaaaacaugggcuuaucauggcagcuacgaagugaagcccucuggguccgccagcuccauggucaauggagugguuaagcuccugaccaaaccuugggacgugauucccauggucacacaaaucgcuaugaccgauacgacaccuuuuggccagcagcggguguucaaggagaaaguugacacccgcaccccgaaggccaaaagaggcacagcgcaaauuauggaagugacggcccgguggcuuuggggguuucugagcagaaacaagaagccccggaucuguacccgcgaggaguucacaagaaaaguccggucuaaugcugccaucggagcuguguuuguugacgagaaccaguggaauagcgccaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcuaaagggucccgcgccauuugguacauguggcucggcgccagauuccuggaguuugaagcucuuggauucaugaaugaggaucacugguucucucgggaaaacagccuguccggcgucgagggggagggacuccauaagcugggcuacauccuucgcgacauuucuaaaaucccugggggaaauauguaugccgaugacacagcuggcugggauaccagaauuacagaagacgaucugcaaaacgaggccaagaucaccgacaucauggaacccgagcacgcgcuccuggccacgagcauuuuuaaacugaccuaccagaauaaggugguucgggugcagcgcccugcuaagaacgggacagucauggaugugaucuccagacgggaccagcgcggcucuggacaagugggcaccuaugggcucaauacauucaccaacauggaagcccagcugauuagacagauggagagcgagggaaucuuucuucccuccgaacuggagacgccgaaccucgcugaacggguucuggauuggcuugagaaauacggcguggaaagacugaagcgcauggccauuagcggggacgacugugucgugaaaccuaucgaugaccgguucgcgacagcccucaccgcucugaaugauaugggaaagguuagaaaagacaucccccagugggagccuucuaagggcuggaacgauuggcaacaggugcccuuuugcucccaucacuuccaccagcugauuaugaaggacgggcgcgagaucgucgugccuugucggaaucaggaugaacucgucggcagagcccgcgugagccaaggagcuggcuggucucugcgggagacagccugccuugggaaauccuaugcucagauguggcagcugauguacuuucauagacgcgaccuccggcuggccgcgaacgccauuuguagcgcuguucccaucgauugggugccgaccuccagaacgaccuggucuauucacgcccaucaccaauggaugacaaccgaagacaugcuuagcgucuggaaucgcguguggaucgaggaaaacccuuggauggaggauaagacacauguuuccagcuggggagacgugcccuaucugggcaaacgggaggaccaguggugcgggucucucauuggacugaccgccagagcuacaugggccuccaauauccaggucgcgaucaaccaggugcggagacugauuggcaaugaaaacuaccucgauuacaugaccagcaugaagcgcuucaaaaaugagggggaccccgaaggcgcucugugguga

SEQ ID NO: 19224 - RNA, 9879 nt, Artificial Sequence
  derived and/or modified CDS sequence (opt5) from DENV-1__GU131789__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacaacccccggcacauucaagacgccggaaggggaggugggagcgauugcucucgauuuuaagccuggcaccagcgggucucccaucgugaaccgcgaaggaaaaaucgucggccuguauggcaauggggugguuacaaccuccggaaccuacgugagcgccauugcccaggcuaaggccucccaggagggcccucuucccgagaucgaagacgaggucuuccggaaaagaaaccugacaauuauggaucugcaccccgggucuggaaagacgcgccgguaucucccugcgaucgugagagaagcuauuaaacgcaagcugcggacccuuauccuggccccgacaagaguuguggccagcgagauggcugaagcccucaagggcaugcccauccgcuaccaaaccacagcugucaaauccgagcauaccgggaaggagauuguggaccugaugugccacgccacguuuacaaugcggcugcucagcccuguuagagugcccaauuauaacaugaucauuauggaugaagcgcauuucaccgacccuucuuccaucgccgcucggggcuacauuagcacccgcgucggaaugggcgaggccgcugccaucuuuaugacagccacacccccugggucuguggaggcuuucccgcagagcaaugcggugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacguuugauacagaauaccagaaaaccaagaacaacgacugggacuacguggucacaaccgauaucagcgagaugggcgcuaauuucagagccgaccgcgugauugauccucggagaugccugaaacccguuauccucaaggacgggccggaacgcgugauccuggccggcccuaugcccgucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacaccugagggcaucauucccgcccuguucgaaccugagagagaaaagagcgcugccaucgauggggaguaucgccugagaggagaggcgcggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcucaaaaugcccuugacaaccugguuaugcugcauaauuccgaacagggcgggcgggcguaucgccacgccauggaggagcucccugauaccauugaaacgcugaugcuucuggcucucaucgccgugcugacaggaggcgugacccuguucuuucucucuggcagagggcuuggaaagaccagcauuggccugcugugugucauggcuuccagcguucuccuguggauggccucuguggagccccauuggaucgccgcuuccaucauucuugaguucuuucugauggugcuccugaucccggagccugaccggcagcgcacaccccaggauaaccaacuggcguacgucgugauugggcuccuuuucaugauccugaccguugccgcuaaugagaugggacugcucgaaacaacgaagaaagaccugggcauugggcacguggccgucggaaaccaccaucacgccgcuaugcuugauguggaccugcauccugccagcgcguggacccucuacgccgucgcuacaaccaucauuacacccaugaugagacacaccaucgagaacacgaccgccaauaucucucugacagcuauugccaaccaggcggccauccugaugggccucgauaagggcuggccuauuuccaaaauggacaucggggugccccuucuggcucugggaugcuauagccagguuaauccgcucacccugacagccgcugugcuuaugcuggucgcccauuacgcuauuaucggcccugggcuccaagccaaggcgacccgggaagcccagaaacgcacggcugccggaaucaugaagaaccccacaguggauggcauuguugcuaucgaccuggaucccguggucuaugacgccaaguuugagaaacagcuggggcagauuaugcuccuuauccuguguaccucucaaauucugcucaugagaacaaccugggcccugugcgaaagcaucacccuugcgacaggaccucugacgacccucugggagggcuccccgggcaaguucuggaauacaaccaucgcugugucuauggccaacauuuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggaucauggaaguggaccgcuccgaggccaaagaaggacugaagcggggcgagacaaccaaacacgcgguuucuagagggaccgccaaacuucgcugguuugucgagcggaaucuggugaaacccgaaggaaaggugauugaucucggcugugggagaggaggcuggagcuacuauugcgcuggccugaagaaagucacagagguuaagggguacaccaaaggaggcccugggcacgaagaacccaucccuauggccacauacggauggaaccuggugaagcuccauuccggcaaagacguguucuuuauucccccugaaaagugugauacgcuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcugugaauaugacgucucgcaugcugcucaaccgguuuaccauggcccacagaaaaccgacauaugaacgcgaugucgaccugggggcgggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacggauacaaccccuuucggccagcagcgcguguuuaaagaaaaggucgacaccagaacaccgaaagcuaagcgggggacggcccaaauuauggaggugaccgcgaaauggcuguggggauuccuuagcagaaacaagaagccccggaucuguacacgcgaagaguuuaccagaaaaguucggucuaaugccgcuauuggcgccguguucgucgacgaaaaccaguggaauagcgcuaaggaggccguggaggaugaacgcuuuugggaccugguucauagagagcgggaacuccacaaacaggggaagugcgccacaugcguguacaacaugaugggaaaacgcgagaagaagcugggcgaguucgggaaagcgaagggcuccagagcuaucugguacauguggcugggagcccgguuucucgaguucgaggcccugggcuucaugaaugaagaucacugguuuucucgcgagaacagccuuuccggggucgaaggagagggccugcauaaacucggguauauucugagagacaucucuaagaucccuggaggcaauauguacgcugaugacaccgccgggugggauacacggauuaccgaggacgaucuucagaacgaagcucgcaucacggacauuauggagcccgaacacgcccugcucgcgaaaagcaucuucaagcugaccuaucaaaauaaaguggucagagugcagcggccugccaagaacggcacaguuauggaugugauuucccgcagagaccagcggggaucuggccaggucgggaccuacggacugaauacauuuaccaacauggaggcucaacucaucagacagauggaaagcgagggcaucuucucccccagcgagcuggaaacgccgauucuugccgagcgcgugcuggauuggcucgaaaaguaugggguggagcggcugaaaagaauggcuaucucuggagacgacuguguugugaagccuauugaugaccgcuuugccacagcgcuuaccgcccugaacgauaugggcaaaguccggaaggacaucccccagugggaaccuuccaaaggguggaaugauuggcagcaagugcccuucugcagccaucacuuucaccagcucauuaugaaggacggcagagagaucguugugccuugucgcaaccaggaugagcuggucggacgggcuagagugucucagggcgccggguggucccugcgcgaaacagcuugccucggaaagagcuacgcccaaauguggcagcugauguauuuccaucggagagaccuucgccuggcugccaaugcgauuuguuccgccguccccguggauuggaucccgaccucucggacgaccuggagcauccacgcucaucaccaguggaugacaaccgaggacaugcucuccguuuggaacagaguguggauugaagagaauccuuggauggaagauaaaacacauaucagcucuuggggcgacguccccuaccuggggaagcgggaggaccaauggugcggaucccuuauuggccugaccgccagagccacaugggcuaccaacauccagguggccauuaaucagguucgccggcucaucgggaacgagaauuaccuggauuauaugacgagcaugaaaagauuuaagaacgaaucugaccccgagggcgcgcugugguga

SEQ ID NO: 19225 - RNA, 9879 nt, Artificial Sequence
  derived and/or modified CDS sequence (opt5) from DENV-1__GU131790__SS-prME
agcgugaccaugcugcucaugcuggugcccacagcccuugcuuuccaccugacgaccagaggcggggaaccucauaugauuguuuccaagcaggaacggggaaaaucucuccuguuuaagacaagcgccggcgugaacaugugcacccuuauugcgauggaccugggggagcucugugaagauacaaugaccuacaaaugcccccgcaucacagagaccgaacccgacgauguggacuguuggugcaaugcuacggauaccugggucacauauggaaccuguucccaaacaggcgagcacagacgggacaagcgcucuguggcccuggccccucauguugggcugggacucgagaccagaacggaaacauggaugagcuccgagggcgcuuggaaacagauucagcggguggaaaccugggcccugcgccaccccggcuucacagucaucgcucuuuuucuggcccaugcgauugggaccucuaucacccagaagggaaucauuuucauccuccugaugcuugugacaccuagcauggccaugagaugcguuggcauugggucccgggauuuuguggagggacugagcggcgcuacgugggucgacguggugcucgagcacgggucuugugucaccacaauggccaaggauaaacccacccuggacaucgaacugcucaagacagagguuaccaacccugcugugcugcgcaaacuuugcauugaagccaagaucuccaauacgacaaccgauagcagauguccgacccaaggagaggcgacacugguggaagaacaagacgccaacuucgucugccggcgcaccuuuguggauagaggcuggggcaauggguguggacucuucggcaaagggucucugauuacaugcgcuaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgccacgauuacaccccaagcuccuaccaccgagauccagcucacagacuacggcgcccugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaagugguugugcugggaagccaagagggcgccaugcacacggcucugaccggggccacagaaauucagaccuccggaacaaccacgaucuuugccggccaucucaaaugcagacugaagauggauaaacuuacacugaaggggaugagcuaugucauguguaccggcucuuucaaacucgagaaggaaguggcugagacccagcacggaacaguucuggugcagauuaaguacgagggcaccgacgccccgugcaaaaucccuuucuccacacaagaugaaaagggggucacgcagaacggacggcugaucaccgcgaaucccauugugacagacaaagagaagccugugaacaucgaagcugagccgcccuuuggcgagagcuauauuguuaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggagucuuuaccagcgugggcaaacuggugcaucagauuuucgggacggccuacggaguccucuuuuccggcgugagcuggaccaugaagaucgggauuggcguucugcuuacauggcugggacucaauucuagauccaccagccugucuaugacauguaucgcugugggccuggucacccuuuaccucggggugaugguucaggccgauuccggaugcgugauuaacuggaaaggccgcgaacugaagugugggagcggaaucuucgucacaaaugaggugcacaccuggacggaacaauauaaguuucaggcugacuccccuaaacggcugucugccgcgauuggcaaggccugggaggaggggguuugcggcaucagaagcgcuacacgccucgaaaacaucauguggaaacagauuuccaacgagcugaaucauauccuucuggaaaacgacaugaaguucaccguggucgugggagauguggccggcauucucgcucaggggaaaaagaugauccggccgcaacccauggaguacaaauauucuuggaaaagcuggggaaaggccaagcugauuggcgccgacguccagaauaccacauuuaucaucgaugggccuaacacccccgaauguccugacgaucagagagcuuggaauauuugggagguugaggacuacggauucggcaucuuuacgacaaacauuuggcugaaacuucgcgauuccuauacccaggugugcgaccaccggcucaugagcgcggccaucaaagauucuaaggcugugcacgccgacaugggcuacuggauugaauccgagaaaaaugaaacauggaagcuggccagagcuagcuucaucgaggucaagaccuguaucuggcccaaaucucauacacugugguccaacggggugcucgaaagcgagaugauuaucccgaagauuuauggaggcccuaucucucaacacaauuaccgccccggguacuucacccagacggccggaccuuggcaucugggcaaacuugagcuggauuuugaccucugcgaagggaccacaguuguggucgaugagcacugcggaaaccggggccccagccugagaaccacaaccgugacgggcaagauuauccacgaaugguguugccgguccuguacacugccuccccuucgcuucagaggggaggacggaugcugguauggcauggagauccggccgguuaaagaaaaggaggaaaaucucgucaagagcauggucucugcgggguccggagagguggacagcuuuucccugggccugcucuguauuucuaucaugauugaagagguuaugagaagccgcuggucccggaaaaugcugaugaccgggacacuugcuguguucuuucugcucaucaugggacagcugaccuggaacgaucugauuagacuuugcaucauggucggcgccaaugccucugaccgcaugggcauggggaccacauaccuggcucucauggccacguucaagaugagaccuauguuugcggugggacuccuguuccggcgccugaccagcagagaggugcuucugcucacaauuggccugucccuggucgcuucuguugaacuucccaacagccuggaggaacucggggauggacuggccaugggcaucaugauccucaaacugcuuaccgacuuucaaucccaucagcugugggccacacuccugagccugaccuucauuaagacgacauuuucucuucacuaugcuuggaaaaccauggccauggugcuguccaucgugagccucuucccccugugucucucuaccacaucccagaagaccacauggcugccuguccuucuggggagccugggaugcaagccgcucacgauguuucugauugcugagaauaaaaucuggggccggcgcucuuggccccuuaacgaaggcauuauggccguggggaucguuuccauccugcucagcucccugcucaagaacgaugugccucuggcgggaccccuuauugccggcgggaugcugaucgcuuguuacgucauuagcggaucuagcgccgaccugucccucgagaaagcugccgaggugucuugggaagaggaagccgagcauagcggcgcuucccacaauauccugguugaagugcaggaugacgggaccaugaagauuaaagaugaggagagagacgauacacuuaccauccugcucaaggcgacacugcucgccgucucuggaguguauccucugagcauccccgcuacccuuuucgucugguacuucuggcagaagaagaagcagcgguccggcgugcugugggacacgccuucucccccggaaguugagcgcgccgugcuggaugacggcauuuauagaaucaugcagcgggggcuccugggacgcagccaggucggcguggggguuuuucaagaaaacguguuccauaccauguggcacgucacaagaggagccgugcuuauguaccagggcaaacggcuggagccuuccugggcuagcgugaagaaagaccucauuucuuacgggggaggcuggagacugcagggcuccuggaauaccggggaggaaguucaggucaucgccguggagcccggaaagaacccuaaaaaugugcaaacagcgcccggcaccuuuaagacaccggaaggggaggucggagcuauugcccucgauuucaagccuggcacgagcgggucucccaucgugaaccgcgaaggaaaaauuguuggccuguauggcaaugggguggucaccacauccggaaccuacgugagcgccaucgcucaggccaaggcgucccaggagggcccucuucccgagaucgaagacgagguuuuucggaaaagaaaccugaccauuauggaucugcaccccgggucuggaaagacacgccgguaucucccugcuaucgugagagaagccauuaaacgcaagcugcggacgcuuauccuggccccgaccagagucguggcuagcgagauggccgaagcucucaagggcaugcccauucgcuaccaaacaaccgccguuaaauccgagcauacagggaaggagaucguggaccugaugugccacgcgaccuucacgaugcggcugcucagcccugucagagugcccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccguuauucaggaugaggaaagagacauccccgagcgguccuggaacucuggauaugaguggaucaccgauuucccuggcaaaacagugugguuugugcccagcauuaaguccgggaaugacaucgcuaacugucuucgcaaaaauggaaagagagucauucagcugucucggaagaccuucgauacggaauaccagaagaccaagaacaacgacugggacuacgugguuaccacagauaucagcgagaugggcgccaauuucagagccgaccgcgugauugauccucggagaugccugaaacccgucauccucaaggacgggccggaacgcgugauucuggcuggcccuaugcccguuaccguggccuccgcggcucagcggagaggacgcaucggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucgucgaacucaugcgcagaggcgaccuuccgguguggcugucuuacaaggucgcuuccgagggguuucaauauagcgaucggcgcuggugcuucgacggcgaaagaaacaaucaggugcuggaggaaaacauggauguugagauuuggaccaaagagggagaacggaagaaacucagaccccgcuggcuggacgcccggacauacuccgacccucuugcucugagagaguuuaaggaguucgccgcuggccgccggucugugagcggggaucucauccuggagaucggaaaacugccccagcaccucacccagagagcccaaaaugcgcuugacaaccuggugaugcugcauaauuccgaacagggcgggcgggccuaucgccacgcuauggaggagcucccugauacaauugaaacccugaugcuucuggcccucaucgcuguccugacgggaggcguuacacuguuuuuccucucuggcagagggcuuggaaagaccagcauuggccugcugugugugauggccuccagcgugcuccuguggauggccucugucgagccccauuggaucgcugcguccauuauccuugaauuuuuccugauggugcuccugaucccggagccugaccggcagcgcacaccccaggauaaccaacuggccuacguugugauugggcuccuuuuuaugauccugacagucgcugccaaugagaugggacugcucgaaaccacaaagaaagaccugggcauugggcacguggccgucgagaaccaccaucacgcugccaugcuugauguggaccugcauccugcgagcgccuggacgcucuacgcuguugccaccacaaucauuacccccaugaugagacacacaaucgaaaacaccacggcuaauauuucucugaccgccaucgcgaaccaggccgcuauccugaugggacucgauaagggcuggccuauuuccaaaauggacaucggcgugccccuucuggcccuggggugcuauagccaggucaauccgcucacacugaccgcugccgugcuuaugcugguugcucauuacgccauuaucggaccuggccuccaagcgaaggccacacgggaggcucagaaacgcaccgccgcugggauuaugaagaaccccacgguggauggaaucgucgccaucgaccuggaucccgugguguaugacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaauugccguuucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcaucauggaggucgaccgcuccgaagcgaaagaggggcugaagcggggagagacgacaaaacacgccgugucuagaggcaccgcuaaacuucgcugguucguggaacggaaucuggucaaacccgaggggaagguuauugaucucggauguggcagagggggauggagcuacuauugcgccggccugaagaaagugaccgaagugaagggcuacacaaaagggggaccuggccacgaggaacccaucccuauggcuaccuacggguggaaccuggucaagcuccauuccggaaaagacguguuuuucauucccccugagaagugugauacacuucugugcgacaucggcgagucuagcccgaaucccacgauugaagaggggcgcacccugcggguucucaaaaugguggaaccuuggcugagaggaaaccaauuuuguaucaagauucuuaaucccuauaugccuuccgucguggagacacuggagcagaugcagcgcaagcacggcggcaugcucguucggaacccccugagcagaaauucuacccaugaaauguacuggguguccugcgggacaggaaacaucgucagcgccgugaauaugaccucucgcaugcugcucaaccgguucacgauggcgcacagaaaaccgaccuaugagcgcgauguggaccugggcgccgggacaagacacgucgcuguugaaccugagguggccaaccuugauaucauuggacagcggaucgaaaauauuaagcaugagcacaaauccaccuggcauuacgacgaggauaaccccuauaagacaugggcuuaccacggcagcuaugaagugaaacccucuggguccgccagcuccauggucaauggagugguuaagcugcucaccaagccuugggacgugauccccauggucacacaaauugcuaugaccgauacgacaccuuuuggccagcagcgcguguucaaagagaagguugacaccagaaccccgaaagccaagcggggcacagcgcaaaucauggaagugacggccaaauggcuguggggguuucuuagcagaaacaagaagccccggaucuguacccgcgaggaguucacaagaaaaguccggucuaaugcugccauuggagcuguguuuguugacgagaaccaguggaauagcgccaaggaggccguggaagaugagcgcuucugggaccugguccauagagaacgggagcuccacaaacagggcaagugcgcgaccugcguguacaacaugauggggaaacgcgaaaagaagcugggagaguuuggcaaagcuaagggguccagagccaucugguacauguggcugggcgcccgguuccucgaguucgaagcucugggauuuaugaaugaggaucacugguucucucgcgaaaacagccuuuccggcgucgagggggagggacugcauaaacucggcuauauucugagagacaucucuaagauuccugggggaaauauguacgccgaugacacagcuggcugggauacccggaucacagaagacgaucuucagaacgaggcccgcaucaccgacauuauggaacccgagcacgcgcugcucgccaaaagcaucuuuaagcugacguaucaaaauaaagugguuagagugcagcggccugcuaagaacgggaccgucauggaugugauuucccgcagagaccagcggggcucuggacaggugggcacauacgggcugaauaccuucacaaacauggaagcccaacucaucagacagauggagagcgagggaaucuuuucccccagcgaacuggagaccccgaaccuugcugaacgcguucuggauuggcucgagaaguauggcgugaaacggcugaagagaauggccaucucuggggacgacugugucgugaaaccuaucgaugaccgcuucgcgacggcccuuacagcucugaaugauaugggaaagguucggaaagacauuccccagugggaaccuuccaagggcuggaacgauuggcagcaagugcccuuuugcagccaucacuuccaccagcucaucaugaaggacgggagagagauugucgugccuugucgcaaucaggaugagcuggucggccgggccagagugucucagggagcuggcuggucccugcgcgaaaccgccugccucgggaaaagcuacgcucaaauguggcagcugauguauuuucaucggagagaccuucgccuggccgcgaacgccaucuguuccgcuguucccguggauuggauuccgacaucucggaccacguggagcauccacgcccaucaccaguggaugaccacagaggacaugcucuccgucuggaauagaguguggauugaagagaacccuuggauggaagauaagacccauaucagcucuuggggagacguucccuaccugggcaaacgggaggaccaauggugcgggucccuuaucggacugacagccagagcuaccugggccacaaauauucagguggcgaucaaccagguccgccggcucauuggcaaugagaacuaccuggauuauaugaccagcaugaagagauucaaaaaugaaucugaccccgagggggcucugugguga

SEQ ID NO: 19226 - RNA, 9879 nt, Artificial Sequence
  derived and/or modified CDS sequence (opt5) from DENV-1__GU131791__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaacucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggccuaugaaaaucaaggaugaggagcgggacgauacgcugaccauccuucugaaagccacacuccuggcugugucuggagucuauccccucagcauuccugccacccuguucgugugguacuucuggcaaaagaaaaagcagcgcuccggcguccuuugggacacacccucuccgccugaaguggagagagccguucuggaugacggcaucuaucggauuaugcagcgcgggcugcucggaagaagccaggugggcgucgggguguuucaagaaaacguuuuccauaccauguggcacgugacgcggggagcuguccugauguaccagggcaagagacuugagcccuccugggccagcgugaaaaaggaccugaucucuuacgggggaggcuggcgccuccagggcuccuggaauaccggggaggaagugcagguuauugcggucgagccuggcaagaaccccaagaaugugcaaacagcuccgggcaccuuuaaaacaccugaaggggaggugggagccaucgcccuggauuucaagcccggcaccagcgggucuccuauugucaaccgggaaggaaagaucgugggccucuauggcaaugggguugugacaacguccggaaccuacgucagcgcuaucgcccaggcgaaggcuucccaggagggcccccugcccgagauugaagacgagguguuuagaaagcgcaaccuuacaaucauggaucugcacccugggucuggaaaaacccggagauaucugccggccauuguucgcgaagccaucaagcggaaacucagaacccugauucuugcucccacacgcguggucgccagcgagauggcugaagcccugaagggcaugccuauccgguaccaaacgaccgcggugaaguccgagcauacagggaaagagaucguugaccucaugugccacgccaccuucacaaugagacugcugagccccgugcgggucccuaauuauaacaugauuaucauggaugaagcucauuuuaccgaccccucuuccauugccgcucgcggcuacaucagcacgagagugggaaugggcgaggccgccgcuauuuucaugacagcgaccccuccggggucuguggaagccuuuccccagagcaaugcugucauccaggaugaggaacgggacaucccugagcgcuccuggaacucuggauaugaguggauuaccgauuuccccggcaagacaguuugguuugugccuagcaucaaauccgggaaugacauugccaacugucucagaaagaauggaaaacgggugauccagcuuucuagaaagaccuucgauacagaauaccaaaagaccaaaaacaacgacugggacuacgucgugacgacagauauuagcgagaugggcgccaauuuccgcgcugaccggguuaucgaucccagacgcugccugaagccggugauucugaaagacgggccugaacgggucauccucgccggccccaugcccgugaccguugcguccgcugcccagagacgcggacggaucggcagaaaccacaauaaggagggggaucaguauauuuacaugggacagccucugaacaaugacgaggaucaugcccacuggacagaagcuaaaaugcuucuggacaacaucaauacccccgagggcauuaucccugcccucuuugaaccggagcgcgaaaagagcgcggccauugauggggaguauagacugcggggagaggcucgcaagacguucguggaacugaugagacggggcgaccuccccgucuggcuuucuuacaaaguggccuccgagggguuucaauauagcgaucgcagauggugcuucgacggcgaacggaacaaucagguccuggaggaaaacauggauguggagaucuggaccaaggagggagaacgcaagaaacugcgcccucgguggcucgacgcuagaacauacuccgacccccuggcccuucgcgaguuuaaagaguucgcugccggccggagaucuguuagcggggaucugauccucgagauuggaaagcugccucagcaccugacccagcgggcgcaaaaugcccucgacaaccuugugauccugcauaauuccgaacagggcgggcgcgcuuauagacacgccauggaggagcugcccgauacaauugaaacccucaugcugcuugcucugaucgccgugcucacaggaggcgucacccuguuuuuccugucuggccgggggcucggaaaaacgagcauuggccuucuguguguuauggccuccagcgugcugcucuggauggcuucuguggagccgcauuggaucgcggccuccaucauucuggaauuuuuccuuaugguccugcucaucccugagcccgaccgccagagaacaccucaggauaaccaacuggcuuacgugguuauugggcugcucuuuaugauccuuaccguggccgccaaugagaugggacugcuggaaaccacaaagaaggaccucggcauugggcacgucgcuguggagaaccaccaucacgccgcgaugcuggaugucgaccuucaucccgccagcgcuuggacccuguacgccguggcuacaacgaucauuaccccuaugaugcggcacacaaucgaaaacaccacagccaauaucucucucaccgcgauugccaaccaggcugccauccugaugggacuggauaaaggcuggcccauuuccaagauggacaucggcguuccgcuccuugcucuggggugcuauagccaggugaauccucugacgcucaccgccgcuguccugaugcuuguggcccauuacgcgauuaucggacccggccugcaagccaaagcuacacgcgaggcccagaagagaaccgcugccgggaucaugaaaaaccccacaguugauggaauuguggccaucgaccucgauccugucguguaugacgcgaaguucgaaaagcagcugggccagauuaugcugcucauccuuuguaccucucaaauucugcugaugcggacgacaugggcucucugcgagagcaucacccuggccacagggccgcuuaccacccugugggagggaucccccggcaaauuuuggaauacaacgaucgcugugucuauggccaacauuuuccgcggcagcuaccucgccggggcuggacuggccuucucccugaugaaaagccucggcgggggaagacggggcaccggggcgcagggagaaacacuuggcgagaaauggaagagacagcugaaucagcuguccaaaucugaauuuaacaccuauaagcgcagcggcaucauggagguugaccgguccgaagccaaggaggggcucaaaagaggagagacaaccaagcacgcugucucucgcggcacggccaaacugcggugguucguggaaagaaaucuugugaagccugaggggaaagucauugaucugggauguggccgcgggggauggagcuacuauugcgcuggccucaagaagguuacagaagugaaaggcuacaccaaaggcgggcccgggcacgaggaaccuauccccauggccaccuacggguggaaccuggugaaacugcauuccggaaaggacgucuuuuucauuccuccggagaaaugugauacacuccuuugcgacaucggcgagucuagccccaauccuaccauugaagaggggcggacacugagagugcugaagaugguugaacccuggcuccgcggaaaccaauuuuguaucaaaauccugaauccuuauaugcccuccguggucgagacgcuugagcagaugcagcggaagcacggcggcaugcuggugagaaacccgcucagccgcaauucuacccaugaaauguacuggguuuccugcgggacaggaaacauugugagcgcggucaauaugaccucucggaugcugcugaacagauucacaauggcccaccgcaagccuaccuaugagagagauguggaccucggcgcugggacgcggcacguggccgucgaacccgagguugcuaaccuggauaucauuggacagcgcaucgaaaauauuaaacaugagcacaaguccaccuggcauuacgacgaggauaaccccuauaaaacaugggccuaccacggcagcuaugaagugaagccuucuggguccgcuagcuccauggugaauggagucgugaaacuucugaccaagcccugggacguuaucccuauggugacacaaaucgccaugaccgauacaaccccguuuggccagcagagagucuucaaggagaaaguggacacgcggacacccaaggcgaaaagaggcaccgcccaaauuauggaaguuaccgcuaaguggcucuggggguuucugagccggaacaaaaagccucgcaucuguacaagagaggaguucacgcggaaggugcgcucuaaugccgcuauuggagccgucuuuguggacgagaaccaguggaauagcgccaaagaggcgguugaagaugagagauucugggaccuugugcaucgggaacgcgagcugcacaagcagggcaaaugcgcuaccugcgucuacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcguggagggggagggacuucauaagcugggcuauauucuccgggacaucucuaaaauccccgggggaaauauguacgcugaugacacagccggcugggauacccgcauuacagaagacgaucugcagaacgaggcgagaaucaccgacauuauggaaccugagcacgcccuucuggcuaagagcaucuuuaaacucacauaucaaaauaaggucgugcggguucagcgccccgccaaaaacgggaccgugauggaugucauuuccagacgggaccagagaggcucuggacaggugggcacguacgggcugaauaccuucacaaacauggaagcucaacugauccgccagauggagagcgagggaaucuuuuccccgagcgaacucgagaccccuaaccuggccgaacgggugcuugauuggcuggagaaguauggcguugaaagacucaagcgcauggcgauuucuggggacgacuguguggucaaacccaucgaugaccgguucgccacagcucugaccgcccuuaaugauaugggaaaggugagaaaagacauuccucagugggagcccuccaagggcuggaacgauuggcagcaaguuccuuuuugcagccaucacuuccaccagcugaucaugaaagacgggcgcgagauugugguccccugucggaaucaggaugaacucgugggcagagcucgcgucucucagggagccggcuggucccugcgggagacggcuugccugggaaagagcuacgcccaaauguggcagcucauguauuuucauagacgcgaccugcggcuugcggccaacgcuaucuguuccgccgugccgguugauuggauuccuacaucuagaaccacauggagcauccacgcccaucaccaguggaugaccacggaagacaugcuguccguguggaaucgggucuggaucgaggaaaaccccuggauggaggauaagacccauauuagcucuuggggagacgugcccuaccucggcaaaagagaggaccaauggugcgggucccugaucggacuuacagcucgcgccaccugggcgacaaauauucagguugcuaucaaccaggugcggagacugauuggcaaugaaaacuaccucgauuauaugaccagcaugaagcgcuucaaaaaugagucugacccugaaggggcccugugguga

SEQ ID NO: 19227 - RNA, 9879 nt, Artificial Sequence
  derived and/or modified CDS sequence (opt5) from DENV-1__GU131792__SS-prME
agcgugaccaugcugcugaugcugaugcccacagcccuugcuuuccaccugacgaccagaggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccgcgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaacccugggcucugcgccacccuggcuucaccgugaucgcccuuuuucuggcgcaugccauugggacauccaucacccagaagggaaucauuuucauccuccugaugcuugucacccccucuauggcuaugagaugcgugggcauugggagccgggccuuuguugagggacuguccggcgcuacauggguggaugucgugcucgagcacgggagcugugugacgaccauggccaaggacaaaccuacacuggauaucgaacugcucaagaccgaggucacaaaccccgcgguucugcgcaaacuuugcauugaagccaagaucucuaauaccacgacagacuccagaugucccacccaaggagaggcuacccugauggaagaacaagaugccacauucgugugccggcgcaccuuuguggacagaggcuggggcaacggguguggacucuucggcaaagggagccugauuacaugcgcuaaguuuaagugcgucacgaaacuugagggaaagaucgugcaguacgaaaaucugaaauauucuguuaucgugaccguccacacaggcgaucagcaucaaguggggaacgaguccaccgaacacggaacaaccgccacgauuaccccucaggcccccacaagcgagauccagcucccugacuacggcgcucugacccuggacuguucuccccggacaggccucgauuucaaugaaaugguucugcuuaccaugaaggagaaauccuggcuggugcauaagcagugguuucucgaccugccgcuuccuuggacgagcggggcguccacaucucaagagaccuggaaccgccaggaucugcucgucacauucaaaaccgcccacgcuaagaagcaggaaguggucgugcugggaagccaagagggcgccaugcacaccgggcugacaggagccacggaaauucagaccuccggcacaaccacaaucuuugcugggcaucucaaaugcagacugaagauggacaaacuuacccugaagggcaugagcuauguuauguguacgggaucuuucaaacucgagaaggaaguggccgagacacagcacggcaccguccuggugcagauuaaguacgaggggaccgaugcgcccugcaaaaucccuuucuccacacaagacgaaaagggaguuacccagaauggccggcugaucacagcuaaccccauugugacggauaaagagaagcccgucaauaucgaagccgagccuccguuuggggagagcuauauugugaucggagccggcgaaaaagcucuuaagcucucuugguucaagaaagggagcuccauuggcaagauguuugaggccaccgcuagaggagcccgccggauggcgauccugggcgacacagccugggauuucgggucugugggaggcguuuuuaccagcgucgggaaacuggugcaucagaucuucggaacagcuuacggcgugcucuuuuccggggucagcuggaccaugaagauuggcaucggagugcugcuuacguggcugggccucaacucuagauccaccagccugucuaugacauguauugccguugggcuggugacccuuuaccucggagucauggugcaggcugacuccggcugcguuaucaauuggaaagggcgcgaacugaaguguggaagcggcauuuucgggacaaacgaggugcacaccuggacagaacaauauaaguuucaggccgauucccccaaacggcugucugcggccaucggcaagccuugggaggagggagucugcggcauuagaagcgcuacccgccucgaaaauaucauguggaaacagaucuccaacgagcugaaccauauucuucuggaaaaugacaugaaguucacggugguugugggggacgucgugggaauccucgcccagggcaaaaagaugauucggccccaaccuauggagcacaaauacucuuggaaaagcugggggaaggcuaagaucauuggagccgaugugcagaacacaaccuuuaucaucgacggccccaauaccccggaauguccugaugaccagagagccuggaacauuugggaggucgaggauuauggcuucgggaucuuuacaaccaauauuuggcugaagcugcgcgacucccacacgcagguuugcgaucaucggcuuauggcugcggccaucaaagacagaaaggcugugcacgccgauaugggauacuggauugaaagcgagaaaaacgaacccuggaagcucgcccgcgcuucuuucaucgaggugaagacauguaucuggccuaaaucccauacccuguggagcaauggcguccuggaaucugagaugauuauccccaagauuuaugggggaccuaucucccaacacaacuaccggcccggcuauuucacacagaccgccgggccguggcaccucggaaaacuggagcuugacuuugaucugugcgaaggcacaaccgugguuguggacgagcauugcggcaauagagggccuagccuccggacgaccacagucaccggaaagauuauccacgaaugguguugccgcucuuguacacugccgccccugagauucaaaggcgaggaugggugcugguacggaauggagauccggccugugaaggaaaaggaggaaaaccuuguuaaaagcaugguguccgcgggcagcggggaggucgacucuuuuucccucggacugcuguguauuagcaucaugauugaagaggugaugagaucccgcuggucucggaagaugcucaugaccggcacgcuggcuguuuuccuucugcucaucaugggccagcugacauggaaugaccugauuagacuuugcaucauggugggggccaacgccagcgaucgcaugggaaugggcaccacauaccuggcucucauggccaccuuuaaaaugagaccgauguucgcggucgggcugcucuuucggcgccugaccuccagagaggugcuucugcucacaauuggacugucucugguggcuagcgucgaacuucccaauucccuggaggaacucggcgacgggcuggccaugggaaucaugauccucaagcugcuuacggauuuccaaucucaucagcugugggccacccuccugagccugacauuuauuaaaaccacacuuucccugcacuaugcuuggaagaccauggccaugguucucagcaucgugucucuguucccucucugucuguccacgacaagccagaagaccaccuggcuucccgugcugcugggcucucucggcugcaaaccucugacaauguuucuuauuaccgagaacaagaucugggggcggaaauccuggccccugaaugaaggaauuauggcugucggcgugguuagcauccuccugucuucccuccugaagaacgacgugccucuugccgggccccugaucgcgggaggcaugcugauugccuguuacgucaucagcggguccagcgcugaucucucucuggagaaagccgcugaggugagcugggaagaggaagccgagcauuccggagccucucacaacauucuuguugaagugcaggacgauggcacaaugaagaucaaagacgaggagcgcgaugacacgcugaccauucuccugaaggcuacacuccuggcggucagcggcguguauccgcuuuccaucccugccacccuguucgucugguacuuuuggcaaaagaaaaagcagagaucuggggugcugugggauacacccagcccucccgaaguugagcgggcugugcucgacgauggaaucuaucgcauuaugcagagaggccugcuugcccggucccaggucggggugggaguuuuccaagaaaauguguuccacaccauguggcaugucacgcgcggcgccgugcugauguaccaggggaaaagacucgagccgucuugggcuagcgugaagaaagaccugaucuccuauggaggcggcuggcggcuccaggggagcuggaacaccggagaggaaguucaggucauugccguggagccuggcaagaaucccaagaacgugcaaacagcgccugggaccuuuaaaacacccgaaggagaggucggcgcuaucgcccuggacuucaagcccgggaccucuggauccccuauugugaauagagaaggcaaaaucguuggccuuuacgggaacggaguggucacaacgagcggcaccuacgugucugccauugcucaggccaaggcgucccaggaggggccgcugcccgagaucgaagaugagguuuuucgcaaacggaaucugacaaucauggaccuccacccuggaagcggcaagaccagacgcuaucugcccgcuauugugcgggaagccaucaagagaaaacuucgcacccugauucucgccccuacacgggucguggcuuccgagauggccgaagcucugaaggggaugcccaucagauaccaaacgaccgccguuaaaucugagcauacaggcaaggagauuguggaucugaugugccacgcgaccuucacaaugcgccuccuuagcccuguccgggugccgaacuauaauaugaucaucauggacgaagcccauuuuaccgaucccuccagcauugcugccagaggauacaucucuacgcgggugggcaugggggaggcugccgccauuuucaugacagcuaccccucccggauccgucgaagcguuuccucagagcaacgccguuauccaggacgaggaacgcgauauucccgagagaucuuggaauagcggcuaugaguggaucaccgacuucccggggaaaacagugugguuugugccuuccaucaagucuggaaacgauauugcuaauugucugcggaagaacggcaaacgcgucauccagcugagcagaaagaccuucgacacagaauaccagaaaaccaagaauaacgauugggacuaugugguuacgacagacauuuccgagaugggggccaacuuucgggccgauagagugaucgacccccgccggugccucaaacccgucauucugaaggauggcccugaaagagugauccuugcuggacccaugccuguuaccguggccucugcggcucagcgccggggcagaauugggcgcaaucacaacaaggagggagaccaguacaucuacaugggccagccgcugaauaacgaugaggaccacgcccauuggacagaagccaaaaugcuccuggauaauaucaacacccccgaggggauuaucccugcucuguucgaacccgagcgggaaaagagcgccgcgauugacggagaguauagacuccgcggcgaggccagaaaaacguucgucgaacuuaugcggcgcggggaucugccuguguggcuguccuacaaggucgcuagcgagggcuuucaauauucugacagacgguggugcuucgauggagaacgcaauaaccaggugcucgaggaaaauauggacguugagaucuggaccaaagagggcgaaagaaagaaacugcggcccagauggcuugaugcccgcacauacuccgacccgcuggcucuccgggaguuuaaggaguucgccgcugggagacgcagcguguccggagaccugauucuggagaucggcaagcucccucagcaccuuacccagcgggcccaaaacgcgcuggauaaucuggugaugcuccauaacucugaacaagggggcagagccuaucggcacgcuauggaggagcugcccgacacaaucgaaacccuuaugcugcucgcccugauugcuguccugacaggcggcguuacccucuuuuuccuuagcgggcgcggacugggcaaaacguccaucgggcugcucugugugauggccucuagcgugcugcuuuggauggccuccgucgagccucacuggauugcugcgagcaucauucuggaauuuuuccucauggugcugcugauccccgagccugauagacagcggacaccccaggacaaucaacucgccuacguugugaucggacuucuguuuaugauucugaccgucgcugccaacgagaugggccuccuggaaaccacaaagaaagaucuugggaucggacauguggccgucgagaaucaccaucacgcuaccaugcuggacguggaucuccauccggccucugcguggacacuguaugccguugcuacgaccauuaucacaccuaugaugcgccacaccauugaaaacacaaccgccaacaucucccugacggcuauugccaaucaggcggccauccucaugggccuugacaagggcuggcccaucagcaaaauggauauuggggugccccugcuggcucucggaugcuacucucaggucaacccucugacccuuacagccgcugugcugaugcucguugcccacuacgcuaucauuggcccggggcugcaagccaaggcgaccagagaggcccagaagcggacagcugccggaaucaugaaaaaucccaccguggacggcauugucgcuaucgaucuggacccugugguguaugaugccaaguucgaaaaacagcucgggcagaucaugcuucugauucuguguacgucccaaauccuccugaugcgcacaaccugggcccuuugcgagagcauuacacuggcgaccggaccccucaccacacugugggagggcucuccuggcaaguuuuggaacacgaccaucgcuguuagcauggccaauauuuucagaggguccuaccuggcuggagccggccucgccuuuucucuuaugaaaagccucgggggaggccggcgcgggacaggagcucagggcgaaacccugggcgagaaguggaagagacagcucaaccagcuguccaaaagcgaguucaauaucuauaagcgguccgggaucauggaggucgacagaucugaagccaaagagggacuuaagcgcggcgagacaacccggcaugcggugagcagagggacggccaaacugcgcugguucguggaacggaaccucgucaagcccgagggaaagguuauugaccugggcugugggagaggaggcugguccuacuauugcgcuggccugaaaaaggugacagaagugaaaggguacaccaagggaggcccugggcacgaggaaccgauccccauggccaccuauggauggaaucucgucaaacuucauucuggcaaggauguguuuuucacaccucccgagaaaugugacacccugcugugcgauauuggggagagcuccccuaaccccacaaucgaagagggacgcacgcuccggguucugaagaugguggaaccguggcuuagaggcaaucaauuuuguauuaagauccugaacccuuacaugcccucugucguggagacccucgagcagaugcagcgcaaacacggcgggaugcugguucggaauccccugagcagaaacuccacacacgaaauguacugggugagcugcggaaccggcaauauugucucugcugugaacaugacaucccgcaugcuccugaaucgguucaccauggcccauagaaagccuacguaugagcgcgacguggaucuuggggcgggaaccagacacgucgccguugaacccgagguggcuaaccuggacaucaucggccagcggauugaaaacaucaaacaugagcacaagagcacauggcauuacgaugaggacaauccuuauaaaaccugggccuaccacgggucuuaugaagugaagccguccggaagcgcuucuuccauggucaacggcgugguuaagcuccugacaaaacccugggaugugauuccuauggucacccaaaucgccaugacagacaccacgcccuuuggccagcagcgcguguucaaggagaaaguugauacaagaaccccuaaggcuaaacgggggaccgcccaaauuauggaagugacagcgagauggcuuuggggauuucugagccggaauaagaagccccgcaucuguacgagagaggaguucacccggaaaguccgcuccaacgccgcuaucggcgccguguuuguugacgagaaucaguggaacagcgcuaaggaggccguggaagacgagagauucugggaucucguccagaaagaacgggagcugcacaagcaggggaaaugcgccacaugcguguacaauaugaugggaaagcgcgaaaagaaacugggcgaguuugggaaggcgaaaggcucuagagcuauuugguauauguggcucggagcccgguuccuggaguuugaagcccuuggcuucaugaacgaggaccauugguucagccgcgaaaauucccugucuggggucgagggagagggccuccacaagcugggguacauccuuagagauauuagcaaaaucccgggaggcaacauguacgcugacgauaccgccgggugggacacacggauuaccgaagaugaccugcaaaaugaggcuaagaucacagauaucauggaaccugagcaugcccuccuggcgaccuccauuuuuaaacugacguaucagaacaaggugguucgcgugcagagacccgccaagaauggcaccgucauggacgugaucucucggcgcgaucagagaggaagcggccaaguggggacauacggacucaacaccuucacaaauauggaagcucagcugauucggcagauggaguccgagggcaucuuucuuccuucugaacuggagacccccaaccucgccgaaagaguucuggacuggcuugagaaauaugggguggaacgccugaagcggauggcuauuagcggagaugacugugucgugaaaccuaucgacgauagauucgccacggcgcucacagcccugaacgacaugggcaagguucgcaaagauaucccccagugggagccguccaagggguggaaugacuggcaacaggugccuuuuugcagccaccacuuccaucagcugauuaugaaggauggccgggagaucgucgugcccuguagaaaccaggacgaacucgucggacgcgcucgggugucucaaggcgccggguggucccugagagagaccgcuugccuuggaaaaagcuacgcccagauguggcagcugauguauuuucaccgccgggaucucagacuggcugccaaugcgauuuguucugccguucccguggacugggucccuacaucccgcaccacguggagcauccaugcucaccaucaauggaugaccacagaagauaugcuuuccguguggaaccggguuuggauugaggaaaauccguggauggaggacaagacccacgugucuagcuggggcgauguccccuaccuggggaaaagagaggaccaguggugcggaucccucaucggccugacagcccgggccaccugggcuagcaacauucagguggccaucaaucaggugagacgccugaucgggaacgaaaauuaucucgacuacaugacaucuaugaagcgguucaaaaacgagggcgauccugaaggagcgcugugguga

SEQ ID NO: 19228 - RNA, 9879 nt, Artificial Sequence
  derived and/or modified CDS sequence (opt5) from DENV-1__HM488256__SS-prME
agcgugaccaugcugcucaugcugaugcccacagcccuugcuuuccaccugacgaccagaggaggggaaccucauaugauugucuccaagcaggaacggggaaaaucucuccuguuuaagacaagcgccggcguuaauaugugcacccuuauugccauggaccugggggagcucugugaagauacaaugaccuacaaaugcccgcgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcuccccgacuacggcgcccugacacuggauuguucuccucggaccggccucgacuucaacgaaauggugcugcuuacgaugaaggagaaauccuggcugguccauaagcagugguuucucgaucugccccuuccguggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaacuggcugagacccagcacggaaccguccuggugcagauuaaguacgagggcacagacgccccuugcaaaauccccuucuccacccaagaugaaaaggggguuacacagaacggacggcuuaucacggcgaauccuauugugaccgacaaagagaagcccgucaacaucgaagcugagcccccuuuuggcgagagcuauauugugaucggggccggagaaaaagcccucaagcugucuugguucaagaaaggcagcuccauugggaagauguuugaggcuacagccagaggcgcucgccggauggccauccugggagcgccggccugggauuucggcucuaucgggggaguguuuaccagcguuggcaaacucguccaucagauuuucgggacagcuuacggagugcuguuuuccggcgugagcuggaccaugaagaucgggauuggcguccuucugacguggcucggacucaauucuagauccaccagccugucuaugacauguaucgccgugggccuuguuacccucuaccugggggugaugguccaggcugacuccggaugcgugauuaacuggaaaggccgcgaacugaagugugggagcggaaucuucguuacaaaugaggugcacaccuggacagaacaauauaaguuucaggccgauucccccaaacggcucucugcggccauuggcaaggcuugggaggagggggucugcggcaucagaagcgccacccgccuggaaaacaucauguggaaacagauuuccaacgagcuuaaucauauccugcucgaaaacgacaugaaguucacggugguugugggagacgucgcuggcauucuggcccaggggaaaaagaugauccggccucaacccauggagcacaaauacucuuggaaaagcuggggaaaggccaagauuaucggcgcugaugugcagaauacaaccuuuaucauugacgggccuaacacccccgaauguccggaugaccagagagcguggaauaucugggagguggaggauuauggauucggcauuuuuacaaccaacaucuggcugaaacuucgcgacuccuacacgcaggucugcgaucaccggcucaugagcgccgcuauuaaagacucuaaggccguucaugccgauaugggcuauuggaucgaauccgagaaaaaugaaacauggaagcuggcuagagccagcuucaucgaggugaagaccuguauuugggcgaaaucucacacacugugguccaacggggugcucgaaagcgagaugaucauuccuaagaucuacggaggccccauuucucaacauaauuaucgcccuggguacuucacccagacagcuggacccuggcaccugggcaaacuugagcuggacuuugaucucugcgaagggaccacggucgugguugacgagcacugcggaaaccggggcccuagccugagaaccacaaccgugacaggcaagaucauccaugaaugguguugccgguccuguacccugcccccgcuucgcuucagaggggaggauggaugcugguacggcauggagauuagcccugucaaagaaaaggaggaaaaucucgugaagucuaugguuuccgccgggagcggagagguggacuccuuuucucugggccugcucuguaucagcauuaugaucgaagaggucaugcgguccagauggucucgcaaaaugcugaugacggggacacuugccguguucuuucugcucauuguuggacagcugcccuggaacgaccugauccggcuuugcauuauggugggcgcuaccgccagcgcgagaaugggcauggggacaaccucccuggcucucauggccaccuucaagaugcgccccauguuugccgucggacugcuguucagacggcugacaucucgcgaggugcuucugcucacgaucggccugagccugguggcuuccgucgaacuuccuaauagccuggaggaacucggggauggacuggccaugggcaucaugauucucaaacugcuuaccgacuuucaaucucaccagcugugggcuacacuccugucccugaccuucaucaagacaaccuuuagccuucauuaugccuggaaaacgauggcgauggggcugucuguugugucccucuucccgcugugucucagcacaaccucucagaagaccacauggcugcccgugcuucugggaucccugggcugcaagccucucaccauguuucugauugccgagaacaaaaucuggggcagacggagcuggccccuuaaugaagggauuauggcugucggaaucguguccauccugcucagcucucugcucaagaacgauguuccucuggccggcccccuuauugcugggggaaugcugaucgccuguuacgugauuagcggcuccucugccgaccugagccucgagaaagcugcggaggucuccugggaagaggaagccgagcacucuggggcuagccauaacauccugguggaaguucaggaugacggaacaaugaagauuaaagaugaggagcgcgacgauacgcuuaccauccugcucaaggccacacugcucgccguguccggcgucuauccucugucuauccccgcuacccuuuucgugugguacuucuggcagaagaagaagcagagaagcggcguccugugggacacaccguccccucccgaaguggagcgggccguucuggaugacgggauuuaucgcaucaugcagagaggacuccugggccggagccaggugggggucggaguguuucaagaaaauguuuuccacaccauguggcacgugacgcgcggcgcgguccuuauguaccaggggaaaagacuggagccuucuugggcuuccgugaagaaagaucucauuagcuauggaggcggcuggcggcugcaggggucuuggaacaccggagaggaagugcagguuaucgccgucgagcccggcaagaauccgaaaaacgugcaaacagccccugggaccuuuaagacacccgaaggagaggugggcgcuauugcccucgacuucaagccugggaccuccggaagccccaucgucaauagagaaggcaaaauugugggccuguacgggaacggaguugugacaacguccggcaccuacgucucugcgaucgcucaggccaaggccagccaggaggggccccuuccugagaucgaagacgagguguuucgcaaacggaaucugacaauuauggaucugcauccgggauccggcaagaccagacgcuaucuccccgcuaucguucgggaagccauuaaaagaaagcugcgcacccuuauccuggcuccuacacggguggucgccagcgagauggcggaagcccucaaggggaugcccauuagauaccaaacgaccgcugugaaaucugagcacacaggcaaggagaucguugaccugaugugccaugccaccuucacaaugcgccugcucuccccugugcggguccccaacuauaauaugaucauuauggaugaagcucacuuuaccgacccuagcucuaucgccgccagaggauacauuagcacgcgggugggcaugggggaggcugcggccaucuucaugacagcuaccccgcccggauccguggaagccuuuccucagucuaacgccgucauucaggaugaggaacgcgacauccccgagagaagcuggaacuccggcuaugaguggaucaccgauuucccugggaaaacaguuugguuugugcccucuauuaagagcggaaacgacaucgcuaauugucuucggaaaaacggcaagcgcgugauucagcuguccagaaagaccuucgauacagaauaccagaagaccaagaauaacgacugggauuaugucgugacgacagacaucagcgagaugggggccaacuuccgggcggacagaguuauugauccgcgccggugccugaaaccugugauccucaaggacggccccgaaagagucauucuggcuggacccaugccugugaccguugccucugccgcucagcgccggggcagaaucgggcgcaaucauaacaaagagggagaucaguacaucuacaugggccagccccuuaauaacgacgaggaucacgcccacuggacagaagcgaagaugcugcucgacaauauuaacaccccugaggggaucauuccggcccuguuugaacccgagcgggaaaaguccgcugccaucgauggagaguauagacugcgcggcgaggcuagaaaaacguucguggaacucaugcggcgcggggaccuuccugucuggcugagcuacaagguggccuccgagggcuuucaauauucugauagacgguggugcuucgacggagaacgcaauaaccagguccuggaggaaaauauggauguggagauuuggaccaaagagggcgaaagaaagaaacuccggcccagauggcuggacgcucgcacauacagcgauccucuugcccugcgggaguuuaaggaguucgcggccgggagacgcuccguuucuggagaccucauccuggagaucggcaaacugccccagcaucucacccagcgggcucaaaacgcccuugacaaucuggugaugcugcacaacagcgaacaagggggcagagcuuaucggcaugccauggaggagcucccggauacaauugaaacccugaugcuucuggcccucaucgcugugcugacaggcggcgucacccuguuuuuccucuccgggcgcggacuuggcaagacgagcauugggcugcuguguguuauggcgucuuccgugcuccuguggauggccagcguggagccucacuggaucgcugccucuauuauccuugaauuuuuccugaugguccuccugauccccgagccugacagacagcggacaccccaggauaaucaacuggccuacgugguuauuggacuccuuuuuaugauccugaccguggcugccaacgagaugggccugcucgaaaccacaaagaaagaccuggggauuggacacgucgcgguggagaaucaucaccaugccgcuaugcuugaugucgaccugcacccugccuccgcuuggacccucuaugccguggcgacaacgaucauuacccccaugaugcgccauacaaucgaaaacaccacagccaacauuagccugaccgcuaucgccaaucaggcugccauccugaugggccucgauaagggcuggccgauuucuaaaauggacaucgggguuccucuucuggcucugggaugcuacagccaggugaacccccucacgcugaccgccgcgguccuuaugcugguggcccacuacgcuauuaucggccccgggcuccaagccaaggcuacaagagaggcccagaaacggaccgccgcgggaauuaugaagaauccuacaguugauggcaucguggcuaucgaccuggauccggucguguaugacgccaaguucgaaaaacagcuggggcagauuaugcuccuuauccuguguaccucccaaauucugcucaugcgcacgacaugggcucugugcgagucuaucacccuugccacaggaccccugaccacccucugggagggcagcccuggcaaguuuuggaacacaacgauugccguguccauggcuaauaucuucagagggagcuaccuggccggagcgggccuggccuucucccucaugaaaucucuugggggaggccggcgcgggaccggagcucagggcgaaacacugggcgagaaguggaaaagacagcugaaccagcucagcaaguccgaauuuaauaccuauaagcggucugggaucauggagguugauagaagcgaagccaaagagggacugaagcgcggcgagacaaccaaacacgcugucucccgggggacggccaaacuuagaugguucguggaacgcaaccuggugaaacccgagggaaaggucauugaccucggcugugggcggggaggcuggucuuacuauugcgcgggccugaagaaaguuacagaagugaagggguacaccaaaggaggcccugggcaugaggaacccaucccuauggccaccuauggauggaaucuggugaagcuccacagcggcaaagacgucuuuuucauuccgcccgagaagugugauacacuucugugcgacaucggggaguccagcccuaaccccaccauugaagagggaagaacacugcgcgugcucaaaaugguugaaccuuggcugcggggcaaucaauuuuguaucaagauucuuaaccccuacaugccgucuguggucgagacgcuggagcagaugcagagaaagcauggcgggaugcucgugcgcaauccucugucccggaacagcacccacgaaauguacuggguuucuugcggaacaggcaauaucguguccgcugucaacaugaccagcagaaugcugcucaaucgcuucacaauggcccaccggaaacccaccuaugagagagauguggaccugggggcuggaacgcgccauguggccgucgaacccgagguugcuaaccuugauaucauuggccagagaaucgaaaacauuaagcacgagcauaaaucuaccuggcacuacgacgaggauaauccuuauaagacaugggccuaccauggguccuaugaagugaaacccagcggauccgcgagcucuauggugaacggcgucgugaagcugcucaccaagccuugggacguuaucccgauggugacacaaauugccaugaccgauacaacccccuuuggccagcagcgggucuucaaagagaagguggacacgcgcacaccuaaagcuaagagagggaccgcccaaaucauggaaguuaccgcuaaauggcuguggggauuucuuagccggaauaagaagcccagaaucuguacacgggaggaguucacgcgcaaagugagauccaacgccgccauuggcgcggucuuuguggaugagaaucaguggaacucugcuaaggaggccguugaagacgagcgguucugggaccuggugcaccgcgaaagagagcuccacaaacaggggaagugcgcgaccugcgucuacaauaugaugggaaaacgggaaaagaagcugggcgaguuugggaaagcuaagggcagccgcgccaucugguauauguggcugggagcuagauuccucgaguucgaagcccugggcuuuaugaacgaggaucauugguucucccgggaaaauucucuuagcgggguggagggagagggccugcacaaacucggguacauucugcgcgacaucuccaagauuccuggaggcaacauguacgcggaugacacagccgggugggauaccagaaucacagaagacgaucuucagaaugaggcucggaucaccgacauuauggaacccgagcaugcccugcucgcuaaaucuaucuuuaagcugacauaucaaaacaaagucgugcgcguucagagaccggccaagaauggcaccgugauggaugucauuagccggcgcgaccagagaggauccggccagguggggacguacggacugaacaccuucacaaauauggaagcgcaacucauccggcagauggagagcgagggcaucuuuucuccuuccgaacuggagacccccaaccuugccgaaagagugcuggauuggcucgagaaguaugggguugaacgccugaaacggauggcuaucagcggagacgauuguguggucaagccuaucgacgacagauucgccacagcucuuaccgcccugaacgauaugggcaaagugcgcaaggacauuccccagugggagccuucuaaaggguggaaugauuggcagcaaguucccuuuugcucccaccacuuccaucagcucaucaugaaggacggccgggagauuguggucccguguagaaaccaggaugaacuggugggacgcgcucgggucagccagggcgccggguggucccugagagagacggcgugccucggaaagucuuacgcccaaauguggcagcugauguauuuucaccgccgggaccuuagacuggcugccaaugccaucuguagcgcugugccuguugauuggauucccacaucccgcaccacauggagcauccaugcccaccaucaguggaugaccacggaagacaugcucucuguguggaaccgggucuggauugaggaaaaucccuggauggaggauaaaacccacaucuccagcuggggcgacgugccuuaccuggggaagagagaggaucaauggugcggaucucuuaucggccugacagcgcgggcuaccugggccacaaacauucagguugccaucaaucaggugagacgccucauugggaacgaaaauuaucuggacuacaugaccagcaugaaacgguucaagaacgaguccgacccggaaggcgcucugugguga

SEQ ID NO: 19229 - RNA, 9879 nt, Artificial Sequence
  derived and/or modified CDS sequence (opt5) from DENV-1__GU131793__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaccacacagaagggaaucaucuucauucuccugaugcuugucacgccuagcauggccaugagaugcgugggcaucgggucccgggauuuuguugagggacugagcggcgcuaccuggguggacgucgugcucgagcacgggucuugugugacaaccauggccaaggauaaacccacacuggacauugaacugcucaagaccgaggucacgaacccugcuguucugcgcaaacuuugcaucgaagccaagauuuccaauacaaccaccgauagcagauguccgacacaaggagaggcgacccugguggaagagcaggacgccaacuucgugugccggcgcacauuugucgauagaggcuggggcaauggguguggacucuucggcaaagggucucugaucacgugcgcuaaguuuaagugcgugaccaaacuugagggaaagauuguucaguacgaaaaccugaaauauuccgugaucgucacagugcacaccggcgaccagcaucaaguugggaaugagagcacagaacacggaaccacggccaccaucacaccccaggcuccuaccacagagauucagcucaccgacuacggcgcccugacgcuggauuguucuccccggacaggccucgacuucaacgaaauggugcugcuuaccaugaaggagaaauccuggcugguccauaagcagugguuucucgaucugccucuucccuggacaagcggggccuccaccucucaagagaccuggaaucgccaggaccugcucgugacauucaaaacggcucacgcgaagaagcaggaagucgugguucugggaagccaagagggcgccaugcacaccgcucugacaggggccaccgaaauccagacauccggaaccacgacaauuuuugccggccaucucaaaugcagacugaagauggauaaacuuacccugcgggggaugagcuaugugauguguaccggcucuuucaagcucgagaaagaagucgcugagacacagcacggaaccgugcugguucagaucaaguacgagggcacagacgccccgugcaagauuccuuucuccacgcaagaugaaaaaggggugacccagaacggaagacugaucacagcgaaucccaucgucaccgacaaggagaaaccugugaacauugaagcugagccccccuuuggcgagagcuauaucgugauuggggccggagaaaaggcccuuaaacucucuugguucaagaagggcagcuccaucgggaaaauguuugaggcuacagcccgcggcgcucggagaauggccauucugggagauaccgcgugggacuucggcucuaucgggggaguuuuuacgagcgucggcaagcuggugcaucagaucuucgggaccgccuacggagugcucuuuuccggcgucagcuggacaaugaaaauugggaucggcgugcugcuuaccuggcugggacucaauucucgcuccacaagccugucuaugaccuguauugcuguuggccuggugacacuuuaccucggggucauggugcaggccgauuccggaugcguuaucaacuggaagggccgggaacugaaaugugggagcggaauuuucgugaccaaugagguccacacguggacagaacaauauaaguuucaggcugacuccccuaagagacugucugccgcgaucggcaaagccugggaggagggggugugcggcauucgcagcgcuacccggcucgaaaacaucauguggaagcagaucuccaacgagcugaaucauauucuucuggaaaacgacaugaaauucaccguuguggucggagauguggccggcauccucgcucaggggaagaaaaugauuagaccgcaacccauggaguacaaguauucuuggaaaagcuggggaaaggccaagaucauuggcgccgacgugcagaauacaaccuuuaucaucgaugggccuaacacgcccgaauguccugacgaucagcgcgcuuggaauauuugggaggucgaggacuacggauucggcaucuuuacaaccaacauuuggcugaaacugcgggauuccuauacacagguuugcgaccacagacuuaugagcgcggccaucaaggauucuaaagcugugcacgccgacaugggcuacuggauugaauccgagaagaaugaaaccuggaaacucgcccgcgcuagcuucaucgaggugaagacauguaucuggcccaagucucauacccugugguccaacgggguccuggaaagcgagaugauuaucccgaaaauuuauggaggcccuaucucucaacacaauuaccggcccggguacuucacgcagaccgccggaccuuggcaucucggcaagcuggagcuugauuuugaccugugcgaagggacaaccgugguuguggaugagcacugcggaaacagaggccccagccuccggacaaccacggucacaggcaaaauuauccacgaaugguguugccgcuccuguacccugccuccccugagauuccggggggaggacggaugcugguauggcauggagaucagaccggugaaggaaaaagaggaaaaucuuguuaagagcauggugucugcgggguccggagaggucgacagcuuuucccucggccugcuguguauuucuaucaugauugaagaggugaugcgcagccggugguccagaaagaugcucaugacagggacccuggcuguuuucuuucuucugaucaugggacagcucaccuggaacgaucugauucgccugugcaucauggugggcgccaaugccucugacagaaugggcauggggacaacguaccuugcucugauggccaccuucaaaaugcggccuauguuugcggucggacuccuguuccgcagacucacaagccgggaggugcugcuucugaccauuggccucucccugguggcuucugucgaacugcccaacagccuugaggaacugggggauggacucgccaugggcaucaugauccugaagcuccugacagacuuucaaucccaucagcuuugggccacccugcucagccugacguucauuaaaacaaccuuuucucugcacugugcuuggaagaccauggccaugguucuuuccaucgugagccuguucccccucugccugucuacaaccucccagaaaacaacguggcucccugugcugcuugggagccugggauguaagccgcugaccauguuucucauugcugagaauaagaucuggggccgcagaucuuggccccugaacgaaggcauuauggccgucgggaucguguccauccuucugagcucccuccugaaaaacgauguuccucucgcgggaccccugauugccggcgggaugcuuaucgcuugcuaugugauuagcggaucuagcgccgaccugucccuggagaaggcugccgaggucucuugggaagaggaagccgagcauagcggcgcuucccacaauauccucguggaaguucaggaugacgggacaaugaaaauuaaggaugaggagcgggacgauacccugacaauccuucugaaagcgacccuccuggccgugucuggagucuacccucucagcauccccgcuacgcuguucgugugguauuucuggcaaaagaaaaagcagcgcuccggcguccuuugggacaccccuucucccccggaaguggagagagccguucuggaugacggcauuuaccggaucaugcagcgcgggcugcucggaagaagccaggugggcgucgggguguuucaagaaaacguuuuccauacaauguggcacgugacccggggagccguccugauguaucagggcaagagacuugagccuuccugggcuagcgugaaaaaggaccugauuucuuacgggggaggcuggcgccuccagggcuccuggaauacaggggaggaagugcagguuaucgccgucgagcccggaaaaaacccuaagaaugugcaaaccgcgcccggcacauuuaaaacgccggaaggggaggugggagcuauugcccuggauuucaagccuggcaccagcgggucucccaucgucaaccgggaaggaaagauugugggccucuacggcaaugggguugugacaaccuccggaaccuaugucagcgccaucgcucaggccaaagcgucccaggagggcccucugcccgagaucgaagacgagguguuuagaaagcgcaaccuuacaauuauggaucugcaccccgggucuggaaaaacgcggagauaccugccugcuaucguucgcgaagccauuaagcggaaacucagaacccugauccuugccccgacacgcguggucgcuagcgagauggccgaagcucugaagggcaugcccauucgguaucaaaccacagccgugaaguccgagcauaccgggaaagagaucguugaccucaugugucacgcgacguucacaaugagacugcugagcccugugcggguccccaauuacaacaugaucauuauggaugaagcccauuuuaccgacccuucuuccaucgcugcccgcggcuauauuagcaccagagugggaaugggcgaggcugccgccaucuucaugacagcuacccccccugggucuguggaagcguuuccgcagagcaaugccgucauucaggaugaggaacgggacauccccgagcgcuccuggaacucuggauacgaguggaucacagauuucccuggcaagaccguuugguuugugcccagcauuaaauccgggaaugacaucgcuaacugccucagaaagaauggaaaacgggugauucagcuuucuagaaagacguucgauacagaauaucaaaagaccaaaaacaacgacugggacuacgucgugacaaccgauaucagcgagaugggcgccaauuuccgcgccgaccggguuauugauccuagacgcugccugaagcccgugauccugaaagacgggccggaacgggucauucucgcuggcccuaugcccgugacgguugccuccgcggcucagagacgcggacggaucggcagaaaccacaauaaggagggggaucaguacaucuauaugggacagccccugaacaaugacgaggaucaugcccacuggaccgaagccaaaaugcuucuggacaacauuaauacaccugagggcaucauucccgcucucuuugaaccugagcgcgaaaagagcgccgcgaucgauggggaguacagacugcggggagaggcccgcaagaccuucguggaacugaugagacggggcgaccucccggucuggcuuucuuauaaaguggcuuccgagggguuucaauacagcgaucgcagaugguguuucgacggcgaacggaacaaucagguccuggaggaaaacauggauguggagauuuggacaaaggagggagaaagaaaaaagcugcgcccccgguggcucgacgccagaaccuauuccgacccucuggcucuucgcgaguuuaaagaauucgccgcuggccggagaucuguuagcggggaucugauccucgagaucggaaagcugccccagcaccugacacagcgggcccaaaaugcgcucgacaaccuugugaugcugcauaauuccgaacagggcgggcgcgccuacagacacgcuauggaggagcugccugauaccauugaaacgcucaugcugcuugcccugaucgcugugcucacaggaggcgucacccuguuuuuccugucuggccgggggcucggaaaaaccagcauuggccuucugugcguuauggccuccagcgugcugcucuggauggccucuguggagccccauuggaucgcugcguccauuauccuggaauuuuuccuuaugguccugcucaucccggagccugacaagcagcgcacaccccaggauaaccaacuggccuaugugguuauugggcugcucuuuaugauccuuaccguggcugccaaugagaugggacugcuggaaacaacgaagaaagaccucggcauugggcacgucgccguggagaaccaccaucacgcugccaugcuggaugucgaccuucauccugcgagcgccuggacccuguacgcuguggccacaaccaucauuacacccaugaugagacacaccaucgaaaacacgaccgcuaauauuucucucacagccaucgcgaaccaggccgcuauccugaugggacuggauaagggcuggccuauuuccaaaauggacaucggcguuccccuccuugcccugggguguuacagccaggugaauccgcugacccucacagcugccguccugaugcuuguggcucauuaugccauuaucggaccuggccugcaagcgaaggccacccgggaggcucagaaacgcacggccgcugggauuaugaagaaccccacaguugauggaaucguggccaucgaccucgaucccgucguguacgacgccaaguucgaaaaacagcugggccagauuaugcugcucauccuuugcaccucucaaauucugcugaugagaacaaccugggcgcucugugagagcaucacccuggcuacagggccucuuacgacccugugggagggauccccgggcaaguuuuggaauacaaccauugccgugucuauggcuaacaucuuccggggcagcuaucucgccggggccggacuggcuuucucccugaugaaaagccucggcgggggacgcagaggcacaggggcccagggagaaacccuuggcgagaaguggaaacggcagcugaaucagcuguccaagucugaauuuaacacguacaagagaagcggcaucauggagguugaccgcuccgaagcgaaagaggggcucaagcggggagagacaaccaaacacgccgucucuagaggcaccgcuaagcugcgcugguucguggaacggaaucuugugaaacccgaggggaaggucauugaucugggaugcggcagagggggauggagcuauuacugugccggccucaagaaaguuacagaagugaagggcuauaccaaagggggaccuggccacgaggaacccaucccuauggcuacauacggguggaaccuggugaagcugcauuccggaaaagacgucuuuuucauucccccugagaagugcgauacgcuccuuugugacaucggcgagucuagcccgaaucccaccauugaagaggggcgcacacugcgggugcugaaaaugguugaaccuuggcucagaggaaaccaauuuugcaucaagauucugaaucccuacaugccuuccguggucgagacccuugagcagaugcagcgcaagcacggcggcaugcuggugcggaacccccucagcagaaauucuacacaugaaauguauuggguuuccugugggaccggaaacaucgugagcgccgucaauaugacgucucgcaugcugcugaaccgguucaccauggcgcacagaaaaccgacauacgagcgcgauguggaccucggcgccgggaccagacacguggcugucgaaccugagguugccaaccuggauaucauuggacagcggaucgaaaauauuaagcaugagcacaaauccacauggcauuaugacgaggauaaccccuacaagaccugggcuuaucacggcagcuacgaagugaaacccucuggguccgccagcuccauggugaauggagucgugaagcuucugacaaagccuugggacguuauccccauggugacccaaauugcuaugacggauacaaccccuuuuggccagcagcgcgucuucaaagagaagguggacaccagaacaccgaaagccaagcggggcacggcgcaaaucauggaaguuaccgccaaauggcucuggggguuucugagcagaaacaagaagccccggaucugcacacgcgaggaauucaccagaaaagugcggucuaaugcugccauuggagcugucuuuguggacgagaaccaguggaauagcgccaaggaggccguugaagaugagcgcuucugggaccuugugcauagagaacgggagcugcacaaacagggcaagugcgcgacaugugucuauaacaugauggggaaacgcgaaaagaagcucggagaguuuggcaaagcuaagggguccagagccaucugguacauguggcugggcgcccgguuccuggaguucgaagcucucggauuuaugaaugaggaucacugguucucucgcgaaaacagccuguccggcguggagggggagggacuucauaaacugggcuacauucucagagacaucucuaagauuccugggggaaauauguaugccgaugacaccgcuggcugggauacacggaucaccgaagacgaucugcagaacgaggcccgcaucacggacauuauggaacccgagcacgcgcuucuggccaaaagcaucuuuaagcucaccuaccaaaauaaagucgugagaguucagcggccugcuaagaacgggacagugauggaugucauuucccgcagagaccagcggggcucuggacaggugggcaccuaugggcugaauacauucaccaacauggaagcccaacugaucagacagauggagagcgagggaauuuuuucccccagcgaacucgagacgccgaaccuggcugaacgcgugcuugauuggcuggagaaguacggcguugaacggcucaaaagaauggccaucucuggggacgacugcguggucaagccuaucgaugaccgcuucgcgacagcccugaccgcucuuaaugauaugggaaaagugcggaaggacauuccccagugggagccuuccaaaggcuggaacgauuggcagcaaguucccuuuuguagccaucacuuccaccagcugaucaugaaggacgggagagagauuguggucccuugccgcaaucaggaugaacucgugggccgggccagagucucucagggagcuggcuggucccugcgcgagacagccugucuggggaagagcuaugcucaaauguggcagcucauguacuuucaucggagagaccugcgccuugccgcgaacgccaucugcuccgcugugcccguugauuggauuccgaccucucggacgaccuggagcauccacgcccaucaccaguggaugacaaccgaagacaugcuguccguguggaauagagucuggauugaggaaaacccuuggauggaggauaaaacacauaucagcucuuggggagacgugcccuaucucggcaagcgggaggaccaauggugugggucccugaucggacuuaccgccagagcuacaugggccaccaauauucagguugcgaucaaccaggugcgccggcugauuggcaaugaaaacuaccucgauuacaugacgagcaugaaaagauucaagaaugagucugaccccgaaggggcucugugguga

SEQ ID NO: 19230 - RNA, 9879 nt, Artificial Sequence
  derived and/or modified CDS sequence (opt5) from DENV-1__GU131794__SS-prME
agcgugacaaugcugcugaugcugaugcccacagcccuugcuuuccaccugacgacccggggaggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucaucagaacaaccuuuucccugcacuaugccuggaaaacgauggcuaugguucuuagcauugugucucuguucccccucugucuguccacaaccagccagaagaccacauggcucccugugcugcuugggucucugggaugcaagccgcugaccauguuucucaucgccgagaauaaaauuuggggccggaaguccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgucgugagcugggaggaagaggcugaacauuccggcgcgucucacaauauucucguugaggugcaggaugacgggacaaugaaaaucaaggaugaagaaagagacgauacgcugaccauccuucugaaagccacacuccuggcugucagcggaguguauccucucuccauucccgccacccuguucgucugguacuucuggcaaaagaagaaacagagaucuggcgugcuuugggacacaccuuccccucccgagguugaacgggccgugcuggaugacggcaucuaucgcauuaugcagagagggcugcucggacggucccaggucggcguggggguuuuucaagagaacguguuccauaccauguggcacgucacgcgcggagcugugcugauguaccagggcaagagacuugaacccagcugggccucugugaaaaaggaccugaucuccuacgggggaggcuggcggcuccagggcagcuggaauaccggggaggagguucaggucauugcgguggaacccggcaagaauccuaagaaugugcaaacagcucccggcaccuuuaagacaucugagggggaagucggagccaucgcccuggauuucaaaccgggcaccuccgggagcccuauugugaacagagagggaaagaucguuggccucuauggcaaugggguggucacaacguccggaaccuacgugucugcuaucgcccaggcgaaagcuagccaggaaggcccccugccugagauugaggacgaaguuuuucgcaagcggaaccuuacaaucauggaucugcaccccggguccggaaaaaccagacgcuaucugcccgccauugugcgggaggccaucaagagaaagcuccgcacccugauucuugcuccuacacgggucguggccagcgaaauggcugaggcccugaaaggcaugccgaucagauaccaaacgaccgcgguuaagucugaacauacagggaaagagaucguggaccucaugugccacgccaccuucacaaugcgccugcugucccccguccgggugccuaauuauaacaugauuaucauggaugaggcucauuuuaccgaccccagcucuauugccgcuagaggcuacaucagcacgcgggugggaaugggcgaagccgccgcuauuuucaugacagcgaccccucccggguccgucgaggccuuuccucagucuaaugcuguuauccaggaugaggaacgcgacaucccggaaagaagcuggaacuccggauaugaguggauuaccgauuuccccggcaagacagugugguuugugccuucuaucaaaagcgggaaugacauugccaacugucuccggaagaauggaaagcgcgucauccagcuuuccagaaaaaccuucgauacagaguaccaaaagaccaaaaacaacgacugggacuacgugguuacgacagauauuagcgaaaugggcgccaauuuccgggcugacagagugaucgauccccgccggugccugaagccugucauucugaaagacgggcccgagagagugauccucgccggcccgaugccuguuaccguggcgucugcugcccagcgccggggaagaaucggccgcaaccacaauaaggaaggggaucaguauauuuacaugggacagccccugaacaaugacgaggaucaugcccacuggacagaggcuaagaugcuucuggacaacaucaauacccccgaaggcauuaucccugcccucuuugagcccgaacgggagaaauccgcggccauugauggggaauauagacugcgcggagaggcuagaaagacguucgucgagcugaugcggcgcggcgaccucccuguguggcuuagcuacaaagucgccuccgaaggguuucaauauucugauagacgguggugcuucgacggcgagcgcaacaaucaggugcuggaagagaacauggauguugaaaucuggaccaaggagggagagcgcaagaagcugcggccgagauggcucgacgcucgcacauacagcgacccccuggcccuucgggaauuuaaagaguucgcugccggcagacgcuccaucucuggggaucugauucucgaaaucggaaagcugccucagcaccugacccagcgggcgcaaaaugcccucgacaaccuugugaugcugcauaauagcgagcagggcgggagagcuuaucggcacgccauggaggaacugcccgauacaauugagacccucaugcugcuugcucugaucgccgugcucacaggaggcgucacccuguuuuuccuguccggccgcgggcucggaaagacgagcauuggccuucuguguguuauggccucuuccgugcugcucuggauggcuagcguggaaccucauuggaucgcggccucuaucauucuggaguuuuuccuuaugguccugcucauccccgaaccggacagacagcggacaccucaggauaaccaacuggcuuacgugguuauugggcugcucuuuaugauccuuaccguggccgccaaugagaugggacugcuggagaccaccaagaaggaccucggcauugggcacgucgcuguggaaaaccaccaucacgccgcgaugcuggaugucgaccuucaucccgccuccgcuuggacccuguacgccguggcuacaacgaucauuaccccuaugaugcgccacacaaucgagaacaccacagccaauaucagccucaccgcgauugccaaccaggcugccauccugaugggacuggauaaaggcuggcccauuucuaagauggacaucggcguuccucuccuugcucuggggugcuauagccaggugaauccccugacgcucaccgccgcuguccugaugcuuguggcccauuacgcgauuaucggaccgggccugcaagccaaagcuacaagagaagcccagaagcggaccgcugccgggaucaugaagaacccuacaguugauggaauuguggccaucgaccucgaucccgucguguaugacgcgaaauucgagaagcagcugggccagauuaugcugcucauccuuuguaccucccaaauucugcugaugcgcacgacaugggcucucugcgaaucuaucacccuggccacagggccccuuaccacccugugggagggaagcccuggcaaauuuuggaauacaacgaucgcuguguccauggccaacauuuucagaggcagcuaccucgccggggcuggacuggccuucucccugaugaagucucucggcgggggacggcgcggcaccggggcgcagggagagacacuuggcgaaaaauggaagagacagcugaaucagcugagcaaguccgaguuuaacaccuauaaacggucuggcaucauggaaguugacagaagcgaggccaaggaagggcucaaacgcggagagacaaccaagcacgcugucucccggggcacggccaaacugagaugguucguggagcgcaaucuugugaagccggaagggaaggucauugaucugggauguggcagagggggauggucuuacuauugcgcuggccucaaaaagguuacagaggugaaaggcuacaccaaagggggacccggccacgaggagccuauccccauggccaccuacggguggaaccuggugaaacugcauagcggaaaggacgucuuuuucauuccucccgaaaaaugugauacacuccuuugcgacaucggcgaguccagcccuaauccgaccauugaggaagggagaacacugcgcgugcugaagaugguugagcccuggcuccggggaaaccaauuuuguaucaagauccugaauccuuauaugcccucuguggucgaaacgcuugagcagaugcagagaaaacacggcggcaugcuggugcgcaacccucucucccggaauagcacccaugagauguacuggguuucuugcgggacaggaaacauuguguccgcggucaauaugaccagcagaaugcugcugaaccgcuucacaauggcccaccggaagcccaccuaugaaagagauguggaccucggcgcugggacgcgccacguggccgucgagccggaaguugcuaaccuggauaucauuggacagagaaucgagaauauuaaacaugaacacaagucuaccuggcauuacgacgaggauaacccuuauaaaacaugggccuaccacggcuccuaugaggugaagcccagcggguccgcuagcucuauggugaauggagucgugaaacuucugaccaaacccugggacguuaucccuauggugacacaaaucgccaugaccgauacaacccccuuuggccagcagcgggucuucaaggaaaaaguggacacgcgcacaccuaaggcgaaaagaggcaccgcccaaauuauggagguuaccgcuaaguggcucuggggguuucugagccggaacaagaaaccgagaaucuguacacgggaagaguucacgcgcaaggugagauccaaugccgcuauuggagccgucuuuguggacgaaaaccaguggaacucugccaaagaggcgguugaggaugaacgguucugggaccuugugcaucgcgagagagaacugcacaagcagggcaaaugcgcuaccugcgucuacaacaugauggggaagcgggagaagaaacucggagaauuuggcaaggccaaagggagccgcgccaucugguacauguggcugggcgcuagauuccuggaguucgaggcccucggauuuaugaaugaagaucacugguucucccgggagaacucucugagcggcguggaaggggagggacuucauaagcugggcuauauucuccgcgacaucuccaaaauccccgggggaaauauguacgcugaugacacagccggcugggauaccagaauuacagaggacgaucugcagaacgaagcgaagaucaccgacauuauggagccugaacacgcccuucuggcuaaaucuaucuuuaagcucacauaucaaaauaaggucgugcggguucagcgccccgccaaaaacgggaccgugauggaugucauuagcagacgggaccagcgcggcuccggacaggugggcacguacgggcugaauaccuucacaaacauggaggcucaacugaucagacagauggaaagcgagggaaucuuuucuccuuccgagcucgaaacccccaaccuggccggccgggugcuugauuggcuggagaagcaugggguugaaagacucaaacgcauggcgauuagcggagacgacuguguggucaagccgaucgaugaccgguucgccacagcucugaccgcccuuaaugauaugggcaaagugagaaaggacauuccucagugggagcccucuaagggguggaacgauuggcagcaaguuccuuuuugcucccaccacuuccaucagcugaucaugaaagacggccgcgaaauugugguccccugucggaaucaggaugagcucgugggcagagcucgcgucagccagggagccggguggucccugcgggagacggcuugccugggaaagucuuaugcccaaauguggcagcucauguacuuucacagacgcgaccugcggcuugcggccaacgcuaucuguagcgccgugccuguugauugggugcccacauccagaaccacauggagcauucaugcccaccaucaguggaugaccacggaagacaugcugucugucuggaaucgcguguggaucgaggaaaacccguggauggaggauaaaacccacaucuccagcuggggcgacguuccuuaucucgggaagcgggaagaccaauggugcggaucucugauuggccuuacagcuagagccaccugggcgacaaauauccagguggcuauuaaccagguccggagacugcucgggaaugagaacuaccuggauuacaugaccagcaugaaacgcuucaagaaugaguccgaccccgaaggcgcccugugguga

SEQ ID NO: 19231 - RNA, 9879 nt, Artificial Sequence
  derived and/or modified CDS sequence (opt5) from DENV-1__GU131796__SS-prME
agcgugaccaugcugcucaugcugaugcccacggcucuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcguggaagcgaagauuuccaacaccacgacagacagcagauguccgacccaaggagaggccacccuuguggaagaacaagaugcuaauuuugucugccggcgcacauucguggacagaggcuggggcaacggguguggacuguuuggcaaagggucucucaugaccugcgccaaguucaagugcguuacaaaacuggagggaaagaucgugcaguacgaaaaucuuaaauauuccgucauugugacgguucacaccggcgaccagcaucaaguggggaacgagagcacagaacacggaaccacagcuaccaucacgccccaggccccuucuaccgagauccagcugacagauuacggcgcccucacccuggacuguagcccccggacaggccuggauuuuaaugaaaugguccuccugaccaugaaggagaaaagcuggcuugugcauaagcagugguuccuggaccucccucugcccuggacguccggggcuucuacaagccaagagaccuggaaccgcaaagaucuucuggucacauuuaagaccgcgcacgccaagaaacaggaagugguugugcucggaucccaggagggcgcuaugcacaccgcccugacaggggccacggaaauucaaaccagcggaacaaccacaaucuucgcuggccaucugaagugcagacucaaaauggacaagcugacccuuaaagggaugucuuaugucauguguacgggcuccuucaagcuggagaaggaaguggccgagacacagcacggaaccguucucgugcagauuaaauacgagggcaccgaugcgccgugcaagaucccuuuuagcacacaggacgaaaaaggggucacccaaaauggacggcugauuacagcuaaccccaucgugacggauaaggagaaaccugugaauaucgaagccgagccgcccuucggcgagucuuauauuguuaucggggccggagaaaaggcucugaaacuuagcugguuuaaaaagggcuccucuauugggaaaauguucgaggccaccgcuagaggcgcccgccggauggcgauccucggagacacagccugggauuuuggcagcauugggggagucuucaccuccgugggcaagcuggugcaucagaucuuugggacagcuuacggaguccuguucagcggcgugucuuggaccaugaaaaucgggauuggcguucuccugacguggcuuggacugaacuccagaagcaccucucucuccaugacauguaucgccgugggccuggucacccuguaccuuggggugaugguucaggcugacagcggaugcgugauuaauuggaagggccgcgaacucaaguguggguccggaaucuuugucacaaacgaggugcacaccuggacagaacaguauaaauuccaagccgacucuccuaagcggcugagcgcggccauuggcaaggcuugggaggaggggguuugcggcaucagauccgccacccgccuggaaaauauuauguggaagcagaucucuaacgagcucaaccauauccugcuugaaaaugauaugaaacugacgguggucgugggagacguggcuggcauucucgcccaggggaagaaaaugauccggccgcagcccauggaguacaaguauagcuggaaguccuggggaaaagccaagauuaucggcgcugauguccaaaacacaaccuuuauuaucgacgggccuaauacccccgaauguccugaugaccagagagcguggaacaucugggagguugaggauuacggauucggcauuuuuacaaccaauaucuggcugaaacugcgcgacagcuauacacaggugugcgaucaccggcuuaugucugccgcuauuaaggacuccaaagccgugcacgccgauaugggcuacuggaucgaaagcgagaagaacgaaacauggaagcucgcuagagccucuuucauugaggucaaaaccuguaucuggcccaagucccauacacuguggagcaauggggugcuggaaucugagaugaucauuccgaaaaucuauggaggcccuauuagccagcacaacuaccgccccggguacuucacccaaacagcgggaccuuggcaucucggcaagcuggagcuugacuuugaucugugcgaagggaccacgguuguggucgacgagcacugcggaaaucggggccccucccucagaaccacaaccgugacaggcaaaaucauucacgaaugguguugccggagcuguacccugccuccccugcgcuucaagggggaggacggaugcugguauggcauggagaucagaccgguuaaggaaaaagaggaaaaccuugugaagucuauggucuccgcugggagcggagagguggauuccuuuucucucggccugcuguguaucagcauuaugaucgaagagguuaugcgguccagauggucucgcaaaaugcucaugacggggacacuggccguguucuuucuucugauuaugggacagcucaccuggaaugaccugauccggcugugcauuauggucggcgccaacgcuagcgauagaaugggcauggggacaaccuaccuugcccugauggcgaccuucaagaugcgcccuauguuugcugugggacuccuguucagacggcucacaucccgcgaggugcugcuucugacgaucggccucucucuggucgccagcguugaacugcccaauucccuugaggaacugggggacggacucgccaugggcauuaugauccugaaacuccugaccgauuuucagagccaucaacuuugggcuacacugcucucucugaccuucaucaagacaaccuccagccugcacuaugccuggaagacgauggcuauggugcuuucuauugugucccuguuuccccucugucugagcacaaccucucagaaaaccacauggcucccuguccugcuugggucccugggaugcaagccgcugaccauguuccucaucgccgagaacaaaauuuggggcagaaagagcuggccccugaaugaaggcaucauggcgguggggauuguuuccauccuucugagcgcccuccugaaaaacgacgugccucucgcuggaccccugaucgccggcgggaugcuuauugcuuguuacgucaucucuggaagcuccgccgaucugucucuggagaaggccgcugaggugagcugggaagaggaagcggagcauuccggcgccucucacaacauucucguugaagugcaggacgaugggacaaugaaaaucaaggacgaggagcgggaugacacgcugaccauucuucugaaggcuacacuccuggccgucagcggaguguauccucucuccauccccgccacccuguuugucugguacuucuggcagaaaaagaaacaacgcucuggcgugcuuugggauacaccuuccccucccgaaguugagagagcugugcuggacgacggcaucuaucggauuaugcagcgcgggcugcucggaagaucccaggucggcguggggguuuuccaggaaaauguguuucauaccauguggcacgucacgcggggagccgugcugauguaccaaggcaagcgccuugagcccagcugggcgucugugaaaaaggaucugaucuccuacgggggaggcuggagacuccagggcagcuggaacaccggggaggaaguucaggucauugcuguggagcccggaaagaauccuaaaaacgugcagacagcccccggcaccuucaagacaucugaaggggaggucggagccaucgcucuggacuuuaaaccgggcaccuccgggagcccuauugugaaucgggaaggaaagaucguuggccucuauggcaacgggguggucacaacguccggaaccuacgugucugccauugcgcaagcuaaagccagccaggagggcccccugccugagaucgaagaugagguuuucagaaagcgcaaucuuacaaucauggaccugcaccccggguccggaaagacccggagauaucugcccgccauugugcgcgaagcuaucaaacggaagcucagaacccugauucuugccccuacacgcgucguggcuagcgagauggccgaagcgcugaaaggcaugccgauccgguaccagacgaccgccguuaagucugagcauacagggaaagagauuguggaucucaugugccacgcuaccuuuacaaugagacugcugucccccguccgcgugccuaacuauaauaugaucaucauggacgaagcccauuucaccgaucccagcucuauugcugcccggggcuacaucagcacgagagugggaaugggcgaggccgcugcgauuuuuaugacagccaccccucccggguccgucgaggcuuucccucaaucuaacgccguuauccaggacgaagaacgggauauuccggagcgcagcuggaacuccggauaugaguggaucaccgacuuucccggcaagacagugugguucgugccuucuaucaagagcgggaacgauauugccaauugucuccgcaagaauggaaagcgggucauccagcuuucccgcaaaaccuuugacacagaauaccagaagaccaaaaauaacgacugggauuacgugguuacgacagacauuagcgagaugggcgcuaacuucagagccgaucgggugaucgaccccagacgcugccugaagccugucauucugaaggaugggcccgaacgggugauccucgcgggcccgaugccuguuaccguggcuucugccgcccaaagacgcggacggauuggcagaaaucacaacaaagagggggaccaguauaucuacaugggacagccccugaauaacgaugaggaccaugcucacuggacagaagccaagaugcuucuggauaauaucaacacccccgagggcauuaucccugcccuguucgaacccgagcgcgaaaaauccgccgcuauugacggggaguaucggcugagaggagaggcccgcaagacguuugucgaacugaugagacggggcgaucucccuguguggcuuagcuacaaagucgcuuccgagggguuccaguauucugaccgcagauggugcuuugauggcgaacggaauaaccaagugcuggaggaaaauauggacguugagaucuggaccaaggagggagaacgcaaaaagcugagaccgcgguggcucgacgccagaacauacagcgauccccuggcucuuagagaguucaaggaauuugccgcgggccggagauccgugucuggggaccugauucucgagaucggaaaacugccucagcaccugacccagcgcgcccagaacgcucucgauaaucuugugaugcugcauaacagcgaacaaggcgggcgggccuauagacacgcuauggaggagcugcccgacacaaucgaaacccucaugcugcuugcccugauugccguccucacaggaggcguuacccuguucuuucuguccggccgggggcucggaaagacgagcaucggccuucugugugugauggcuucuuccgugcugcucuggauggcgagcgucgagccucauuggauugccgcuucuaucauucuggaguucuuucuuauggugcugcucauccccgagccggaucgccagagaacaccucaggacaaucagcuggccuacguugugaucgggcuccucuucaugauucuuaccgucgccgcuaacgagaugggacugcuggaaaccaccaagaaggaucucggcaucgggcacguggccgucgagaaucaccaucacgcggccaugcuggacguggaucuucaucccgcuuccgccuggacccuguacgcuguugccacaacgauuaucaccccuaugaugcggcacacaauugaaaacaccacagcgaacaucagccucaccgccauugcuaaucaagccgcuauccugaugggacuggacaaaggcuggcccaucucuaagauggauauuggcgugccucuccuugcccuggggugcuauagccaggucaacccccugacgcucaccgcugccgugcugaugcuuguugcgcauuacgccaucauuggaccgggccugcaggcuaaggccacacgcgaggcucagaaaagaaccgccgccgggaucaugaagaauccuacaguggacggaauugucgcgaucgaucucgaccccgugguguaugacgcuaaauuugaaaagcagcugggccagaucaugcugcucauucuuuguaccucccagauccugcugaugcggacgacaugggcccucugcgagucuauuacccuggcuacagggccccuuaccacccugugggagggaagcccuggcaaauucuggaacacaacgaucgccguuuccauggccaauauuuuucgcggcagcuaccucgcuggggccggacuggcguucucccugaugaagucucucggcgggggaagacggggcaccggggcccaaggagaaacacuuggcgagaaguggaaacgccagcugaaccagcugagcaaguccgaguucaauaccuauaaaagaucuggcaucauggaggucgaucggagcgaagcuaaggaggggcucaaaagaggagagacaaccaagcacgccgugucccgcggcacggcuaagcugcggugguuuguggaaagaaaccuugucaaaccggaggggaagguuaucgaccugggauguggccgcgggggauggucuuacuauugcgccggccucaaaaaggugacagaagugaaaggcuacaccaaagggggacccggccacgaggaaccuauucccauggcgaccuacggguggaaucuggucaaacugcauagcggaaaggauguguucuuuaucccucccgagaagugugacacacuccuuugcgauauuggcgaguccagcccuaacccgaccaucgaagaggggcggacacugagaguucugaaaaugguggaacccuggcuccgcggaaaucaguucuguauuaagauccugaacccuuauaugcccucugucguggagacgcuugagcaaaugcagcggaaacacggcggcaugcugguuagaaauccucucucccgcaacagcacccaugaaauguacugggugucuugcgggacaggaaauauugucuccgccgugaacaugaccagccggaugcugcugaauagauuuacaauggcucaccgcaagcccaccuaugagcgggacguggaucucggcgccgggacgagacacgucgcuguugaaccggagguggccaaccuggacaucaucggacagcgcauugaaaacaucaaacaugagcacaagucuaccuggcauuacgaugaggacaauccuuauaagacaugggcuuaccacggcuccuaugaagugaaacccagcggguccgccagcucuauggucaacggagugguuaaacuucugaccaaacccugggaugugauuccuauggucacacagaucgcgaugaccgacacaacccccuucggccaacagagaguguuuaaggagaaaguugacacgcggacaccuaaggccaagcgcggcaccgcucagauuauggaagugaccgccaaauggcucuggggguuccugagcagaaauaagaaaccgcggaucuguacaagagaggaauuuacgcggaagguccgcuccaacgcugccaucggagccguguucguugaugagaaucaauggaacucugcgaaagaggcuguggaagacgagagauuuugggaucuuguccaucgggaacgcgagcugcacaagcagggcaagugcgcgacaugcguguacaauaugauggggaaaagagaaaagaaacucggagaguucggcaaggccaaagggagccgggcuauuugguacauguggcugggcgcccgcuuucuggaguucgaagcucucggauucaugaacgaggaccacugguuuuccagagaaaauucucugagcggcgucgagggggagggacuucauaagcugggcuauauccuccgggauauuuccaaaauccccgggggaaacauguacgccgacgauacagcgggcugggacacccgcauuacagaagaugaccugcagaaugaggccaagaucaccgauaucauggaaccugagcacgcccuucuggccaagucuauuuucaaacucacauaucagaacaaggugguuagagugcaacggcccgcuaaaaaugggaccgucauggacgugaucagccgcagagaucagcggggcuccggacaggugggcacguacgggcugaacaccuuuacaaauauggaagcccagcugauucgccaaauggagagcgagggaaucuucucuccuuccgaacucgagacccccaaccuggcgggcagaguucuugacuggcuggaaaagcaugggguggagcggcucaaaagaauggccauuagcggagacgauugugucgugaagccgaucgacgaucgcuuugcugccgcucugacagcccuuaacgacaugggcaagguucggaaagauaucccucagugggaacccucuaagggguggaaugacuggcaacaggugccuuucugcucccaccacuuucaucaacugauuaugaaagauggcagagagaucgucgugcccugucgcaaccaggacgagcucgucggacgggcuagagugagccagggcgccggguggucccugcgcgaaaccgcgugccugggaaagucuuaugcccagauguggcaacucauguacuuccaccggagagaucugcgccuugcugccaaugccauuuguagcgcuguuccuguggacuggguccccacgucccggacaaccuggagcauccaugcccaccaucaguggaugacaaccgaggauaugcugucuguguggaacagaguuuggauugaagagaauccguggauggaagacaaaacgcacaucuccagcuggggcgacgugccuuaucucgggaagcgcgaggaucaguggugcggaucucugauuggccuuaccgcgcgggcuacaugggccaccaacauccaagucgccaucaaucaggugagacggcugauugggaacgagaauuaccucgacuacaugacaagcaugaagagauuuaaaaacgaauccgaucccgagggcgcucugugguga

SEQ ID NO: 19232 - RNA, 9879 nt, Artificial Sequence
  derived and/or modified CDS sequence (opt5) from DENV-1__GU131797__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagagcaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccccccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauuccggggggaggacggaugcugguauggcauggagauuagaccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcaucaugauucugaagcuccugaccgacuuucaaucccaucagcuuugggccacacugcucagccugaccuucaucaaaacgacauuuucucugcacugugcuuggaagaccauggccaugguucuuuccauugugagccuguucccccucugccugucuaccacaucccagaaaaccacauggcucccugugcugcuugggagccugggauguaagccgcugacgauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuugcuaugugaucagcggaucuagcgccgaccugucccuggagaaggcugccgaggucucuugggaagaggaagccgagcauagcggcgcuucccacaauauucucguggaaguucaggaugacgggaccaugaaaaucaaggaugaggagcgggacgauacacugaccauccuucugaaagcgacacuccuggccgugucuggagucuacccucucagcauucccgcuacccuguucgugugguauuucuggcaaaagaaaaagcagcgcuccggcguccuuugggacacgccuucucccccggaaguggagagagccguucuggaugacggcaucuaccggauuaugcagcgcgggcugcucggaagaagccaggugggcgucgggguguuucaagaaaacguuuuccauaccauguggcacgugacacggggagccguccugauguaucagggcaagagacuugagccuuccugggcuagcgugaaaaaggaccugaucucuuacgggggaggcuggcgccuccagggcuccuggaauaccggggaggaagugcagguuauugccgucgagcccggaaaaaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuacggcaaugggguugugaccacauccggaaccuaugucagcgccaucgcucaggccaaagcgucccaggagggcccucugcccgagauugaagacgagguguuuagaaagcgcaaccuuaccaucauggaucugcaccccgggucuggaaaaacacggagauaccugccugcuauuguucgcgaagccaucaagcggaaacucagaacgcugauucuugccccgacccgcguggucgcuagcgagauggccgaagcucugaagggcaugcccauccgguaucaaacaaccgccgugaaguccgagcauacagggaaagagaucguugaccucaugugucacgcgaccuucacgaugagacugcugagcccugugcggguccccaauuacaacaugauuaucauggaugaagcccauuuuacagacccuucuuccauugcugcccgcggcuauaucagcaccagagugggaaugggcgaggcugccgccauuuucaugaccgcuacacccccugggucuguggaagcguuuccgcagagcaaugccgucauccaggaugaggaacgggacauccccgagcgcuccuggaacucuggauacgaguggauuaccgauuucccuggcaagacaguuugguuugugcccagcaucaaauccgggaaugacauugcuaacugccucagaaagaauggaaaacgggugauccagcuuucuagaaagaccuucgauacggaauaucaaaagacaaaaaacaacgacugggacuacgucgugaccacagauauuagcgagaugggcgccaauuuccgcgccgaccggguuaucgauccuagacgcugccugaagcccgugauucugaaagacgggccggaacgggucauccucgcuggcccuaugcccgugaccguugccuccgcggcucagagacgcggacggaucggcagaaaccacaauaaggagggggaucaguacauuuauaugggacagccccugaacaaugacgaggaucaugcccacuggacggaagccaaaaugcuucuggacaacaucaauaccccugagggcauuauccccgcucucuuugaaccugagcgcgaaaagagcgccgcgauugauggggaguacagacugcggggagaggcccgcaagacauucguggaacugaugagacggggcgaccucccggucuggcuuucuuauaaaguggcuuccgagggguuucaauacagcgaucgcagaugguguuucgacggcgaacggaacaaucagguccuggaggaaaacauggauguggagaucuggaccaaggagggagaaagaaaaaagcugcgcccccgguggcucgacgccagaacauauuccgacccucuggcucuucgcgaguuuaaagaauucgccgcuggccggagaucuguuagcggggaucugauccucgagauuggaaagcugccccagcaccugacccagcgggcccaaaaugcgcucgacaaccuugugaugcugcauaauuccgaacagggcgggcgcgccuacagacacgcuauggaggagcugccugauacaaucgaaacccucaugcugcuugcccugauugcugugcucacgggaggcgucacacuguuuuuccugucuggccgggggcucggaaaaaccagcaucggccuucugugcguuauggccuccagcgugcugcucuggauggccucuguggagccccauuggauugcugcguccaucauccuggaauuuuuccuuaugguccugcucauuccggagccugacaagcagcgcaccccccaggauaaccaacuggccuaugugguuaucgggcugcucuuuaugauucuuacaguggcugccaaugagaugggacugcuggaaaccacaaagaaagaccucggcaucgggcacgucgccguggagaaccaccaucacgcugccaugcuggaugucgaccuucauccugcgagcgccuggacgcuguacgcuguggccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcguuccccuccuugcccugggguguuacagccaggugaauccgcugacacucaccgcugccguccugaugcuuguggcucauuaugccaucauuggaccuggccugcaagcgaaggccacacgggaggcucagaaacgcaccgccgcugggaucaugaagaaccccacgguugauggaaucguggccauugaccucgaucccgucguguacgacgccaaguucgaaaaacagcugggccagaucaugcugcucauucuuugcacaucucaaauccugcugaugagaaccacaugggcgcucugugagagcauuacccuggcuaccgggccucuuacaacgcugugggagggauccccgggcaaguuuuggaauaccacaaucgccgugucuauggcuaacaucuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggaugcggcagagggggauggagcuauuacugugccggccucaagaaaguuaccgaagugaagggcuauacaaaagggggaccuggccacgaggaacccauuccuauggcuaccuacggguggaaccuggugaagcugcauuccggaaaagacgucuuuuucauccccccugagaagugcgauacacuccuuugugacauuggcgagucuagcccgaaucccacgaucgaagaggggcgcacccugcgggugcugaaaaugguugaaccuuggcucagaggaaaccaauuuugcauuaagauccugaaucccuacaugccuuccguggucgagacacuugagcagaugcagcgcaagcacggcggcaugcuggugcggaacccccucagcagaaauucuacccaugaaauguauuggguuuccugugggacaggaaacaucgugagcgccgucaauaugaccucucgcaugcugcugaaccgguucacgauggcgcacagaaaaccgaccuacgagcgcgauguggaccucggcgccgggacaagacacguggcugucgaaccugagguugccaaccuggauauuaucggacagcggauugaaaauaucaagcaugagcacaaauccaccuggcauuaugacgaggauaaccccuacaagacaugggcuuaucacggcagcuacgaagugaaacccucuggguccgccagcuccauggugaauggagucgugaagcuucugaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcucuggggguuucugagcagaaacaagaagccccggauuugcacccgcgaggaauucacaagaaaagugcggucuaaugcugccaucggagcugucuuuguggacgagaaccaguggaauagcgccaaggaggccguugaagaugagcgcuucugggaccuugugcauagagaacgggagcugcacaaacagggcaagugcgcgaccugugucuauaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcguggagggggagggacuucauaaacugggcuacauccucagagacauuucuaagaucccugggggaaauauguaugccgaugacacagcuggcugggauacccggaucacagaagacgaucugcagaacgaggcccgcauuaccgacaucauggaacccgagcacgcgcuucuggccaaaagcauuuuuaagcucacguaccaaaauaaagucgugagaguucagcggccugcuaagaacgggaccgugauggaugucaucucccgcagagaccagcggggcucuggacaggugggcacauaugggcugaauaccuucacaaacauggaagcccaacugauuagacagauggagagcgagggaaucuuuucccccagcgaacucgagaccccgaaccuggcugaacgcgugcuugauuggcuggagaaguacggcguugaacggcucaaaagaauggccaucucuggggacgacugcguggucaagccuauugaugaccgcuucgcgacggcccugacagcucuuaaugauaugggaaaagugcggaaggacaucccccagugggagccuuccaaaggcuggaacgauuggcagcaaguucccuuuuguagccaucacuuccaccagcugauuaugaaggacgggagagagaucguggucccuugccgcaaucaggaugaacucgugggccgggccagagucucucagggagcuggcuggucccugcgcgagaccgccugucuggggaagagcuaugcucaaauguggcagcucauguacuuucaucggagagaccugcgccuugccgcgaacgccauuugcuccgcugugcccguugauuggaucccgacaucucggaccacguggagcauucacgcccaucaccaguggaugaccacagaagacaugcuguccguguggaauagagucuggaucgaggaaaacccuuggauggaggauaaaacccauaucagcucuuggggagacgugcccuaucucggcaagcgggaggaccaauggugugggucccugauuggacuuacagccagagcuaccugggccacaaauauccagguugcgauuaaccaggugcgccggcugaucggcaaugaaaacuaccucgauuacaugaccagcaugaaaagauucaagaaugagucugaccccgaaggggcucugugguga

SEQ ID NO: 19233 - RNA, 9879 nt, Artificial Sequence
  derived and/or modified CDS sequence (opt5) from DENV-1__GU131801__SS-prME
agcgugaccaugcugcucaugcugaugcccacggcccuugcuuuccaccugacgaccagaggaggggagccucauaugaucguguccaagcaggaacggggaaaaucucuccuguuuaagaccagcgccggaguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccagggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgggauuggagccggcgagaaagcucucaagcugucuugggugaagaaagggagcuccaucggcaagaugguugaagccacagcuagaggagcccgccggauggcgauucugggcgacaccgccugggauuucgggucuaucggaggcgucuuuacaagcguggggaaacucgugcaucagaucuucggaaccgcuuacggcguccuguuuuccggggugagcuggacgaugaagauuggcaucggaguucuucugaccuggcucggccucaauucuagauccacaagccugucuaugaccuguauugccguggggcuugucacacucuaccugggagugaugguucaggcugacuccggcugcgugaucaacuggaaagggcgcgagcugaaguguggaagcggcauuuucgucaccaaugaagugcacacauggaccgagcaauauaaguuucaggccgauuccccuaaacggcucucugcggccaucgggaaggcuugggaggaaggcguuugcggaauuagaagcgccacgcgccuggagaacaucauguggaaacagaucuccaacgaacuuaaucauauucugcucgagaacgacaugaaguucacaguggucgugggcgacguggcugggauccugguccagggcaagaagaugauucggccgcaacccauggaauacaaauauucuuggaaaagcuggggcaaggccaaaaucauuggggccgauguucaaaauuccaccuuuaucaucgacggaccuaacacccccgaguguccugaugaccagagagcuuggaauauuugggagguggaagauuacggcuucggcaucuuuacaaccaacauuuggcugaaacuucgcgacagcuauacacaggugugcgaucaccggcucaugucugcggccaucaaagacuccaaggcuguccacgccgauaugggguacuggauugagagcgagaagaaugagacauggaagcuggccagagcuucuuucaucgaagugaagaccuguaucuggcccaaaucccauacacuguggagcaacggaguucucgagucugagaugauuaucccgaagauucacggcgggccuaucagccaacauaauuaucgccccggauacuuuacccagacagccggcccuuggcaccuggggaaacuugaacuggacuucgaucucugcgagggaaccacgguggucguggacgaacacugcggcaaccggggccccucccugagaaccacaaccguuacagggaagauuauccaugagugguguugccggagcuguacccugccuccccuucgcuucagaggagaggauggcugcugguacgggauggaaauccggccggugaaagagaaggaagagaaucucgucaagucuaugguguccgcgggaagcggcgaaguugacuccuuuucucuggggcugcucuguauuagcaucaugauugaggaggugaugagaucccgcuggucucggaaaaugcugaugacgggaacacuugcugucuucuuucugcucaucaugggccagcugaccuggaacgaccugauuagacuuugcaucauggugggcgccaaugccagcgaucgcauggggaugggaacaaccuaucuggcucucauggccaccuucaagaugagaccuauguuugcggugggccugcuguuccggcgccugacauccagagaaguccuucugcucacgauugggcugucucugguugcuagcguggagcuucccaacucccuggaagaacugggagacggccuggccauggggaucaugauccucaaacugcuuaccgauuuucaaagcuaccagcugugggccacacuccugucucugaccuucauuaagacaaccuuuucccuucacuaugcuuggaaaacgauggccauggugcugagcaucgucucucucuucccccugugucucuccacaaccagccagaagaccacauggcugccugugcuucugggaucucugggcugcaagccgcucaccauguuucugauugcugaaaauaaaaucuggggccggaaguccuggccccuuaacgaggggauuauggccguuggaaucgugagcauccugcucuccagccugcucaaaaacgacgucccucuggcgggcccccuuauugccgggggaaugcugaucgcuuguuacgugauuucuggcagcuccgccgaucugucucucgagaaggcugccgaaguuagcugggaggaagaggccgaacauuccggggcuucucacaauauccugguggagguccaggacgauggaacaaugaaaauuaaggacgaggaacgcgaugacacgcuuaccauccugcucaaagcgacacugcucgccgugagcggcgucuauccucuguccauccccgcuacccuuuucguguggcauuuuuggcaaaagaagaaacagagaucuggcguucugugggauacaccuagcccucccgagguggaacgggccguccuggacgaugggauuuaccgcaucaugcagagaggacuccugggccggucccagguggggguuggaguguuccaagagaacgucuuccacaccauguggcacgugacgcgcggcgccgugcuuauguaucaggggaagagacuggagcccagcugggcuucuguuaaaaaggaccucauuuccuacggaggcggcuggcgguuucaggggagcuggaauaccggagaagagguccaggugaucgccguggaacccggcaaaaacccuaagaauguccaaacagcgcccgggaccuucaagacaccggagggagaagugggcgcuauugcccuggacuuuaaaccugggaccucuggaucccccaucguuaacagagagggcaagauugugggccucuacgggaauggagucgugacaacgagcggcaccuauguuuccgccaucgcucaggccaaagcgucucaggaggggccucugcccgaaaucgaggaugaaguguuccgcaagcggaaccuuacaauuauggaccugcaucccggaagcggcaaaaccagacgcuaccugccugcuaucguccgggaggccauuaagagaaagcuccgcacccugauccuugccccgacacgggugguugcuuccgaaauggccgaggcucugaaagggaugcccauuagauaucaaacgaccgccgucaagagcgagcacacaggcaaagaaaucgucgaucucaugugccaugcgaccuuuacaaugcgccugcugucuccugugcgggugcccaauuacaacaugaucauuauggacgaggcccacuucaccgauccuuccagcaucgcugccagaggauauauuucuacgcgggucggcaugggggaagcugccgccaucuuuaugacagcuacacccccuggaagcauggaggcguucccgcaguccaaugccguuauucaggacgaagaaagagauauccccgagagaucuuggaacagcggcuacgaauggaucaccgacuuuccugggaagacagugugguucgugcccuccauuaaagcuggaaaugauaucgccaacugucuccggaagaauggcaagcgcgucauucagcuuucuagaaaaaccuuugacacagaguaucaaaagaccaaaaacaacgauugggacuacgugguuacgacagacaucagcgaaaugggggccaauuuccgggcugauagagugauugacccucgccggugccugaagcccgucauccugaaagauggcccggagagagugauucucgccggaccuaugcccguuaccguggcguccgcugcccagcgccggggcagaaucgggcgcaaccauaauaaggagggagaccaguacaucuauaugggccagccccugaacaaugaugaagaccacgcccacuggacagaggcuaagaugcuucuggauaacauuaauaccccugaagggaucauucccgcccucuucgagccugaacgggagaaaagcgcggccaucgacggagaguacagacugcgcggcgaagcuagaaagacguuugucgagcugaugcggcgcggggaucucccgguguggcuuucuuauaaagucgccuccgaaggcuuccaauacagcgacagacgguggugcuuugauggagagcgcaacaaucaggugcuggaagagaacauggacguugagauuuggaccaaggaaggcgagcgcaaaaagcugcggcccagauggcucgaugcucgcacauauuccgacccucuggcccuucgggaguucaaagaguuugcugccgggagacgcucugugagcggagaccugauccucgaaaucggcaagcugccccagcaucugacccagcgggcgcaaaaugcccucgauaaccuugugaugcugcacaauuccgagcaagggggcagagcuuaccggcaugccauggaggaacugccugacacaauugagacccucaugcugcuugcucugaucgccguccucacaggcggcguuacccuguucuuucugucugggaagggacucggcaaaacgagcauugggcuucugugugugauggccuccagcgugcugcucuggauggcuucugucgaaccccacuggaucgcggccuccauuauccuggaguucuuucuuauggugcugcucaucccggagccugaucgccagagaacaccccaggacaaccaacuggcuuauguugugauuggacuccucuucaugauccuuaccgucgccgccaaugaaaugggccugcuggagaccacaaagaaagaucucgggauuggacacguggcugucgaaaaccaucaccaugccgcgaugcuggacguggaucuucacccugccagcgcuuggacccuguacgccguugcuacaacgaucauuacccccaugaugcggcauacaaucgagaacaccacagccaauauuucucucaccgcgaucgccaaccaggcugccauccugaugggccuggacaagggcuggccuauuuccaaaauggauaucggggugccccuccuugcucugggaugcuacagccaggucaauccgcugacgcucaccgccgcugugcugaugcuuguugcccacuaugcgauuaucggcccugggcugcaagccaaggcuacacgcgaagcccagaagagaaccgcugccggaauuaugaaaaaccccacaaucgacggcaucguggccauugaucucgaccccgucguguacgaugcgaaguuugagaaacagcuggggcagaucaugcugcucauucuuuguaccucucaaauccugcugaugcggacgacaugggcucucugcgagagcauuacccuggccacaggaccucuuaccacccugugggaaggcuccccgggcaaguucuggaauacaacgaucgcugugucuauggccaacaucuuucgcgggagcuaucucgccggagcuggccuggccuucucccugaugaaaagccucgggggaggcagacgggggaccggagcgcagggcgagacacuuggcgaaaaguggaagcgccagcugaaucagcuguccaaaucugaguucaacaccuacaagagaagcgggauuauggaaguugaccgguccgaggccaaagagggacucaagagaggcgaaacaaccaaacacgcugucucucgcgggacggccaagcugcggugguuuguggagagaaaucuugugaagcccgaaggaaaagucaucgaccugggcugugggcgcggaggcuggagcuauuacugcgcuggccucaagaaaguuacagaggugaagggguauaccaaaggaggcccugggcaugaggaacccauuccuauggccaccuacggauggaaccuggugaagcugcacuccggcaaagaugucuucuuuauucccccugagaagugugacacacuccuuugcgauaucggggaaucuagcccgaaucccaccaucgaggaaggacggacacugagagugcugaagaugguugagccuuggcuccgcggcaaccaauucuguauuaaaauccugaaucccuacaugccuuccguggucgagacgcuugaacagaugcagcggaagcauggcgggaugcuggugagaaacccccucagccgcaauucuacccacgagauguauuggguuuccugcggaacaggcaacaucgugagcgcggucaauaugaccucucggaugcugcugaacagauuuacaauggcccaccgcaaaccgaccuacgaacgggacguggaucucggggcuggaacgagacauguggccgucgagccugaaguugcuaaccuggacauuaucggccagcgcauugagaauaucaagcacgagcauaaauccaccuggcacuaugaugaagacaaccccuacaagacaugggccuaucaugggagcuacgaggugaagcccucuggauccgcuagcuccauggugaauggcgucgugaaacuucugaccaagccuugggauguuauucccauggugacacaaaucgccaugaccgacacaaccccuuucggccagcagagagucuuuaaagaaaagguggauacgcggacaccgaaagcgaagcgcgggaccgcccaaaucauggagguuaccgcuagauggcucuggggauuccugagccggaacaagaaacccagaauuuguacacgggaagaguuuacgcgcaaggugagaucuaaugccgcuaucggcgccgucuucguggacgagaaccaguggaauagcgccaaagaagcgguugaggacgaucgguuuugggaccuugugcaccgcgaaagagagcugcacaagcaggggaaaugcgcuaccugcgucuauaacaugaugggaaagcgggaaaagaaacucggcgaguucgggaaggccaaaggcucccgcgccauuugguacauguggcugggagcuagauuucuggaguucgaagcccucggcuucaugaaugaggaucauugguuuucucgggaaaacagccuguccgggguggagggagagggccuucacaagcugggguacauccuccgcgacauuucuaaaaucccuggaggcaauauguaugcugaugacacagccgggugggauaccagaaucacagaagacgaucugcagaacgaggcgaagauuaccgacaucauggaacccgagcaugcccuucuggcuaaaagcauuuucaagcucacauaccaaaauaaggucgugcggguucagcgcccugccaaaaacggcaccgugauggaugucaucuccagacgggaccagcgcggaucuggccagguggggacguauggacugaauaccuuuacaaacauggaagcucaacugauuagacagauggagagcgagggcaucuuccuccccaacgaacuggagaccccgaaucuugccgggcgggugcuggauuggcucgaaaaguacggaguugagagacugaaacgcauggcgaucuccggcgacgacuguguggucaagccuauugaugaccgguuugccacagcucuuaccgcccugaacgauauggggaaagugagaaaggacaucccccagugggaaccuagcaagggcuggaaugauuggcagcaaguucccuucugcucucaccacuuucaucagcucauuaugaaagacggacgcgagaucguggucccuugucggaaccaggaugagcuggugggcagagcucgcgucucccagggggccggauggagccugcgggaaacggcuugccucggcaagucuuaugcccaaauguggcagcugauguacuuccacagacgcgaccuucggcuggcggccaaugcuauuuguuccgccgugcccguugauugggugccgacaagcagaaccacaugguccauccaugcccaccaucaguggaugaccacggaggacaugcucucugucuggaaccgcguguggauugaagagaauccuuggauggaagauaaaacccggaucagcuccugggaggacguucccuaucuggggaagagagaggaccaauggugcggaagccuuaucggccugacagcucgggccaccugggcgacaaacauucagguggcuaucaaucaggucagacgccucauugggaacgaaaauuacucugauuacaugaccuccaugaaacgguuuaagaacgagagcgaacccgagggcgcccugugguga

SEQ ID NO: 19234 - RNA, 9879 nt, Artificial Sequence
  derived and/or modified CDS sequence (opt5) from DENV-1__GU131804__SS-prME
agcgugaccauguuccugaugcucaugcccaccgcccuggcuuuucaccuuacgaccagaggcggggaaccucauaugaucguguccaagcaggaacggggaaaaucucuccuguucaagacaagcgccggcguuaacaugugcacccugaucgcgauggaccuuggggaacugugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggugacaccuagcauggccaugagaugcgugggcauugggucccgggauuucguugagggacuuagcggcgcuacguggguggacguggugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuuuccacacaagaugaaaaggggguuacgcagaacggacggcugaucaccgcgaaucccauugugacagacaaagagaagccugucaacaucgaagcugagccgcccuucggcgagagcuauauugugaucggggccggagaaaaagcccuuaagcucucuugguuuaagaaaggcagcuccauugggaagauguucgaggcuaccgccagaggcgcucgccggauggccauccugggagauacagcgugggacuuuggcucuaucgggggaguguucaccagcguuggcaaacugguccaucagauuuuugggacggccuacggaguccuguucuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguuuaccgugguugugggagaugucgccggcauucucgcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcugaagcugcgcgauuccuauacccaggucugcgaccaccggcuuaugagcgcggccauuaaagauucuaaggcuguucacgccgacaugggcuacuggaucgaauccgagaaaaaugaaacauggaagcucgccagagcuagcuucaucgaggugaagaccuguauuuggcccaaaucucauacacugugguccaacggggugcuggaaagcgagaugaucauuccgaagaucuauggaggcccuauuucucaacacaauuaccgccccggguacuuuacccagacggccggaccuuggcaucucggcaaacuggagcuugauuucgaccugugcgaagggaccacagucgugguugaugagcacugcggaaaccggggccccagccucagaaccacaaccgugacgggcaagaucauccacgaaugguguugccgguccuguacacugccuccccugcgcuuuagaggggaggacggaugcugguauggcauggagauucggccggucaaagaaaaggaggaaaaucuugucaagagcaugguuucugcgggguccggagagguggacagcuucucccucggccugcuguguaucucuauuaugaucgaagaggucaugagaagccgcuggucccggaaaaugcucaugaccgggacacuggcuguguuuuuccuucugauuaugggacagcucaccuggaacgaucugaucagacugugcauuaugguuggcgccaaugccucugaccgcaugggcauggggaccacauaccuugcucugauggccacguuuaagaugagaccuauguucgcggugggacuccuguuucggcgccucaccagcagagagguccugcuucugacaaucggccucucccugguggcuucuguggaacugcccaacagccuugaggaacugggggauggacucgccaugggcaucaugauucugaaacuccugaccgacuuccaaucccaucagcuuugggccacacugcucagccugaccuuuaucaagacgacauucucucugcacuaugcuuggaaaaccauggccaugguccuuuccauuguuagccuguuuccccucugucugucuaccacaucccagaagaccacauggcucccugugcugcuugggagccugggaugcaagccgcugacgauguuccucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggaccaugaagaucaaagaugaggagagagacgauacacugaccauccuucugaaggcgacacuccuggccguuucuggaguguauccucucagcauucccgcuacccuguucgucugguacuuuuggcagaagaagaagcagcgguccggcgugcuuugggacacgccuucucccccggaagucgagcgcgccgugcuggaugacggcaucuauagaauuaugcagcgggggcugcucggacgcagccagguuggcgugggggucuuccaagaaaacguguuucauaccauguggcacguuacaagaggagccgugcugauguaccagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccucuauggcaauggggugguuaccacauccggaaccuacgugagcgccaucgcucaggcccgggcgucccaggagggcccucugcccgagauugaagacgaggucuucagaaagcgcaaccuuaccaucauggaucugcaccccgggucuggaaaaacacggagauaucugccugcuauugugcgcgaagccaucaagcggaaacucagaacgcugauucuugccccgacccgcguuguggcuagcgagauggccgaagcucugaagggcaugcccauccgguaccaaacaaccgccgucaaguccgagcauacagggaaagagaucguggaccucaugugccacgcgaccuuuacgaugagacugcugagcccuguucgggugcccaauuauaacaugauuaucauggaugaagcccauuucacagacccuucuuccauugcugcccgcggcuacaucagcaccagagucggaaugggcgaggcugccgccauuuuuaugaccgcuacacccccugggucuguggaagcguucccgcagagcaaugccgugauccaggaugaggaacgggacauccccgagcgcuccuggaacucuggauaugaguggauuaccgauuuuccuggcaagacagucugguucguucccagcaucaaauccgggaaugacauugcuaacugucucagaaagaauggaaaacgggugauccagcuuucuagaaagaccuucgauacggaauaccaaaagaccaagaacaacgacugggacuacguggucaccacagauauuagcgagaugggcgccaauuuucgcgccgaccgggugaucgauccuagacgcugccugaagcccguuauucugaaagacgggccggaacgggugauccucgcuggcccuaugcccgucaccguggccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuucgaaccugagcgcgaaaagagcgccgcgauugauggggaguauagacugcggggagaggcccgcaagacauuuguugaacugaugagacggggcgaccucccgguguggcuuucuuacaaagucgcuuccgagggguuccaauauagcgaucgcagauggugcuuugacggcgaacggaacaaucaggugcuggaggaaaacauggaugucgagaucuggaccaaggagggagaacgcaagaagcugcgcccccgguggcucgacgccagaacauacuccgacccucuggcucuuagagaguucaaagaauuugccgcuggccggagaucugugagcggggaucugauccucgagauuggaaagcugccccagcaccugacccagcgggcccaaaaugcgcucgacaaccuuguuaugcugcauaauuccgaacagggcgggcgcgccuauagacacgcuauggaggagcugccugauacaaucgaaacccucaugcugcuugcccugauugcugugcucacgggaggcgugacacuguucuuucugucuggccgggggcucggaaaaaccagcaucggccuucugugugucauggccuccagcguucugcucuggauggccucuguggagccccauuggauugcugcguccaucauccuggaguucuuucuuauggugcugcucauuccggagccugaccgccagagaacaccccaggauaaccaacuggccuacgucgugaucgggcuccucuucaugauucuuacaguugcugccaaugagaugggacugcuggaaaccacaaagaaggaccucggcaucgggcacgccgcuguggagaaccaccaucacgccgcgaugcuggaugucgaccuucauccugccagcgcuuggacgcuguacgccguggcuaccacaauuaucacccccaugaugcggcacacaauugaaaacaccacggccaauaucucucucaccgcgaucgccaaccaggcugccauucugaugggacuggauaaaggcuggccuaucuccaagauggacauuggcgucccccuccuugcucuggggugcuauagccaggugaauccgcugacacucaccgccgcuguucugaugcuuguggcccauuacgcgaucauuggaccuggccugcaagccaaagcuacacgcgaggcccagaagagaaccgcugccgggaucaugaaaaaccccacggucgauggaaucguggccauugaccucgaucccguuguguaugacgcgaaguuugaaaagcagcugggccagaucaugcugcucauucuuuguacaucucaaauccugcugaugcggaccacaugggcucucugcgagagcauuacccuggccaccgggccucuuacaacgcugugggagggauccccgggcaaauucuggaauaccacaaucgcugucucuauggccaacaucuuccgcggcagcuaccucgccggggcuggacuggccuuuucccugaugaaaagccucggcgggggaagacggggcaccggggcgcagggagaaacacuuggcgagaaauggaagagacagcugaaucagcuguccaaaucugaguucaacaccuauaagcgcagcggcauuauggagguggaccgguccgaagccaaggaggggcucaaaagaggagagacgacaaagcacgcugugucucgcggcaccgccaaacugcggugguuuguugaaagaaaucuugucaagcccgaggggaaagugaucgaucugggauguggccgcgggggauggagcuacuauugcgcuggccucaagaaggugaccgaagucaaaggcuacacaaaaggcgggccugggcacgaggaacccauuccuauggccaccuacggguggaaccugguuaaacugcauuccggaaaggacguguucuuuauucccccugagaaaugugauacacuccuuugcgacauuggcgagucuagcccgaaucccacgaucgaagaggggcggacccugagagugcugaagauggucgaaccuuggcuccgcggaaaccaauucuguauuaaaauccugaaucccuauaugccuuccgugguugagacacuugagcagaugcagcggaagcacggcggcaugcuggugagaaacccccucagccgcaauucuacccaugaaauguacugggucuccugcgggacaggaaacaucgugagcgcgguuaauaugaccucucggaugcugcugaacagauuuacgauggcccaccgcaagccgaccuaugagagagauguggaccucggcgcugggacacggcacgucgccguggaaccugagguggcuaacauugauaucauuggacagcgcaucgaaaauauuaaacaugagcacaaguccaccuggcauuacgacgaggauaaccccuauaaaacaugggccuaccacggcagcuaugaagucaagcccucuggguccgcuagcuccaugguuaauggaguggugaaacugcuuaccaagccuugggacgucauccccauggugacacaaaucgccaugaccgauacgacaccuuucggccagcagagaguuuuuaaggagaaaguggacacccggaccccgaaggcgaaaagaggcacagcccaaauuauggaagucacggcuaaguggcuguggggguuccucagccggaacaaaaagccccgcaucuguaccagagaggaauuuacacggaaggugcgcucuaaugccgcuauuggagccguuuucguggacgagaaccaguggaauagcgccaaagaggcggucgaagaugagagauuuugggaccuggugcaucgggaacgcgagcuucacaagcagggcaaaugcgcuaccugcguuuacaacaugauggggaagagagagaaaaagcugggagaguucggcaaggccaaagggucccgggccaucugguacauguggcucggcgcucgcuuccuggaguuugaagcccugggauucaugaaugaggaucacugguuuucuagagaaaacagccucuccggcguggagggggagggacugcauaaacuuggcuauauucugcgggacaucucuaaaaucccugggggaaauauguacgcugaugacacagccggcugggauacccgcauuacagaagacgaucuccagaacgaggcgagaaucaccgacauuauggaacccgagcacgcccugcuugcuaagagcaucuucaaacugacguaucaaaauaaggucgugcggguccagcgcccugccaaaaacgggaccgugauggauguuauuuccagacgggaccagagaggcucuggacaggugggcacauacgggcucaauaccuuuacaaacauggaagcucaacugauccgccagauggagagcgagggaaucuucucccccagcgaacuggagaccccgaaccucgccgaacggguccuggauuggcuugagaaguauggcguggaaagacugaagcgcauggcgauuucuggggacgacugugugguuaaaccuaucgaugaccgguuugccacggcucucacagcccugaaugauaugggaaaggugagaaaagacauuccccagugggagccuuccaagggcuggaacgauuggcagcaaguccccuucugcagccaucacuuucaccagcuuaucaugaaagacgggcgcgagauugugguuccuugucggaaucaggaugaacuggugggcagagcucgcgucucucagggagccggcuggucccuccgggagaccgcuugccugggaaagagcuacgcccaaauguggcagcugauguauuuccauagacgcgaccuccggcuggcggccaacgcuaucuguuccgccgugcccgucgauuggauuccgacaucuagaaccacguggagcauccacgcccaucaccaguggaugaccacagaagacaugcuuuccguguggaaucggguuuggaucgaggaaaacccuuggauggaggauaagacccauauuagcucuuggggagacgugcccuaccugggcaaaagagaggaccaauggugcgggucccucaucggacugacagcucgcgccaccugggcgacaaauauucaggucgcuaucaaccaggugcggagacuuauuggcaaugaaaacuaccuggauuauaugaccagcaugaagcgcuuuaaaaaugagucugaccccgaaggggcccucugguga

SEQ ID NO: 19235 - RNA, 9879 nt, Artificial Sequence
  derived and/or modified CDS sequence (opt5) from DENV-1__GU131805__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcauugaagcgaagaucuccaacaccacgacagacagcagauguccgacccaaggagaggccacccuuguggaagagcaggaugcuaauuuugugugccggcgcacauucgucgacagaggcuggggcaacggguguggacuguuuggcaaagggucucucaugaccugcgccaaguucaagugcgugacaaaacuggagggaaagauuguucaguacgaaaaucuuaaauauuccgugaucgucacggugcacaccggcgaccagcaucaaguugggaacgagagcacagaacacggaaccacagcuaccaucacgccccaggccccuucucccgagauucagcugccugauuacggcgcccucacccuggacuguuccccccggccgggccuggauuuuaaugaaauggugcuccugccuaugaaggagaaaagcuggcuuguccauaagcagugguuccuggaccucccccugccuuggacauccggggcuucuaccagccaagagacauggaaccgcaaagaucuucugggaaccuuuaagacggcgcacgccaaggaacaggagguggucgugcucggcucccaggaaggggcuaugcacacagcccugaccggagccacagagauccaaaccagcggcaccacaacgauuuucgcugggcaucugaaaugcagacucaagauggacaaacugacccuuaagggcaugucuuauguuauguguacaggauccuucaaacuggaaaaggagguggccgagacccagcacggcacaguccucgugcagaucaaguacgaagggaccgaugcgcccugcaaaauucccuuuagcacgcaggacgagaagggaguuacacaaaauggccggcugaucaccgcuaacccuaucgugaccgauaaagaaaagccggucaauauugaggccgagcccgccuucggggaaucuuauaucgugauuggagcuggcgagaaagcccugaagcuuagcugggugaagaaaggguccucuaucggcaagauguuugaagcuacagccagaggagcgcgccggauggccauucucggcgacaccgcuugggauuucgggagcaucggaggcguuuuuacauccgucgggaaacuggugcaucagaucuucggaacggccuacggcgugcuguuuagcggggucucuuggaccaugaagauuggcaucggagugcuccugacauggcuuggccugaacuccagaagcaccucucucuccaugacauguauugcuguugggcuggugacccuguaccuuggagucauggugcaggccgacagcggcugcguuaucaauuggaaagggcgcgagcucaaguguggauccggcauuuucgggacgaacgaagugcacaccuggacagagcaguauaaguuucaagcggacucuccuaaacggcugagcgccgcuaucggcaaggccugggaggaaggagucugcggcauuagauccgcuacccgccuggagaauaucauguggaaacagaucucuaacgaacucaaccauauucugcuugagaaugccaugaagcugacagugguugugggggaugucgccggaauccucgcucagggcaaaaagaugauucggccccagccuauggaauacaaauauagcuggaaguccugggggaaggcgaaaaucauuggagccgacgugcaaaacaccacauucaucaucgauggccccaauaccccggaguguccugacgaucagagagcuuggaacauuugggagguggaagacuacggcuuugggaucuucacgacaaauauuuggcugaagcugcgcgauagcuauacccaggucugcgaccaccggcuuaugucugccgccaucaaagauuccaaggcuguucacgccgacaugggauacuggauugagagcgaaaaaaacgagcccuggaagcucgcgagagcuucuuuuaucgaagugaagaccuguaucuggccuaaaucccauacacuguggagcaauggcgugcuggagucugagaugauuauccccaagauuuaugggggaccuaucagccagcacaacuaccgccccggcuacuucacccaaacggccgggccguggcaucucggaaaacuggaacuugauuucgaccugugcgagggcacaaccgucgugguugaugaacacugcggcaaucgggggccuucccucagaacaaccacagugcccggaaagauuauccacgagugguguugccggagcuguacccugcccccucugcgcuuuaaaggcgaggacgggugcugguauggaauggaaaucucuccggucaaggagaaggaagagaaccuugugaaauccaugguuagcgccggcuccggggaaguggacucuuucagccucggacugcuguguauuuccaucaugauugaggaggucaugagaucucgguggagcagaaagaugcucaugacgggcccccugccuguguuuuuccuucugaucaugggccagcuccccuggaaugaucugauucgccugugcaucaugguuggggcuaacgccuccgaccggaugggaaugggcaccccuuaccuugcgcugauggcuacauuuaaaaugagacccauguucgccguggggcuccuguuucgcagacucaccucucgggaaggacugcuucugacaauuggccucagccuggucgccuccguggagcugccuaauagccuugaagagcugggggauggacucgcuaugggcaucaugauccugaagcuccugaccgacuuccagucucaucaacuuugggccacgcugcucgcucugacauuuauuaaaaccacauucucccuggauuaugccuggaagaccauggcgauggugcuuagcaucgucucucuguuuccccucugucuguccaccacaagccagaagacgaccuggcucccgguucugcuuggcucucuggggugcaaaccucugacaauguuccucauugccgaaaacaagaucuggggacgcaaauccuggccccugaaugagggcauuauggcuguggggaucgugagcauccuucuguccgcccuccugaagaacgacgucccucucgcuggaccccugauugccggcgggaugcuuaucgccuguuacgugauuagcggaucuagcgcugaucugucccuggagaaagcggccgaaguuucuugggaggaagaggcugaacacagcggcggcucccauaacauccucguggagguccaggacgaugggaccaugaagauuaaagacgaggaaagagaugccacacugaccauccuucugaaggccacgcuccuggcugugucuggaguuuauccgcucagcaucccugccacacuguuugugugguacuucuggcagaagaaaaagcaacgguccggcguccuuugggacacccccucuccucccgagguggaacgcgcgguccuggaugacgggauuuauagaaucaugcagcggggacugcucggccgcagccagguggggguuggaguguuccaggagaaugucuuucacaccauguggcaugugacaagaggcgcuguucugauguaccaaggcaaacggcuugagcccuccugggccagcgugaagaaagaccugauuucuuacgggggaggcuggcgccuccagggguccuggaacaccggagaagagguccaggugaucgccguggaaccuggcaagaauccgaagaacguucagacagcucccgggacguucaaaaccagcgagggagaagucggcgccauugcgcuggauuuuaagccuggcacaucugggucccccaucgugaauagagagggaaaaauugugggccucuaugggaacggagucgugaccacaagcggcaccuacguuuccgcuaucgcccaagccaaggcuucucaggaggggccucugcccgaaaucgaggacgaaguguuccggaaaagaaaucuuacgauuauggaucugcacccuggcagcggaaagacccgccgguaucugccggccaucgucagagaggcuauuaagcgcaaacuccggacacugauccuugcccccaccagagugguugcguccgaaauggccgaggcucugaagggcaugccuauucgcuaccagacaaccgccgugaaaagcgagcacacagggaaggaaaucgucgaccucaugugccaugcuacguuuaccaugcggcugcugucucccgugagaguuccuaacuauaauaugaucauuauggaugaggcccacuucacagaccccuccagcaucgccgcucgcggauacauuucuacccgggugggcaugggggaagcggccgcuaucuuuaugaccgccacaccgccuggaagcgucgaggccuucccccaauccaacgcugugauucaggaugaagagagagacauccccgagcggucuuggaauagcggcuaugaauggaucacggauuuuccugggaaaaccgugugguucguccccuccauuaagucuggcaacgacaucgccaauugucuccgcaagaacggaaaaagaguuauucagcuuagccggaagacauuugauaccgaguaccagaaaacaaagaauaacgacugggacuacguggugaccacggauaucuccgaaaugggcgcgaacuuccgcgcugacagagucauugauccucggagaugccugaaaccggugauccugaaggacgggcccgagcgcguuauucucgccggaccuaugcccgugacagucgccagcgcugcccaacggagaggccgcaucgggcggaaucauaacaaggagggagaucaguauaucuacaugggccagccucugaauaacgacgaagaucacgcgcauuggaccgaggccaaaaugcuucuggacaauauuaacacccccgaagggaucauuccggcucucuucgagccugaaagagagaagucugccgcuaucgauggcgaguaucgccugcggggagaagccagaaaaacauuuguggagcugaugcgcagaggcgaccuccccguuuggcuuuccuacaagguggcuagcgaaggguuccaguauuccgaucggcgcuggugcuuugacggagagagaaauaaccaaguccuggaagagaauauggauguggagauuuggaccaaagaaggcgagcggaagaaacugcgcccuagauggcucgacgcccggacauacucugacccccuggcgcuuagagaauucaaggaguuugccgcugggcgccggagcgucuccggagaucugauccucgaaaucggcaagcugccucagcaccugacccagagagcccagaacgcucucgacaaucuugugaugcugcacaacucugagcaaggcgggcgcgccuaucggcaugccauggaggaacugcccgauacgauugagacacucaugcugcuugcucugaucgcgguucucaccggaggcgugacacuguucuuucugagcgggagaggacucggcaaaaccuccauugggcuucugugugugauggccagcucuguccugcucuggauggcuuccguugaaccgcacuggaucgccgccagcauuauccuggaguucuuucuuauggugcugcucaucccugagcccgaccggcagcgcacgccccaggauaaucagcuggcuuacguggucauuggacugcucuucaugauccuuaccguggccgcgaacgaaaugggccugcuggagacaaccaagaaagaccucggcauugggcauguugccguggaaaaucaccaccaugcugccaugcuggaugucgaccuucacccugcuucugccuggacacuguacgcgguggccaccacaaucauuaccccgaugaugagacauacgaucgagaacacaaccgcuaacauuucccucaccgccaucgcuaaucaagccgcuauccugaugggacuggauaagggcuggcccauuagcaaaauggacaucggggucccucuccuugcccugggaugcuauucucaggugaacccccugacacucaccgcggccguucugaugcuuguggcucacuacgccauuaucggcccugggcugcaggcuaaggccacacgggaagcccaaaagcgcacggcggcuggaauuaugaaaaaucccaccgucgauggcaucguggccaucgaccucgauccuguuguguaugacgcuaaguuugagaaacagcugggccagauuaugcugcucauccuuuguacaagccagauucugcugaugagaaccacaugggcccucugcgaguccaucacccuggccacggggccgcuuaccacacugugggaaggaucucccggcaaguucuggaacaccacaauugcugucagcauggccaauaucuuucggggguccuaccucgcgggagccggccuggcuuucagccugaugaaaucccucgggggaggccgcagaggcaccggggcccaaggagagacgcuuggcgaaaaguggaagcggcagcugaaccagcugucuaaaagcgaguucaauacauauaagcgcuccgggaucauggaaguggacagaucugaggcuaaagagggacucaagcggggcgaaaccacaaaacaugccgugagcagagggaccgcgaagcugcgcugguuuguugagcggaaccuugucaagccugaaggaaaagugauugaucugggcuguggcagagggggaugguccuacuauugcgccggccucaagaaagugaccgaggucaagggguacacaaaaggaggccccgggcacgaagagccuauccccauggcuacguacggauggaaucugguuaagcugcacucuggcaaagacguguucuuuauuccgccugagaagugugauacccuccuuugcgacaucggcgaaagcucccccaaccccacaauugaggaagggcgcacccugcgggugcugaagauggucgagccuuggcucagaggaaaucaguucuguaucaaaauucugaaccccuauaugccuagcgugguugagacacuugaacaaaugcagcgcaagcauggcgggaugcuggugcggaauccgcucucuagaaacuccacccacgagauguacugggucagcugcggaacgggcaauaucgugucugccguuaacaugacaucccgcaugcugcugaaucgguuuaccauggcucauagaaaacccaccuaugaacgcgauguggaccucggggccggaacacggcacgucgcuguggagccugaaguggccaaccuggauaucauuggccagagaaucgagaacauuaagcacgagcauaaaagcaccuggcacuacgacgaagauaaucccuauaagacaugggcguaccauggcucuuaugaggucaagccuuccgggagcgccuccagcaugguuaacggaguggugaaacuucugacgaagcccugggacgucaucccgauggugacccagauugcuaugacagauaccacaccuuucggccaacagcgcguuuuuaaagaaaagguggacaccagaacgcccaaagccaagcgggggaccgcucagaucauggaggucacagccaaguggcucuggggauuccugucucgcaauaaaaagccuagaaucuguacccgggaagaguuuacaagaaaagugcggagcaacgccgcgauuggcgcuguuuucguggacgagaaucaauggaacuccgccaaggaagccgucgaggaugaacgcuuuugggaccuugugcacagagagcgggaacugcauaaacaggggaagugcgcuaccugcguuuacaauaugaugggcaagcgcgagaaaaagcucggagaguucggcaaagccaaggggucuagagcuaucugguacauguggcugggagcccgguuucuggaauucgaggcgcucggcuucaugaacgaagaucacugguuuagccgcgagaauucccugucugggguggagggagaaggccuucacaaacugggguauauucucagagacaucagcaagauucccggcggaaacauguacgccgaugacacagcuggcugggauacccggaucacggaggacgaucugcagaaugaagccaaaaucacagacauuauggagccugaacaugcucuucuggccaaguccaucuucaagcucaccuaucagaacaaagucgugcgcguccaaagacccgcgaagaaugggaccgugauggauguuauuucucggcgcgaccagagaggaagcggccagguggggacauacggacugaacacguuuaccaauauggaggcccagcugauccggcaaauggaguccgaaggcauuuucagcccgucugagcucgaaacaccuaaccuggcugggcgcguccuugauuggcuggagaaacacggcguggaaagacucaagcggauggccaucuccggagacgacugugugguuaaacccaucgaugacagauuugcugccgcucugaccgcccuuaacgauaugggcaaggugcgcaaggacauuccccagugggagccuagcaaaggguggaaugauuggcagcaggucccguucugcucucaucacuuucaccaacugaucaugaaggacggacgggagauugugguucccuguagaaaccaggaugaacucgugggccgcgcgcgggucucccagggggccggauggagccugagagagacagcuugccugggcaaauccuaugcccagauguggcaacucauguacuuccaucgccgggaccugagacuugccgcuaaugccaucuguucugcggugccugucgauugggugcccaccagccgcacaaccugguccauucacgcucaucaccaguggaugacgaccgaagacaugcugagcguuuggaaccggguguggaucgaggaaaauccuuggauggaggauaagacacauauuucuuccuggggggacguccccuaucucggcaaaagagaggaccaguggugcggaagccugaucggccuuaccgcccgcgccacaugggcuaccaacauccaaguggccauuaaucagguucggagacugaucgggaacgaaaauuaccucgauuacaugacgucuaugaagcgguuuaagaacgagagcgacccugaaggagcucugugguga

SEQ ID NO: 19236 - RNA, 9879 nt, Artificial Sequence
  derived and/or modified CDS sequence (opt5) from DENV-1__GU131806__SS-prME
agcgugaccauguuccugaugcucaugcccacagcgcuggcuuuucaccuuacgaccagaggaggggaaccucauaugaucgucuccaagcaggaacggggaaaaucucuccuguucaagacaagcgccggcguuaacaugugcacccugauugcgauggaccuuggggaacugugugaagauacaaugaccuacaaaugcccgagaaucacagagaccgaacccgacgauguggacuguuggugcaaugcuacggauaccugggugacauauggaaccuguucccagacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcugguuacaccuagcauggccaugagaugcgugggcauugggucccgggauuucguugagggacuuagcggcgcuacguggguggacgucgugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuaccaccgagauccagcugacagacuacggcgcccucacccuggauuguucuccccggacgggccuggacuuuaacgaaauggugcuccugacaaugaaggagaaauccuggcuuguccauaagcagugguuccuggaucucccucuggccuggaccagcgggggauccacaucucaagagaccuggaaucgccaggaccuuguggucaccuuuaaaacagcucacggcaagaagcaggaagugguugugcuggggagccaagagggagcgaugcacacggcccucaccggcgcuacagaaauucagaccuccgggacaaccacgaucuucgccggccaucugaaaugcagacugaagauggauaaacucacacugaagggaaugagcuaugucauguguaccggcucuuucaaacuugagaaggaacuggccgagacccagcacgggacagugcucguucagauuaaguacgagggaaccgacgcucccugcaaaaucccguuuuccacacaagaugaaaagggcgugacgcagaacgggcggcugaucaccgccaauccuauugucacagacaaagagaagcccgugaacaucgaagcggagccucccuucggagagagcuauauugugaucggcgcuggggaaaaagcccugaaacuuucuugguuuaagaaaggcagcuccauuggaaagauguucgaggccaccgcuagaggcgcccgccggauggcuauccucggggauacagccugggacuuuggaucuaucggcgggguuuucaccagcgucggaaaacuggugcaucagauuuuuggcacggcguacggggugcuguucuccggcgucagcuggaccaugaagaucggaauuggcgugcuccugacauggcuugggcucaauucuagauccaccagccucucuaugacauguaucgccguuggacuggugacccuguaccuuggcgucauggugcaggcugauuccgggugcguuauuaacuggaaaggacgcgaacucaaguguggcagcgggaucuuugugacaaaugagguccacaccuggacggaacaauauaaguuccaggccgacucccccaaacggcugucugcugccauuggcaaggcgugggaggagggagugugcggcaucagaagcgccacacgccuggaaaacaucauguggaaacagauuuccaacgagcucaaucauauccugcuugaaaacgacaugaaguuuaccguuguggucggggauguggcuggcauucuggcccagggcaaaaagaugauccggccucaaccgauggaguacaaauauucuuggaaaagcugggggaaggcuaagauuaucggagccgacgugcagaauaccacauucaucauugauggccccaacaccccugaaugucccgacgaucagagagccuggaauaucugggaggucgaggacuacggcuuugggauuuucacgacaaacaucuggcucaagcugcgcgauuccuauacccagguuugcgaccaccggcugaugagcgcugcgauuaaagauucuaaggccgugcacgcugacaugggauacuggaucgaauccgagaaaaaugaaacauggaaacuugccagagccagcuucaucgaggugaagaccuguauuuggccuaaaucucauacacucugguccaacggcguccuggaaagcgagaugaucauucccaagaucuaugggggaccgauuucucaacacaauuaccgcccuggcuacuuuacccagacggcugggcccuggcaucuggccaaacucgagcuggauuucgaccuuugcgaaggaaccacagugguuguggaugagcacugcggcaaccggggcccuagccugagaaccacaaccgucacggggaagaucauccacgaaugguguugccgguccuguacacugcccccucugcgcuuuagaggagaggacggcugcugguaugggauggagauucggcccgugaaagaaaaggaggaaaaucugguuaagagcauggugucugcgggauccggcgaggucgacagcuucucccuugggcuccuguguaucucuauuaugaucgaagaggugaugagaagccgcuggucccggaaaaugcugaugaccggaacacucgcugucuuuuuccugcuuauuaugggccagcugaccuggaacgaucucaucagacugugcauuauggugggcgccaaugccucugaccgcauggggaugggaaccacauaccuggcucuuauggccacguuuaagaugagaccgauguucgcggucggccugcucuuucggcgccugaccagcagagaggugcuccugcuuacaaucgggcugucccucguggcuucugucgaacugccuaacagccuggaggaacuuggagauggccuggccauggggaucaugauucucaaacugcucaccgacuuccaaucccaucagcugugggccacacuucugagccucaccuuuaucaagacgacauucucucugcacuaugcuuggaaaaccauggccaugguucuguccauugugagccuuuuuccccugugucucucuaccacaucccagaagaccacauggcugcccgugcuccugggaagccuuggcugcaagccucugacgauguuccugaucgcugagaauaaaauuuggggccggcgcucuuggccgcucaacgaagggaucauggccgucggaaucguguccauucugcuuagcucccugcucaagaacgauguuccccuggcgggcccucucaucgccgggggaaugcugauugcuuguuacgugaucagcggcucuagcgccgaccuuucccuggagaaagcugccgaggucucuugggaagaggaagccgagcauagcgggcccucccacaauauucugguggaaguucaggaugacggaccuaugaagaucaaagaugaggagagagacgauacccucacaauccugcuuaaggcuacccugcucgcggugucuggcgucuauccccugagcauuccugccacacucuucgugugguacuuuuggcagaagaagaagcagcgguccggcguccugugggacacccccucuccgccugaaguggagcgcgcuguucuugaugacgggaucuauagaauuaugcagcggggacugcugggccgcagccaggugggggucggaguguuccaagaaaacguuuuucauacgauguggcacgugaccagaggcgccguccucauguaccaggggaaacggcuggagcccuccugggccagcgugaagaaagaccuuaucucuuacggaggcggcuggagacugcagggguccuggaauacaggagaggaagugcagguuauugcugucgagccuggcaagaaccccaaaaaugugcaaaccgccccggggacauucaagaccccugaaggagaggugggcgcgaucgcucucgauuuuaagcccgggacaagcggaucuccuauugucaaccgcgaaggcaaaauccugggccucuaugggaauggagugguuacgaccuccggcacauacgugagcgccaucgcccaggcucgggccucccaggaggggccccugcccgagauugaagacgaggucuucagaaagcgcaaccuuaccaucauggaucugcacccuggaucuggcaaaacccggagauaucugccggcgauugugcgcgaagcuaucaagcggaaacucagaacacugauucuugcccccacgcgcguuguggccagcgagauggcugaagcccugaaggggaugccuauccgguaccaaaccacagcugucaaguccgagcauaccggcaaagagaucguggaccucaugugccacgccacauuuaccaugagacugcugagccccguucgggugccuaauuauaacaugauuaucauggaugaagcgcauuucacggaccccucuuccauugccgcucgcggauacaucagcacaagagucggcaugggggaggccgcugccauuuuuaugaccgccaccccuccgggaucuguggaggcuuucccccagagcaaugcggugauccaggaugaagaacgggacaucccugagcgcuccuggaacucuggcuaugaguggauuacagauuuucccgggaagaccgucugguucguuccuagcaucaaauccggaaaugacauugccaacugucucagaaagaauggcaaacgggugauccagcuuucuagaaagacauucgauaccgaauaccaaaagacgaaaaacaacgacugggacuacguggucacaaccgauauuagcgagaugggggcuaauuuucgcgccgaccgggugaucgaucccagacgcugccugaagccgguuauucugaaagacggcccugaacgggugauccucgccggacccaugcccgucacaguggcuuccgccgcgcagagacgcggccggaucgggagaaaccacaauaaggagggagaucaguauauuuacaugggccagccucugaacaaugacgaggaucaugcucacuggaccgaagccaaaaugcuucuggacaacaucaauacgcccgaggggauuaucccugcccucuucgaaccggagcgcgaaaagagcgcugccauugauggagaguauagacugcggggcgaggcgcgcaagaccuuuguugaacugaugagaagaggggaccuccccguguggcuuucuuacaaagucgccuccgagggcuuccaauauagcgaucgcagauggugcuuugacggagaacggaacaaucaggugcuggaggaaaacauggaugucgagaucuggacaaaggagggcgaacgcaagaagcugcgcccucgguggcucgacgcuagaaccuacuccgacccccuggcccuucgcgaguucaaagaauuugcugccgggcggagaucugugagcggagaucugauccucgagauuggcaagcugccucagcaccugacacagcgggcucaaaaugcccucgacaaccuuguuaugcugcauaauuccgaacaagggggacgcgcguauagacacgccauggaggagcugcccgauaccaucgaaacacucaugcugcuugcucugauugccgugcucaccggcggcgugacgcuguucuuucugucugggcggggacucggcaaaacaagcaucgggcuucugugugucauggcuuccagcguucugcucuggauggccucuguggagccgcauuggauugccgcuuccaucauccuggaguucuuucuuauggugcugcucauuccugagcccgaccgccagagaaccccucaggauaaccaacuggcguacgucgugaucggacuccuguucaugauucuuaccguugccgcuaaugagaugggccugcuggaaacaaccaagaaggaccucgggaucggacacguggccgucgagaaccaccaucacgccgcuaugcuggauguggaccuucaucccgccagcgcguggacacuguacgccgucgcuacgaccauuaucacaccuaugaugcggcacaccauugaaaacacaaccgccaauaucucucucacggcuaucgccaaccaggcggccauucugaugggccuggauaaaggcuggcccaucuccaagauggacauuggggugccgcuccuugcucugggaugcuauagccagguuaauccucugacccucacagccgcugugcugaugcuugucgcccauuacgcuaucauuggccccgggcugcaagccaaagcgacccgcgaggcccagaagagaacagcugccggaaucaugaaaaaccccaccguggauggcaucguugcuauugaccucgauccuguggucuaugacgccaaguuugaaaagcagcuggggcagaucaugcugcucauucuuuguacgucucaaauccugcugaugcggacaaccugggcccucugcgagagcauuacacuggcgaccggaccgcuuaccacacugugggagggcucccccggcaaauucuggaauacgaccaucgcugugucuauggccaacaucuuccgcgggagcuaccucgcuggagccggccuggccuuuucccugaugaaaagccucgggggaggcagacgggggacaggagcucagggcgaaacccuuggcgagaaauggaagagacagcugaaucagcuguccaaaucugaguucaacacauauaagcgcagcgggauuauggagguggaccgguccgaagccaaggagggacucaaaagaggcgagaccacgaagcacgcgguuucucgcgggacagccaaacugcggugguuugucgaaagaaaucuugugaagccugagggaaaagugaucgaucugggcugugggcgcggaggcuggagcuacuauugcgcuggccucaagaaggucaccgaaguuaaaggguacaccaagggaggccccgggcacgaggaaccuauucccauggccacauacggauggaaccuggugaaacugcauuccggcaaggacguguucuuuaucccuccggagaaaugugauacccuccuuugcgacauuggggagucuagccccaauccuacaaucgaagagggacggacgcugagaguccugaagaugguggaacccuggcuccgcggcaaccaauucuguauuaaaauccugaauccuuauaugcccuccguuguggagacccuugagcagaugcagcggaagcacggcgggaugcuggucagaaacccgcucagccgcaauucuacacaugaaauguacuggguguccugcggaaccggcaacaucguuagcgcugugaauaugacaucucggaugcugcugaacagauuuaccauggcccaccgcaagccuacguaugagagagaugucgaccucggggcgggaacccggcacguggccguggaacccgaggucgcuaaccuggauauuaucggccagcgcauugaaaauaucaaacaugagcacaaguccacauggcauuacgacgaggauaaccccuauaaaaccugggccuaccacgggagcuaugaaguuaagccuucuggauccgcuagcuccauggugaauggcguggucaaacuucugacaaagcccugggacgugauuccuaugguuacccaaaucgccaugacagauaccacgccguucggccagcagagaguguuuaaggagaaagucgacacacggacccccaaggcuaaaagagggaccgcccaaaucauggaagugacagcgaaguggcucuggggauuccugagccggaacaaaaagccucgcauuuguacgagagaggaauuuacccggaagguucgcucuaaugccgcuaucggcgccguguucgucgacgagaaccaguggaauagcgcuaaagaggccguggaagaugagagauuuugggaccuuguucaucgggaacgcgagcugcacaagcaggggaaaugcgccacaugcguguacaacaugaugggaaagagagagaagaagcucggcgaguucgggaaggcgaaaggcucccgggcuauuugguacauguggcugggagcccgcuuccuggaguuugaagcccucggcuucaugaaugaggaucacugguuuucuagagaaaacagccuguccggggucgagggagagggccuucauaagcugggguauauccuccgggacauuucuaaaauccccggaggcaauauguacgcugaugacaccgccgggugggauacacgcaucaccgaagacgaucugcagaacgaggcuagaauuacagacaucauggaaccugagcacgcccuucuggccaagagcauuuucaaacucaccuaucaaaauaaggugguccgggugcagcgccccgccaaaaacggcacgguuauggaugugaucuccagacgggaccagagaggaucuggccaggucgggaccuacggacugaauacauuuaccaacauggaagcucaacugauucgccagauggagagcgagggcaucuucuccccgagcgaacucgagacaccuaaccuggccgaacgggugcuugauuggcuggagaaguaugggguggaaagacucaagcgcauggcuaucucuggagacgacuguguugugaaacccauugaugaccgguuugccaccgcgcugacggcccuuaaugauaugggcaaggucagaaaagacaucccucagugggagcccuccaagggguggaacgauuggcagcaagugccuuucugcagccaucacuuucaccagcugauuaugaaagacggccgcgagaucguugugcccugucggaaucaggaugaacucgucggacgggcucgcgugucucagggcgccggguggucccugcgggagacagcuugccugggaaagagcuacgcccaaauguggcagcucauguauuuccauagacgcgaccugcggcuugcugccaacgcgauuuguuccgccgucccgguggauuggaucccuaccucuagaacaaccuggagcauucacgcucaucaccaguggaugacgaccgaagacaugcuguccguuuggaaucggguguggaucgaggaaaaccccuggauggaggauaagacacauaucagcucuuggggcgacguccccuaccucgggaaaagagaggaccaauggugcggaucccugauuggccuuaccgcccgcgccacaugggcuaccaauauccagguggccauuaaccagguucggagacugaucgggaaugaaaacuaccucgauuauaugacaagcaugaagcgcuuuaaaaaugagucugacccugaaggcgcgcugugguga

SEQ ID NO: 19237 - RNA, 9879 nt, Artificial Sequence
  derived and/or modified CDS sequence (opt5) from DENV-1__GU131807__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagccugaggucacaaacccggcuguucugcgcaaacuuugcauugaagccaagaucuccaauaccacgacagauagcagaugucccacccaaggagaggcgacccugguggaagagcaggacgccaacuucgugugccggcgcacauuugucgauagaggcuggggcaauggguguggacucuucggcaaagggucucugauuaccugcgcuaaguuuaagugcgugacaaaacuugagggaaagaucguucaguacgaaaaccugaaauauuccgugaucgucacggugcacaccggcgaccagcaucaaguugggaaugagagcacagaacacggaaccacagccaccauuacgccucaggcucccaccacagagauccagcucaccgacuacggcgcccugacacuggauuguucuccucggaccggccucgacuucaacgaaauggugcuggucacgaugaaggagaaauccuggcuugugcauaagcagugguuucuggaucucccccugccguggacaagcggggccuccaccucucaagagacauggaaucgccaggaccuucuggucaccuucaaaaccgcucacgcgaagaagcaggaagugguugugcucggaagccaagagggcgccaugcacacagcucugacgggggccaccgaaauucagacauccggaaccacaaccaucuuugccggccaucugaaaugcagacucaagauggauaaacugacgcuucgggggaugagcuaugucauguguacaggcucuuucaagcuggagaaagaaguggcugagacccagcacggaaccguucucgugcagauuaaguacgagggcacagacgccccuugcaagauccccuucuccacccaagaugaaaaaggggucacacagaacggaagacugaucacggcgaauccuauugugaccgacaaggagaaacccgugaacaucgaagcugagcccccuuuuggcgagagcuauauuguuaucggggccggagaaaaggcccugaaacuuucuugguucaagaagggcagcuccauugggaaaauguuugaggcuacagcccgcggcgcucggagaauggccauccucggagauaccgcgugggacuucggcucuaucgggggagucuuuacaagcgugggcaagcuggugcaucagauuuucgggccggccuacggaguccuguuuuccggcgugagcuggcccaugaaaaucgggauuggcguucuccugaccuggcuuggacugaauucucgcuccacgagccucucuaugaccuguaucgcugugggccuggucacacuguaccuuggggugaugguucaggccgauuccggaugcgugauuaacuggaagggccgggaacucaaaugugggagcggaaucuucgucaccaaugaggugcacacauggaccgaacaauauaaguuucaggcugacuccccuaagagacugucugccgcgauuggcaaagccugggaggaggggguuugcggcauccgcagcgcuacacggcuggaaaacaucauguggaagcagauuuccaacgagcucaaucauauccugcuugaaaacgacaugaaauucaccguggucgugggagauguggccggcauucuggcucaggggaagaaaaugaucagaccccaaccuauggaguacaaguauucuuggaaaagcuggggaaaggccaagauuaucggcgccgacguccagaauacgacauuuaucauugaugggcccaacaccccggaauguccugacgaucagcgcgcuuggaauaucugggagguugaggacuacggauucggcauuuuuaccacaaacaucuggcucaaacugcgggauuccuauacccaggugugcgaccacagacugaugagcgcggccauuaaggauucuaaagcugugcacgccgacaugggcuacuggaucgaauccgagaagaaugaaacguggaaacuugcccgcgcuagcuucaucgaggucaagacauguauuuggcccaagucucauacccucugguccaacggggugcuggaaagcgagaugaucauuccuaaaaucuauggaggccccauuucucaacacaauuaccggccuggguacuucacacagaccgccggacccuggcaucugggcaagcucgagcuggauuuugaccuuugcgaagggacaaccguuguggucgaugaccacugcggaaacagaggcccgagccugcggacgaccacagugaccggcaaaaucauccacgagugguguugccgcuccuguacacucccuccccugagauuccggggggaagacggaugcugguauggcauggagauuagacccguuaaggagaaagaagagaaucuggugaagagcauggucucugcgggguccggagaaguggauagcuuuucccuuggccuccuguguaucucuauuaugaucgaggaaguuaugcgcagccggugguccagaaagaugcugaugaccgggacgcucgcuguguucuuucugcuuauuaugggacagcugacauggaacgaccucauccgccugugcauuauggucggcgccaaugccucugauagaaugggcauggggaccacauaccuggcucuuauggccaccuucaaaauccggccuauguuugcggugggacugcucuuccgcagacugaccagccgggaggugcuccugcuuacaaucggccugucccucgucgcuucuguugagcugccgaacagccuggaagagcuuggggacggacuggccaugggcauuaugauccucaagcugcucacggauuuucaaucccaucagcugugggccacccuucugagccucacauucauuaaaaccacauuuucucugcacugugcuuggaagaccauggccauggugcuguccaucgugagccuuuucccccugugccucucuacgacaucccagaaaaccaccuggcugccuguccuccuggggagccuuggauguaagccccugacaauguuucugauugcugaaaauaagaucuggggccgcagaucuuggccucucaacgagggcaucauggccguggggauuguuuccauccugcuuagcucccugcucaaaaacgacgugccccuggcgggaccucucauugccggcgggaugcugaucgcuugcuaugucauuagcggaucuagcgccgaucuuucccuggaaaaggcugccgaggugucuugggaggaagaggccgaacauagcggcgcuucccacaauauccugguugaggugcaggacgaugggaccaugaaaaucaaggacgaagagcgggaugacacacucacgauucugcuuaaagcgacccugcucgccgucucuggaguguacccccugagcaucccggcuacacucuucgucugguauuucuggcaaaagaaaaagcagcgcuccggcgugcugugggauaccccuucucccccugagguugaaagagccgugcuugacgacggcauuuaccggaucaugcagcgcgggcugcugggaagaagccaggucggcguggggguuuuucaagagaacguguuccauacaauguggcacgucacccggggagccgugcucauguaucagggcaagagacuggaacccuccugggcuagcgugaaaaaggaucuuauuucuuacgggggaggcuggcgccugcagggcuccuggaauacgggggaggagguucaggucaucgccguggaaccgggaaaaaacccuaagaaugugcaaaccgcgcccggcacauuuaaaaccccugagggggaagucggagcuauugcccucgacuucaagcccggcacaagcgggucucccaucgugaaccgggagggaaagaucguuggccuguacggcaaugggguggucaccacauccggaacguaugugagcgccauugcucaggccaaagcgucccaggaaggcccucucccggagaucgaggaugaaguuuuuagaaagcgcaaccugaccauuauggaccuucaccccgggucuggaaaaacacggagauaccugccugcuaucgugcgcgaggccauuaagcggaaacugagaacccucauccuggcccccacccgcgucguggcuagcgaaauggccgaggcucuuaagggcaugccuauccgguaucaaacaacggccguuaaguccgaacauaccgggaaagagauuguggaucugaugugucacgcgacauucaccaugagacuccugagccccguccgggugccuaauuacaacaugaucauuauggacgaggcccauuuuacagauccgucuuccaucgcugcccgcggcuauauuagcaccagagugggaaugggcgaagcugccgccaucuucaugacggcuacacccccugggucugucgaggcguuuccccagagcaaugccguuauccaggacgaagagcgggauauuccugaacgcuccuggaacucuggauacgaguggaucaccgacuuccccggcaagaccgugugguuugugccgagcauuaaauccgggaaugauaucgcuaacugccugagaaagaauggaaaacgggucauucagcucucuagaaagacauucgacaccgaguaucaaaagacaaaaaacaacgacugggauuacgugguuaccacggacaucagcgaaaugggcgccaauuuccgcgccgaucgggugauugacccuagacgcugccuuaagcccgucauccugaaagaugggcccgagcgggugauccuggcuggcccuaugcccguuacaguggccuccgcggcucagagacgcggacggauuggcagaaaccacaauaaggaaggggaccaguacaucuauaugggacagccucucaacaaugaugaggaccaugcccacuggaccgaggccaaaaugcugcuugauaacauuaauacaccggaaggcaucauucccgcucuguuugagccugaacgcgagaagagcgccgcgaucgacggggaauacagacuccggggagaggcccgcaagaccuucgucgagcugaugagacggggcgaucugcccguguggcucucuuauaaagucgcuuccgaaggguuucaauacagcgaccgcagaugguguuucgauggcgagaagaacaaucaggugcuugaagagaacauggacguugaaaucuggacgaaagagggagagcggaagaaacugagaccucgcuggcuggacgcccggaccuauuccgauccccucgcucugagagaauuuaaggaguucgccgcuggccgccggucugugagcggggaccuuauucuggaaaucggaaaacucccgcagcaccugacacagagagcccaaaaugcgcuggauaaccucgugaugcuucauaauuccgagcagggcgggcgggccuaccgccacgcuauggaagagcugccugacaccauugagacacugaugcuccuggcccuuaucgcuguccugaccggaggcguuacacucuuuuuccugucuggcagagggcugggaaagaccagcauuggccuccuuugcgugauggccuccagcgugcugcuguggauggccucugucgaaccccauuggaucgcugcguccaucauucucgaguuuuuccugauggugcuucugaucccugaacccgauaagcagcggacgccucaggacaaccaacucgccuauguugugauugggcugcuguuuaugauccucacagucgcugccaaugagaugggacuucuggagaccaccaaaaaggaucugggcauugggcacguggccgucgaaaaccaccaucacgcugccaugcucgacguggaucugcaucccgcgagcgccuggacacuuuacgcuguugccaccacaaucauuacgccgaugaugcgccacaccaucgagaacacaaccgcuaauaucucucugacagccauugcgaaccaggccgcuauccucaugggacuggacaaaggcuggccuauuuccaagauggauaucggcgugccccugcucgcccuuggguguuacagccaggucaauccccugacccugacggcugccgugcucaugcugguugcucauuaugccauuaucggaccuggccuucaagcgaaagccaccagagaagcucagaagcggacagccgcugggaucaugaagaacccgaccguggacggaauugucgccaucgaucuggaccccgugguguacgacgccaaauucgagaagcagcucggccagauuaugcugcugauccucugcacaucucaaauucuucugaugcgcaccacgugggcgcugugugaaagcaucacacucgcuaccgggccucugacaacccuuugggagggaucccccggcaaauuuuggaauaccacaaucgccguuucuauggcuaacauuuucagaggcagcuaucuggccggggccggacucgcuuucucccugaugaagagccugggcgggggacggcgcggcacgggggcccagggagagacccucggcgaaaaauggaagagacagcuuaaucagcuguccaagucugaguuuaacacauacaaacggagcggcaucauggaagucgauagauccgaggcgaaggaagggcugaaacgcggagagaccacaaagcacgccgugucucggggcaccgcuaaacucagaugguucguggagcgcaaucuggucaagccugaagggaagguuauugaccuuggaugcggccgggggggauggagcuauuacugugccggccugaaaaaggugacggaggugaaaggcuauacaaaggggggacccggccacgaagagccuaucccgauggcuaccuacggguggaaccucgucaaacugcauuccggaaaggauguguuuuucauucccccugaaaaaugcgacacccugcucugugauaucggcgagucuagccccaauccuacaauugaggaagggagaacccuucgcguucugaagaugguggagcccuggcugcggggaaaccaauuuugcaucaagauccucaauccguacaugccuuccgucguggaaacacuggagcagaugcagagaaaacacggcggcaugcuuguucgcaacccccugagccggaauucuacgcaugagauguauuggguguccugugggaccggaaacauugucagcgccgugaauaugacaucuagaaugcuccugaaccgcuucaccauggcgcaccggaagcccacauacgaaagagacguggaucugggcgccgggacccgccacgucgcuguugagccugaaguggccaaccucgacaucauuggacagagaaucgagaauauuaaacaugaacacaaguccacguggcauuaugaugaggacaaccccuacaaaaccugggcuuaucacggcagcuacgaggugaagccuucuggguccgccagcuccauggucaauggagugguuaagcugcuuacaaaaccgugggaugugauccccauggucacccaaaucgcuaugacagacaccacaccuuuuggccagcagcggguguucaaggaaaaaguugacacccgcacgcccaaggccaaaagaggcacagcgcaaauuauggaggugaccgccaaguggcuguggggguuucucagccggaacaagaaaccuagaaucugcacccgggaagaguucacacgcaaggucagaucuaaugcugccauuggagcuguguuuguugaugaaaaccaguggaauagcgccaaagaggccguggaggacgaacgguucugggaucugguccaucgcgagagagaacuucacaagcagggcaaaugcgcgacguguguguauaacaugauggggaagcgggagaagaaacugggagaauuuggcaaggcuaaagggucccgcgccaucugguacauguggcucggcgccagauuccuggaguucgaggcucugggauuuaugaaugaagaccacugguucucucgggagaacagccucuccggcgucgaaggggagggacugcauaagcuuggcuacauucugcgcgauaucucuaaaauccccgggggaaauauguaugccgacgauaccgcuggcugggacacaagaauuaccgaggaugaccuccagaacgaagcccggaucacagauauuauggagccggaacacgcgcugcuugccaagagcaucuuuaaacugaccuaccaaaauaaggugguucgcgugcagagaccugcuaagaacgggacagucauggacgugauuucccggcgcgaucagagaggcucuggacaggugggcaccuaugggcucaauacguucaccaacauggaggcccaacugauccggcagauggaaagcgagggaaucuuuucccccagcgagcuggaaacaccuaaccucgcugagagaguucuggacuggcuugaaaaauacggcguggagcgccugaagcggauggccauuucuggggacgauugcgucgugaaacccaucgacgauagauucgcgaccgcccucacagcucugaaugacaugggaaagguucgcaaagauauuccucagugggaacccuccaagggcuggaacgacuggcagcaagugccguuuuguagccaucacuuccaccagcuuaucaugaaggaugggcgggagauugucgugccuugcagaaaucaggacgagcuggucggccgcgcccgggugucucagggagcuggcuggucccucagagaaaccgccugucuggggaaaagcuaugcucaaauguggcagcugauguacuuucaucgccgggaucucagacuggccgcgaacgccaucugcuccgcuguucccguggacuggauucccacgucucgcacaaccuggagcauccacgcccaucaccaguggaugacaaccgaggauaugcuuuccgucuggaaucggguguggaucgaagagaacccuuggauggaagacaagacgcauauuagcucuuggggagacguuccguaucugggcaaaagagaggaucaauggugugggucccucaucggacugaccgcccgggcuacaugggccaccaauauucagguggcgaucaaccaggucagacgccuuauuggcaaugagaacuaccuggacuacaugacaagcaugaagcgguucaaaaaugaaucugaucccgagggggcucucugguga

SEQ ID NO: 19238 - RNA, 9879 nt, Artificial Sequence
  derived and/or modified CDS sequence (opt5) from DENV-1__GU131811__SS-prME
agcgugaccaugcugcugaugcugaugcccacggcccuugcuuuccaccugacgacccggggaggggagccucauaugaucgucuccaagcaggaacggggaaaaucucuccuguuuaagacaagcgccggcguuaacaugugcacccuuauugccauggaccugggggaguucugugaagauacaaugaccuacaaaugcccgcgcaucacagaggcugaacccgacgauguggacuguuggugcaaugccaccgauacgugggugaccuauggaacauguucccaaauuggcgagcacagacgggacaagcgcucugucgcccucgcuccucauguggggcugggacuggagaccagaacagaaaccuggaugagcuccgagggcgccuggaaacagauccagcggguugaaacgugggcucuccgccaccccggcuuuacagugauugcccuguuccuugcgcaugccaucgggaccucuaucacacagaagggaauuaucuuuauucugcucaugcuggucaccccuagcauggcuaugagaugcgugggcaucgggucccgggauuucguugagggacuuagcggcgccaccuggguggacgucgugcuggagcacgggucuugugugacaacgauggcuaaggauaaacccacccucgacauugaacugcugaagacagaggucaccaacccugccguucuccgcaaacugugcaucgaagcgaagauuuccaauacaaccacggauagcagauguccgacacaaggagaggccacccuuguggaggaacaggacgcuaacuuugugugccggcgcaccuucgucgauagaggcuggggcaauggguguggacuguuuggcaaagggucucucaucacaugcgccaaguucaagugcgugaccaaacuggagggaaagaucguucaguacgaaaaccuuaaauauuccgugauugucacagugcacacgggcgaccagcaucaaguugggaaugagagcaccgaacacggaacaaccgcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgccaggaccuucuggugaccuuuaaaacagcgcacgccaagaagcaggaagucgugguucucggaucccaagagggcgcuaugcacaccgcccugaccggggccacagaaauccagacgagcggaaccacaaccauuuucgcuggccaucugaaaugcagacucaagauggauaaacugacacuuaaggggaugucuuaugugauguguaccggcuccuucaaacuggagaaggaagucgccgagacgcagcacggaacagugcucguucagaucaaguacgagggcaccgacgcgccgugcaaaaucccuuuuagcacccaagaugaaaagggggugacacagaacggacggcugauuaccgcuaaucccaucgucacagacaaagagaagccugugaacauugaagccgagccgcccuucggcgagucuuauaucgugauugggguuggagaaaaagcccugaaacuuagcugguuuaagaaaggcuccucuaucgggaagauguucgagacgaccgcuagaggcgcccgccggauggcuauccucggagauacagccugggacuuuggcagcauugggggagucuucaccuccgugggcaaacuggugcaucagaucuuugggacagcguacggaguccuguucagcggcgugucuuggaccaugaagauugggaucggcguucuccugacguggcuuggacucaauuccagaagcaccucucucuccaugacauguauugccgugggccuggucacccuguaccuuggggugaugguucaggcugauagcggaugcgugaucaacuggaaaggccgcgaacucaaguguggguccggaauuuuugucacaaaugaggugcacaccuggacagaacaauauaaguuccaggccgacucuccuaaacggcugagcgcugccaucggcaaggcgugggaggaggggguuugcggcaucagauccgccacccgccuggaaaacauuauguggaaacagaucucuaacgagcucaaucauauucugcuugaaaacgacaugaagcugacgguggucgugggagauguggcuggcauccucgcccaggggaaaaagaugauucggccgcaacccauggaguacaaauauagcuggaaguccuggggaaaggcuaaaaucaucggcgccgacguccagaauacaaccuuuauuaucgaugggccuaacacccccgaauguccugacgaucagagagccuggaauauuugggagguugaggacuacggauucggcaucuuuacaaccaacauuuggcugaagcugcgcgauagcuauacacaggugugcgaccaccggcuuaugucugcugcgaucaaagauuccaaggccgugcacgcugacaugggcuacuggaucgaaagcgagaaaaaugaaacauggaagcucgccagagccucuuucauugaggucaagaccuguaucuggcccaaaucccauacacuguggagcaacggggugcuggaaucugagaugauuaucccgaagauuuauggaggcccuaucagccaacacaauuaccgccccggguacuucacccagacagcuggaccuuggcaucucggcaaacuggagcuugauuuugaccugugcgaagggaccacgguuguggucgaugagcacugcggaaaccggggccccucccucagaaccacaaccgugacaggcaagaucauucacgaaugguguugccggagcuguacccugccuccccugcgcuucaaaggggaggacggaugcugguauggcauggagaucagaccgguuaaggaaaaggaggaaaaucuugugaaaucuauggucuccgccgggagcggagagguggacuccuuuucucucggccugcuguguauuagcaucaugauugaagagguuaugcgguccagauggucucgcaagaugcucaugacggggacacuggcgguguucuuucuucugaucaugggacagcucaccuggaacgaucugauucggcugugcaucauggucggcgcuaaugccagcgacagaaugggcauggggacaaccuaccuugcccugauggcuaccuucaaaaugcgcccuauguuugccgugggacuccuguucagacggcucacaucccgcgaggugcugcuucugacgaucggccucucucuggucgcgagcguugaacugcccaacucccuugaggaacugggggauggacucgcuaugggcauuaugauccugaagcuccugaccgacuuucaaagccaucagcuuugggccacacugcucucuaugaccuucauuagaacaaccuuuucccugcacuaugccuggaaaacgauggcuauggugcugagcaucgugucucuuuucccccugugucucuccacaaccagccagaagaccacauggcugccuguccuccuggggucucuuggaugcaagccgcugaccauguuucugauugccgagaauaaaaucuggggccggaaguccuggccccucaacgaaggcaucauggcuguggggauuguuagcauccugcuuuccagccugcucaaaaacgaugugccucuggccggaccccucauugcgggcgggaugcugaucgccuguuacgucauuucuggaagcuccgcugaccuuucucuggagaaggccgcugugguuagcugggaggaagaggccgaacauuccggcgccucucacaauauccugguggagguccaggaugacgggacaaugaaaaucaaggaugaagaaagagacgauacgcucaccauucugcuuaaagcuacacugcucgcggugagcggagucuauccucuguccauccccgccacccucuucgugugguacuucuggcaaaagaagaaacagagaucuggcguucugugggacacaccuuccccucccgagguggaacgggcuguccuugaugacggcauuuaucgcaucaugcagagagggcugcugggacggucccaggugggcguugggguguuucaagagaacgucuuccauaccauguggcacgugacgcgcggagccgugcucauguaccagggcaagagacuggaacccagcugggccucuguuaaaaaggaccuuauuuccuacgggggaggcuggcggcugcagggcagcuggaauaccggggaggagguccaggugaucgcuguggaacccggcaagaauccuaagaauguccaaacagcccccggcaccuuuaagacaucugagggggaagugggagcgauugcucucgauuucaaaccgggcaccuccgggagcccuaucguuaacagagagggaaagguggucggccuguauggcaauggggugguuacaacguccggaaccuacgugucugccaucgcccaggcuaaagccagccaggaaggcccccucccugagauugaggacgaagucuuucgcaagcggaaccugacaaucauggaucuucaccccggguccggaaaaaccagacgcuaucugcccgcgauugugcgggaggcuaucaagagaaagcugcgcacccucauucuggccccuacacggguuguggccagcgaaauggcugaggcccuuaaaggcaugccgaucagauaccaaacgaccgcugucaagucugaacauacagggaaagagaucguggaccugaugugccacgccaccuucacaaugcgccuccugucccccgugcgggucccuaauuauaacaugauuaucauggaugaggcgcauuuuaccgaccccagcucuauugccgcuagaggcuacaucagcacgcggguuggaaugggcgaagccgcugccauuuucaugacagccaccccucccggguccguggaggcuuuuccucagucuaaugcggugauccaggaugaggaacgcgacaucccggaaagaagcuggaacuccggauaugaguggauuaccgauuuccccggcaagacagucugguuugugccuucuaucaaaagcgggaaugacauugccaacugucugcggaagaauggaaagcgcguuauccagcucuccagaaaaaccuucgauacagaguaccaaaagaccaaaaacaacgacugggacuacguggucacgacagauauuagcgaaaugggcgcuaauuuccgggccgacagagugaucgauccccgccggugccuuaagccuguuauucugaaagacgggcccgagagagugauccuggccggcccgaugccugucaccguggcuucugccgcgcagcgccggggaagaaucggccgcaaccacaauaaggaaggggaucaguauauuuacaugggacagccccucaacaaugacgaggaucaugcucacuggacagaggccaagaugcugcuugacaacaucaauacccccgaaggcauuaucccugcccuguuugagcccgaacgggagaaauccgcugccauugauggggaauauagacuccgcggagaggcgagaaagacguucgucgagcugaugcggcgcggcgaccugccuguguggcucagcuacaaaguugccuccgaaggguuucaauauucugauagacgguggugcuucgacggcgagcgcaacaaucaggugcuugaagagaacauggauguggaaaucuggaccaaggagggagagcgcaagaagcugcggccgagauggcuggacgcucgcacauacagcgacccccucgcccugcgggaauuuaaagaguucgcugccggcagacgcuccgucucuggggaucuuauccuggaaauuggaaagcucccucagcaccugacccagcgggcucaaaaugcccuggacaaccucguuaugcuucauaauagcgagcagggcgggagagcguaucggcacgccauggaggaacugcccgauacaaucgagacccugaugcuccuggcucuuauugccgugcugacaggaggcgugacccucuuuuuccuguccggccgcgggcugggaaagacgagcaucggccuccuuugugucauggcuucuuccgugcugcuguggauggccagcguugaaccucauuggauugccgcuucuaucauccucgaguuuuuccugauggugcuucugauucccgaaccggacagacagcggacaccucaggauaaccaacucgcguacgucgugaucgggcugcuguuuaugauucucaccgucgccgcuaaugagaugggacuucuggagaccaccaagaaggaccugggcaucgggcacguggccguugaaaaccaccaucacgccgcuaugcucgauguggaccugcaucccgccuccgcguggacccuuuacgccgucgcuacaacgauuaucaccccuaugaugcgccacacaauugagaacaccacagccaauaucagccugaccgcuaucgccaaccaggcggccauucucaugggacuggauaaaggcuggcccaucucuaagauggacauuggcgugccucugcucgcucuugggugcuauagccagguuaauccccugacgcugaccgccgcugugcucaugcuggucgcccauuacgcuaucauuggaccgggccuucaagccaaagcgacaagagaagcccagaagcggaccgcugccgggaucaugaagaacccuacaguggauggaaucguggcuauugaccuggaucccguugucuaugacgccaaauucgagaagcagcucggccagaucaugcugcugauucucuguaccucccaaauccuucugaugcgcacgacaugggcccugugcgaaucuauuacccucgcgacagggccccugaccacccuuugggagggaagcccuggcaaauuuuggaauacaacgaucgcuguguccauggccaacaucuucagaggcagcuaccuggcuggggccggacucgccuucucccugaugaagucucugggcgggggacggcgcggcaccggggcucagggagagacacucggcgaaaaauggaagagacagcuuaaucagcugagcaaguccgaguuuaacaccuauaaacggucuggcauuauggaaguggacagaagcgaggccaaggaagggcugaaacgcggagagacaaccaagcacgcggucucccggggcacggccaaacucagaugguucguugagcgcaaucuggugaagccggaagggaaggugaucgaucuuggauguggcagagggggauggucuuacuauugcgcuggccugaaaaaggucacagaggugaaaggcuacaccaaagggggacccggccacgaggagccuauucccauggccaccuacggguggaaccucguuaaacugcauagcggaaaggacguguuuuucaucccucccgaaaaaugugauacacugcucugcgacauuggcgaguccagcccuaauccgaccaucgaggaagggagaacacuucgcguccugaagaugguggagcccuggcugcggggaaaccaauuuuguauuaagauccucaauccuuauaugcccucuguuguggaaacgcuggagcagaugcagagaaaacacggcggcaugcuuguccgcaacccucugucccggaauagcacccaugagauguacugggugucuugcgggacaggaaacaucguguccgcugucaauaugaccagcagaaugcuccugaaccgcuucacaauggcccaccggaagcccaccuaugaaagagauguugaccugggcgcggggacgcgccacguggccguggagccggaagucgcuaaccucgauauuaucggacagagaauugagaauaucaaacaugaacacaagucuaccuggcauuacgacgaggauaacccuuauaaaacaugggccuaccacggcuccuaugaggugaagcccagcggguccgcuagcucuaugguuaauggaguggucaagcugcuuaccaaacccugggacgugauuccuaugguuacacaaaucgccaugaccgauacaacccccuuuggccagcagcggguguucaaggaaaaagucgacacgcgcacaccuaaggcuaaaagaggcaccgcccaaaucauggaggugaccgcgaaguggcuguggggguuucucagccggaacaagaaaccgagaauuuguacacgggaagaguucacgcgcaagguuagauccaaugccgcuaucggagccguguuugucgacgaaaaccaguggaacucugcuaaagaggccguggaggaugaacgguucugggaccugguccaucgcgagagagaacuucacaagcagggcaaaugcgcgaccugcguguacaacaugauggggaagcgggagaagaaacugggagaauuuggcaaggcgaaagggagccgcgcuauuugguacauguggcucggcgccagauuccuggaguucgaggcccugggauuuaugaaugaagaucacugguucucccgggagaacucucucagcggcguugaaggggagggacugcauaaacuuggcuauauccugcgcgacauuuccaaaauccccgggggaaauauguacgcugaugacacagccggcugggauaccagaaucacagaggacgaucuccagaacgaagcuaagauuaccgacaucauggagccugaacacgcccugcuugcgaaaucuauuuuuaagcugacauaucaaaauaaggugguccgggugcagcgccccgccaaaaacgggaccgugauggauguuaucagcagacgggaccagcgcggcuccggacaggugggcacguacgggcucaauaccuucacaaacauggaggcucaacugauuagacagauggaaagcgagggaaucuuuucuccuuccgagcuggaaacccccaaccucgccggccgggcucuggauuggcuugagaagcauggggucgaaagacugaaacgcauggccaucagcggagacgacugugugguuaagccgauugaugaccgguucgcgacagcccucaccgcucugaaugauaugggcaaagugagaaaggacaucccucagugggagcccucuaagggguggaacgauuggcagcaagucccuuuuugcucccaccacuuccaucagcuuauuaugaaagacggccgcgaaaucgugguccccugucggaaucaggaugagcuggugggcagagcccgcguuagccagggagcuggguggucccuccgggagacggccugccugggaaagucuuaugcucaaauguggcagcugauguacuuucacagacgcgaccuccggcuggccgcgaacgccauuuguagcgcugugccugucgauugggugcccacauccagaaccacauggagcauccaugcccaccaucaguggaugaccacggaagacaugcuuucuguuuggaaucgcguguggauugaggaaaacccguggauggaggauaaaacccacaucuccagcuggggcgacgucccuuaucuggggaagcgggaagaccaauggugcggaucucucaucggccugacagccagagcuaccugggccacaaauauucagguggcgaucaaccaggugcggagacuucuggggaaugagaacuaccucgauuacaugaccagcaugaaacgcuucaagaaugaguccgaccccgaaggcgcucugugguga

SEQ ID NO: 19239 - RNA, 9882 nt, Artificial Sequence
  derived and/or modified CDS sequence (opt5) from DENV-1__JF937615__SS-prME
uccgugaccaugcugcucaugcugaugcccacagcccuugcuuuccaccugacgacccggggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcauugaagcgaagaucuccaacaccacgacagacagcagauguccgacccaaggagaggccacccuuguggaagaacaggaugcuaauuuugugugccggcgcacauucgucgacagaggcuggggcaacggguguggacuguuuggcaaagggucucucaugaccugcgccaaguucaagugcgugacaaaacuggagggaaagauuguucaguacgaaaaucuuaaauauuccgugaucgucacggugcacaccggcgaccagcaucaaguugggaacgagagcacagaacacggaaccacagcuaccaucacgccccaggccccuucuaccgagauucagcugacagauuacggcgcccucacccuggacuguagcccccggacaggccuggauuuuaaugaaauggugcuccugaccaugaaggagaaaagcuggcuuguccauaagcagugguuccuggaccucccucugcccuggacguccggggcuucuacaagccaagagaccuggaaccgcaaagaucuucuggugacauuuaagaccgcgcacgccaagaaacaggaagucgugguucucggaucccaggagggcgcuaugcacaccgcccugacaggggccacggaaauccaaaccagcggaacaaccacaauuuucgcuggccaucugaagugcagacucaaaauggacaagcugacccuuaaagggaugucuuaugugauguguacggauuccuucaagcuggagaaggaagucgccgagacacagcacggcaccgugcucguucagaucaaauacgagggaaccgacgcgccgugcaagauuccuuuuagcacacaggaugaaaaaggcgugacccaaaaugggcggcugaucacagcuaaccccaucgucacggacaaggagaaaccugugaauauugaagccgagccgcccuucggagagucuuauaucgugauuggcgccggggaaaaggcucugaaacuuagcugguuuaaaaagggauccucuaucggcaaaauguucgaggccaccgcuagaggggcccgccggauggcgauucucggcgauacagccugggacuuuggaagcaucggcgggguuuucaccuccgucggaaagcuggugcaucagaucuuuggcacagcuuacggggugcuguucagcggagucucuuggaccaugaaaauuggcaucggggugcuccugacguggcuuggccugaacuccagaagcaccucucucuccaugacauguauugccguuggacuggugacccuguaccuuggcgucauggugcaggcugacagcgggugcguuaucaauuggaagggacgcgaacucaaguguggcuccgggauuuuugugacaaacgagguccacaccuggacagaacaguauaaauuccaagccgauucuccuaagcggcugagcgcggccaucggaaaggcuugggaggagggcgugugcgggauuagauccgccacccgccuggaaaauaucauguggaagcagaucucuaacgagcucaaccauauucugcuugaaaaugacaugaaauuuacgguuguggucggcgauguggcuggaauccuggcccagggcaagaaaaugauucggccgcagcccauggaguacaaguauagcuggaaguccugggggaaagccaagaucauuggagcugacgugcaaaacacaaccuucaucaucgauggcccuaauacccccgaauguccugacgaucagagagcguggaacauuugggaggucgaggacuacggguuuggaaucuucacaaccaauauuuggcucaaacugcgcgauagcuauacgcagguuugcgaccaccggcugaugucugccgcuaucaaggauuccaaagccgugcacgccgacaugggcuacuggauugaaagcgagaagaacgaaacauggaaacuugcuagagccucuuucaucgaggugaaaaccuguaucuggcccaagucccauacacucuggagcaauggcguccuggaaucugagaugauuaucccgaaaauuuaugggggaccuaucagccagcacaacuaccgccccggcuacuuuacccaaacagcggggccuuggcaucugggaaagcucgagcuggauuucgaccuuugcgaaggcaccacggugguuguggacgagcacugcgggaaucggggacccucccugagaaccacaaccgucacaggcaaaauuauccacgaaugguguugccggagcuguacccucccuccccugcgcuuuaagggcgaggaugggugcugguauggaauggagaucagaccggugaaggaaaaagaggaaaaccugguuaagucuaugguguccgcuggcagcggggaggucgacuccuucucucuuggacuccuguguauuagcaucaugauugaagaggugaugcgguccagauggucucgcaaaaugcugaugacgggcacacucgccgucuuuuuccugcuuaucauggggcagcugaccuggaaugaucucauucggcugugcaucauggugggagccaacgcuagcgacagaaugggcaugggcacaaccuaccuggcccuuauggcgaccuuuaagaugcgcccuauguucgcugucgggcugcucuuuagacggcugacaucccgcgaggugcuccugcuuacgauuggacugucucucguggccagcgucgaacugcccaauucccuggaggaacuuggcgaugggcuggccaugggaaucaugauccucaaacugcucauugacuuccagagccaucaacugugggcuacccuucugucucucacauuuaucaagaccacauucucccugcacuaugccuggaagaccauggcuaugguucugagcauugugucucuuuuuccccugcucccugugcaugaucugccgaaaaagacgacauggcuccccguccugcuuggcucccugggguguaaaccucugaccauguuccucaucgccgagaacaagauuuggggaagaaaaagcuggccccugaaugaaggcaucauggcggugggcaucguuucuauucuucuguccgcccuccugaagaacgacgugccucucgcugggccccugaucgccggaggcaugcuuauugcuugcuacgucaucagcggguccagcgccgaucugucucuggagaaagccgcugaggugagcugggaagaggaagcggagcacuccggagccucucauaacauucucguugaagugcaggacgauggcaccaugaagaucaaggacgaggagcgggaugacacacugaccauccuucugaaagcuacacuccuggccgucagcgggguguauccucucuccauucccgccacgcuguucgucugguacuuuuggcagaagaaaaagcagcgcucuggagugcuuugggacaccccgagcccucccgaaguugagagagcugugcuggaugacggcaucuaucggauuaugcaacgcggccugcucgggagaucccaggucggagugggcguuuuccaggaaaauguguuucacacaauguggcacgucaccagaggggcggugcugauguaccagggaaaacgccuugagccuucuugggcgagcgugaagaaggaucugaucuccuacggcgggggauggagacuccaaggcagcuggaacacaggcgaggaaguucaggucauugcuguggagcccgggaaaaauccgaagaacgugcagaccgccccuggaacguucaaaaccucugaaggcgaggucggggccaucgcucuggacuuuaagcccggaacauccggcagcccuauugugaaucgggaagggaaaaucguuggacucuauggcaacggcguggucaccacaucugggaccuacguguccgccaucgcgcaggcuaaggccagccaagagggaccccugcccgagauugaagaugagguuuucagaaagcgcaaucuuacaaucauggaccugcauccuggcuccgggaaaacgcggagauaucugccggccauugugcgcgaagcuaucaagcggaaacucagaacccugauucuugcccccacacgcgucguggcuucugagauggccgaagcgcugaagggaaugccuauccgguaccagaccaccgccguuaaaagcgagcacacaggcaaggagaucguggaucucaugugucaugcuacguuuaccaugagacugcugucccccguccgcgugccuaacuauaauaugauuaucauggacgaagcccacuucacagaucccagcucuauugcugcccggggguacaucuccaccagagugggcaugggagaggccgcugcgauuuuuaugacagccaccccuccgggcagcgucgaggcuuucccccagucuaacgccguuauccaagacgaagaacgggauaucccugagcgcagcuggaacuccggguaugaguggauuacggacuuucccggaaagacagugugguucgugccuucuaucaaaagcggcaacgacauugccaauugccucagaaagaacgggaaacgggucauccagcuuucccgcaagaccuucgauaccgaauaccagaaaacaaagaauaacgacugggauuacgugguuaccacagacauuucugagaugggagcuaacuuuagagccgaucgggugaucgaccccagacgcugucugaagccggucauucugaaagauggcccugaacgggugauccucgcggggcccaugcccguuaccguggcuagcgccgcccagagacgcggccggaucggaagaaaucauaacaaggagggcgaccaauauauuuacauggggcagccucugaauaacgaugaggaccacgcucacuggacggaagccaaaaugcuucuggauaauaucaacacacccgagggaauuaucccugcccucuucgaaccggagcgcgaaaaguccgccgcuauugacggcgaguaucggcugagaggggaggcccgcaaaaccuuugucgaacugaugagacggggagaucuccccguguggcuuagcuacaaggucgcuucugagggcuuccaguauuccgaccgcagauggugcuuugacggggaacggaauaaccaggugcuggaggaaaauauggauguugagaucuggacaaaagagggcgaacgcaagaagcugagaccucgguggcucgacgccagaaccuacagcgauccccuggcccuucgcgaguucaaagaauuugccgcgggacggagauccgugucuggcgaccugauccucgagauugggaagcugccucaacaucugacgcagcgcgcccagaacgcucucgauaaucuugugaugcugcacaacagcgaacagggaggccgggccuauagacaugcuauggaggagcugcccgacaccaucgaaacacucauguuccuggcccuuauugccguccugaccgggggaguuacacucuuuuuccuguccggccggggccuggggaaaaccucuaucggacuccuuugcgugauggcuagcuccgugcugcuguggauggcgagcgucgagccgcacuggauugccgcuucuaucauccucgaauuuuuccugauggugcuucugauuccugagcccgaucgccaaagaacaccucaggacaaucagcucgccuacguugugaucggccugcuguuuaugauucucaccgucgccgcuaacgagauggggcuucuggaaacgacaaagaaagaucugggaaucggccacguggccgucgagaaucaucaccaugcggccaugcucgacguggaucugcaccccgcuuccgccuggacccuuuacgcuguugccaccacaauuaucaccccuaugaugcggcauacaauugaaaacacgaccgcgaacaucagccugacagccaucgcuaaucaggccgcuauucucauggggcuggacaagggauggcccaucucuaagauggauauuggcgugccgcugcucgcccuuggcuguuauucccaagucaacccucugacccugacagcugccgugcucaugcugguugcgcacuacgccaucauugggcccggacuucaggcuaaagccacccgcgaggcucagaagagaacggccgccggcaucaugaaaaaucccaccguggacgggaucgucgcgauugaccuggauccugugguguaugacgcuaaguucgaaaaacaacucggacagaucaugcugcugauucucugcacaagccagauccuucugaugcggaccacaugggcccugugugagucuauuacccucgcuacgggcccgcugacaacccuuugggaggggagccccggaaaguucuggaacacaaccaucgccguuuccauggccaauaucuuucgcggcucuuaccuggcuggcgccgggcucgcguucagccugaugaagucccugggaggcgggagacggggaaccggcgcccagggggaaacacucggagagaaauggaagcgccaacuuaaccagcugagcaaauccgaauuuaauacguauaagagaucuggcauuauggaggucgaucggagcgaagcuaaagagggccugaagagaggggagaccacaaagcacgccgugucccgcggaaccgcuaaacuccggugguucguggaaagaaaccuggucaagccugagggcaaaguuaucgaccuugggugcggacgcggcggguggucuuacuauugugccggacugaagaaagugacagaagugaagggcuacaccaaaggcgggcccggacaugaggaaccuauucccauggcgacguacggcuggaaucucgucaagcugcacagcgggaaggauguguuuuucaucccuccggagaaaugcgacacacugcucugugauauuggagaguccucucccaacccuaccaucgaagagggccggacccuuagaguucugaagaugguggaacccuggcugcgcgggaaucaguuuugcauuaaaauccucaacccuuauaugcccagcgucguggagacacuggagcagaugcaacggaagcauggaggcaugcuuguuagaaauccgcugucccgcaacagcacccacgaaauguacugggugucuuguggcacagggaauaucgucuccgccgugaacaugacgagccggaugcuccugaauagauucaccauggcucaccgcaaaccuacauaugagcgggacguggaucugggagccggcaccagacaugucgcuguugaacccgagguggccaaccucgacauuaucgggcagcgcauugaaaacaucaagcacgagcauaagucuacauggcacuacgaugaggacaaucccuauaaaaccugggcuuaccauggauccuaugaagugaagccuagcggcucugccuccagcauggucaacggggugguuaaacugcuuacgaagcccugggacgugauuccuauggucacccagaucgcgaugacagauaccacaccguuuggacagcaaagaguguucaaagagaagguugacacccggacacccaaggccaaacgcggcaccgcucagaucauggaagugacggccaaguggcuguggggcuuucucuccagaaauaaaaagccucggauuugcacaagagaggaguucacccggaaaguccgcagcaacgcugccaucggggccguguuuguugaugagaaucaguggaacucugcgaaggaggcuguggaagacgagagauucugggaucugguccaccgggaacgcgagcuucacaagcaaggaaaaugugcuaccugcguguacaauaugaugggcaagagagagaagaagcugggggaguucggaaaagccaagggcagccgggcuauuugguacauguggcucggggcccgcuuucuggaguucgaagcucugggcuuuaugaacgaggaccauugguucuccagagaaaauucucucagcggagucgagggcgaggggcugcacaaacuuggauauauccugcgggauauuuccaagauccccggcgggaacauguacgccgacgauacagcgggaugggacacgcgcaucaccgaagaugaccuccagaaugaggccaagauuacagauaucauggaaccugagcaugcucugcuugccaaaucuauuuuuaagcugaccuaucagaacaaagugguuagagugcagcggcccgcuaagaauggcacagucauggacgugaucagccgcagagaccaacggggguccggccaggugggaaccuacggccucaacacauucaccaauauggaagcccagcugauucgccagauggagucugaggggaucuuuagcccguccgaacuggagacgccuaaccucgcgggaagaguucuggauuggcuugaaaaacacggcguggagcggcugaagagaauggccaucagcggggacgauugcgucgugaagcccauugacgaucgcuucgcugccgcucucaccgcccugaacgacaugggaaaaguucggaaggauaucccucaaugggaacccucuaaaggcuggaaugacuggcaacaggugccuuuuuguucccaccauuuccaccagcuuauuaugaaggaugggagagagaucgucgugcccugccgcaaccaagacgagcuggucggccgggcuagagugagccagggagccggcuggucucuccgcgaaacagcgugucuggggaaauccuaugcccagauguggcagcugauguacuuucaucggagagaucuccgccuggcugccaaugccauuugcagcgcuguuccgguggacugggucccuaccucccggacaaccuggucuauccacgcccaucaccaauggaugacgacagaggacaugcuuagcguguggaacagaguuuggauugaagagaaucccuggauggaagauaagacccacaucuccagcuggggagacgugcccuaucugggcaagcgcgaggaucaguggugugggucucucaucggacugacagcgcgggcuaccugggccacgaacauucaggucgccaucaaucaagugagacggcuuauuggcaacgagaauuaccuggacuacaugaccuccaugaaaagauucaagaacgaaagcgauccugagggggcucucugguga

SEQ ID NO: 19240 - RNA, 9879 nt, Artificial Sequence
  derived and/or modified CDS sequence (opt5) from DENV-1__GU131814__SS-prME
agcgugaccaugcugcucaugcugaugcccacagcgcuugcuuuccaccugacgaccagaggcggggaaccucauaugaucguguccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacaacccccggcacauucaagacgccggaaggggaggugggagcgauugcucucgauuuuaagccuggcaccagcgggucucccaucgugaaccgcgaaggaaaaaucgucggccuguauggcaauggggugguuacaaccuccggaaccuacgugagcgccauugcccaggcuaaggccucccaggagggcccucuucccgagaucgaagacgaggucuuccggaaaagaaaccugacaauuauggaucugcaccccgggucuggaaagacgcgccgguaucucccugcgaucgugagagaagcuauuaaacgcaagcugcggacccuuauccuggccccgacaagaguuguggccagcgagauggcugaagcccucaagggcaugcccauccgcuaccaaaccacagcugucaaauccgagcauaccgggaaggagauuguggaccugaugugccacgccacguuuacaaugcggcugcucagcccuguuagagugcccaauuauaacaugaucauuauggaugaagcgcauuucaccgacccuucuuccaucgccgcucggggcuacauuagcacccgcgucggaaugggcgaggccgcugccaucuuuaugacagccacacccccugggucuguggaggcuuucccgcagagcaaugcggugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacguuugauacagaauaccagaaaaccaagaacaacgacugggacuacguggucacaaccgauaucagcgagaugggcgcuaauuucagagccgaccgcgugauugauccucggagaugccugaaacccguuauccucaaggacgggccggaacgcgugauccuggccggcccuaugcccgucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacaccugagggcaucauucccgcccuguucgaaccugagagagaaaagagcgcugccaucgauggggaguaucgccugagaggagaggcgcggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcucaaaaugcccuugacaaccugguuaugcugcauaauuccgaacagggcgggcgggcguaucgccacgccauggaggagcucccugauaccauugaaacgcugaugcuucuggcucucaucgccgugcugacaggaggcgugacccuguucuuucucucuggcagagggcuuggaaagaccagcauuggccugcugugugucauggcuuccagcguucuccuguggauggccucuguggagccccauuggaucgccgcuuccaucauucuugaguucuuucugauggugcuccugaucccggagccugaccggcagcgcacaccccaggauaaccaacuggcguacgucgugauugggcuccuuuucaugauccugaccguugccgcuaaugagaugggacugcucgaaacaacgaagaaagaccugggcauugggcacguggccgucggaaaccaccaucacgccgcuaugcuugauguggaccugcauccugccagcgcguggacccucuacgccgucgcuacaaccaucauuacacccaugaugagacacaccaucgagaacacgaccgccaauaucucucugacagcuauugccaaccaggcggccauccugaugggccucgauaagggcuggccuauuuccaaaauggacaucggggugccccuucuggcucugggaugcuauagccagguuaauccgcucacccugacagccgcugugcuuaugcuggucgcccauuacgcuauuaucggcccugggcuccaagccaaggcgacccgggaagcccagaaacgcacggcugccggaaucaugaagaaccccacaguggauggcauuguugcuaucgaccuggaucccguggucuaugacgccaaguuugagaaacagcuggggcagauuaugcuccuuauccuguguaccucucaaauucugcucaugagaacaaccugggcccugugcgaaagcaucacccuugcgacaggaccucugacgacccucugggagggcuccccgggcaaguucuggaauacaaccaucgcugugucuauggccaacauuuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggaucauggaaguggaccgcuccgaggccaaagaaggacugaagcggggcgagacaaccaaacacgcgguuucuagagggaccgccaaacuucgcugguuugucgagcggaaucuggugaaacccgaaggaaaggugauugaucucggcugugggagaggaggcuggagcuacuauugcgcuggccugaagaaagucacagagguuaagggguacaccaaaggaggcccugggcacgaagaacccaucccuauggccacauacggauggaaccuggugaagcuccauuccggcaaagacguguucuuuauucccccugaaaagugugauacgcuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcugugaauaugacgucucgcaugcugcucaaccgguuuaccauggcccacagaaaaccgacauaugaacgcgaugucgaccugggggcgggaaccagacacguggccguggagccugaagucgcuaaccuugauaucauuggccagcggaucgagaauauuaagcaugaacacgaguccacauggcauuacgacgaggauaaccccuauaaaaccugggccuaccacgggagcuaugaaguuaagcccucuggauccgcuagcuccauggugaauggcguggucaaacugcucacaaagccuugggacgugauccccaugguuacccaaaucgccaugacggauacaaccccuuucggccagcagcgcguguuuaaggagaaagucgacaccagaacaccgaaggcuaaacgggggacggcccaaauuauggaagugaccgcgaaguggcuguggggauuccuuagcagaaacaaaaagccccggaucuguacacgcgaggaauuuaccagaaagguucggucuaaugccgcuauuggcgccguguucgucgacgagaaccaguggaauagcgcuaaagaggccguggaagaugagcgcuuuugggaccugguucauagagaacgggagcuccacaagcaggggaaaugcgccacaugcguguacaacaugaugggaaagcgcgagaaaaagcugggcgaguucgggaaggcgaaaggcuccagagcuaucugguacauguggcugggagcccgguuucucgaguucgaagcccugggcuucaugaaugaggaucacugguuuucucgcgaaaacagccuuuccggggucgagggagagggccugcauaagcucggguauauucugagagacaucucuaaaaucccuggaggcaauauguacgcugaugacaccgccgggugggauacacggauuaccgaagacgaucuucagaacgaggcucgcaucacggacauuauggaacccgagcacgcccugcucgccaagagcaucuucaaacugaccuaucaaaauaagguggucagagugcagcggccugccaaaaacggcacaguuauggaugugauuucccgcagagaccagcggggaucuggccaggucgggaccuacggacugaauacauuuaccaacauggaagcucaacucaucagacagauggagagcgagggcaucuucucccccagcgaacuggagacgccgaaccuugccgaacgcgugcuggauuggcucgagaaguaugggguggaacggcugaagagaauggcuauuucuggagacgacuguguugugaaaccuaucgaugaccgcuuugccacagcgcuuaccgcccugaaugauaugggcaagguccggaaagacauuccccagugggagccuuccaagggguggaacgauuggcagcaagugcccuucugcagccaucacuuucaccagcucaucaugaaagacggcagagagauuguugugccuugucgcaaucaggaugaacuggucggacgggcuagagugucucagggcgccggguggucccugcgcgagacagcuugccucggaaagagcuacgcccaaauguggcagcugauguauuuccaucggagagaccuucgccuggcugccaacgcgaucuguuccgccguccccguggauuggauuccgaccucucggacgaccuggagcauccacgcucaucaccaguggaugacaaccgaagacaugcucuccguuuggaauagaguguggaucgaggaaaacccuuggauggaggauaagacacauauuagcucuuggggcgacguccccuaccuggggaaacgggaggaccaauggugcggaucccuuaucggccugaccgccagagccacaugggcuaccaauauucagguggccaucaaccagguucgccggcucauugggaaugaaaacuaccuggauuauaugacgagcaugaagagauuuaaaaaugagucugaccccgaaggcgcgcugugguga

SEQ ID NO: 19241 - RNA, 9879 nt, Artificial Sequence
  derived and/or modified CDS sequence (opt5) from DENV-1__GU131815__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggagcucugugaagauaccaugaccuacaaaugcccgagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgcggcuugagggaaaaaucguucaguacgaaaaccugaaguauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccgcacgggccucgacuucaacgaaauggugcugcuuacaaugaaagagaaguccuggcugguccauaaacagugguuucucgaucugccucuucccuggaccagcggggccuccacaucucaagagaccuggaauagacaggaccugcucgugaccuucaagacagcucacgcgaaaaagcaggaagucgugguucugggaagccaagagggcgccaugcacacggcucugaccggggccacagaaauucagaccuccggaacaaccacgaucuuugccggccaucucaagugccggcugaaaauggauaaacuuacacugaaagggaugagcuaugugauguguaccggcucuuucaagcucgagaaagaagucgcugagacccagcacggaacagugcugguucagauuaaguacgagggcaccgacgccccgugcaagaucccuuuccugacacaagaugaaaaaggggugacgcagaacggaagacuuaucaccgcgaaucccauugucacagacaaggagaaaccugugaacaucgaagcugagccgcccuuuggcgaguccuauauuaccaucggggccggagaaaaggcccucaaacugagcugguucaagaagggcucuagcauugggaaaauguuugaggcuacagcccgcggcgcucggagaauggccauccugggagauaccgcgugggacuucggcuccaucgggggaguguuuacgucuguuggcaagcucguccaucagauuuucgggaccgccuacggagugcuguuuagcggcguguccuggacaaugaaaaucgggauuggcguccuucugaccuggcucggacugaauagccgcucuacaucccugagcaugaccuguaucgcugugggccuuguuacacucuaccugggggugaugguccaggccgauucuggaugcgugauuaacuggaagggccgggaacugaaauguggguccggaaucuucguuaccaaugaggugcacacguggacagaacaauauaaguuucaggcugacagcccuaagagacucuccgccgcgauuggcaaagccugggaggagggggucugcggcauccgcucugcuacccggcuggaaaacaucauguggaagcagauuagcaacgagcuuaaucauauccugcucgaaaacgacaugaaauucaccgugguugugggagaugucgccggcauucuggcucaggggaagaaaaugaucagaccgcaacccauggaguacaaguauuccuggaaaucuuggggaaaggccaagauuaucggcgccgacgugcagaauacaaccuuuaucauugaugggccuaacacgcccgaauguccugacgaucagcgcgcuuggaauaucugggagguggaggacuacggauucggcauuuuuacaaccaacaucuggcugaaacuucgggauagcuauacacaggucugcgaccacagacucauguccgcggccauuaaggauagcaaagcuguucacgccgacaugggcuacuggaucgaaucugagaagaaugaaaccuggaaacuggcccgcgcuuccuucaucgaggugaagacauguauuuggcccaagagccauacccuguggucuaacggggugcucgaauccgagaugaucauuccgaaaaucuauggaggcccuauuagccaacacaauuaccggcccggguacuucacgcagaccgccggaccuuggcaucugggcaaacuugagcuggauuuugaccucugcgaagggacaaccgucgugguugaugagcacugcggaaacagaggccccucucugcggacaaccacggugacaggcaaaaucauccacgaaugguguugccgcagcuguacccugccuccccuuagauucagaggggaagacggaugcugguauggcauggagauucggccggucaaggaaaaagaggaaaaucucgugaaguccaugguuagcgcggggucuggagagguggacuccuuuagccugggccugcucuguaucuccauuaugaucgaagaggucaugcgcucucgguggagcagaaagaugcugaugacagggacccuugcuguguucuuucugcucauuaugggacagcugaccuggaacgaucugauccgccuuugcauuaugguuggcgccaaugccuccgacagaaugggcauggggacaacguaccuggcucucauggccaccuucaaaaugcggccuauguuugcggugggacuccuguuccgcagacugacaucucgggagguccuucugcucaccaucggccugagccugguggcuuccguggaacuucccaacucucuggaggaacucggggauggacuggccaugggcaucaugauucucaagcugcuuacagacuuucaaagccaucagcugugggccacccuccugucccugacguucaucaaaacaaccuuuagccuucacuaugcuuggaagaccauggccaugguccugucuauuguuucccucuucccccugugucucagcacaaccucucagaaaacaacguggcugccugugcuucuggggucccugggaugcaagccgcucaccauguuucugaucgcugagaauaagauuuggggccgcagaagcuggccccuuaacgaaggcaucauggccguggggaucgucucuauucugcucuccagccugcucaaaaacgaugugccucuggcgggaccccuuaucgccggcgggaugcugauugcuuguuacguuaucuccggaagcucugccgaccugagccucgagaaggcugccgagguguccugggaagaggaagccgagcauucuggcgcuagccacaauauucuggucgaagugcaggaugacgggacaaugaaaaucaaggaugaggagcgggacgauacccuuacaauccugcucaaagcgacccugcucgccgcuuccggaguuuauccucugucuauucccgccacgcuuuucgugugguacuucuggcaaaagaaaaagcagcgcagcggcguccugugggacaccccuagcccucccgaaguggagagagccguccuggaugacggcaucuaucggauuaugcagcgcgggcuccugggaagaucucaggugggcguugggguguuucaagaaaacgucuuccauacaauguggcacgugacccggggagcuguucuuauguaccagggcaagagacuggagcccagcugggccuccgugaaaaaggaccucaucagcuacgggggaggcuggcgccugcagggcucuuggaauacaggggaggaaguccaggugauugcgguggagcccggcaagaauccuaagaauguucaaaccgcucccggcacauuuaaaacgccggaaggggaggucggagccaucgcccucgauuucaagccuggcaccuccgggagccccauugugaaccgggaaggaaagaucgugggccuguauggcaauggggucgugacaaccucuggaaccuacguuuccgcuaucgcccaggcgaaagcuagccaggagggcccucuucccgagauugaagacgagguguuuagaaagcgcaaccugacaaucauggaucugcaccccggguccggaaaaacgcggagauaucucccugccauuguccgcgaagccaucaagcggaaacugagaacccuuauucuggcuccgacacgcgugguugccucugagauggcugaagcccucaagggcaugcccauccgguaccaaaccacagcggugaaguccgagcauaccgggaaagagaucgucgaccugaugugccacgccacguucacaaugagacugcucuccccugugcggguucccaauuauaacaugauuaucauggaugaagcucauuuuaccgacccuagcucuguggccgcucgcggcuacauuuccaccagagucggaaugggcgaggccgccgcuaucuucaugacagcgacacccccugggagcguggaagccuuuccgcagucuaaugcugugauucaggaugaggaacgggacauccccgagcgcagcuggaacuccggauaugaguggaucacagauuucccuggcaagaccgucugguuuguucccucuauuaaaagcgggaaugacaucgccaacugucuuagaaagaauggaaaacgggugauucagcuguccagaaagacguucgauacagaauaccaaaagaccaaaaacaacgacugggacuacguggucacaaccgauaucucugagaugggcgccaauuuccgcgcugaccgggugauugauccuagacgcugccugaagcccguuauccucaaagacgggccggaacgggugauucuggccggcccuaugcccgucacgguggcgagcgcugcccagagacgcggacggaucggcagaaaccacaauaaggagggggaucaguauaucuacaugggacagccccuuaacaaugacgaggaucaugcccacuggaccgaagcuaaaaugcugcucgacaacauuaauacaccugagggcaucauucccgcccuguuugaaccugagcgcgaaaaguccgcggccaucgauggggaguauagacugcggggagaggcucgcaagaccuucguugaacucaugagacggggcgaccuuccgguguggcugagcuacaaagucgccucugagggguuucaauauuccgaucgcagauggugcuucgacggcgaacggaacaaucaggugcuggaggaaaacauggaugucgagauuuggacaaaggagggagaacgcaagaagcuccgcccccgguggcuggacgcuagaaccuacagcgacccucuugcccugcgcgaguuuaaagaguucgcugccggccggagauccgugucuggggaucucauccuggagaucggaaagcugccccagcaccucacacagcgggcgcaaaaugcccuugacaaccugguuaugcugcauaauagcgaacagggcgggcgcgcuuauagacacgccauggaggagcucccugauaccauugaaacgcugaugcuucuggcucucaucgccgugcugacaggaggcgugacccuguuuuuccucuccggccgggggcuuggaaaaaccucuauuggccugcugugugucauggccagcuccguucuccuguggauggcuagcguggagccccauuggaucgcggccucuauuauccuugaauuuuuccugauggugcuccugaucccggagccugaccgccagagaacaccccaggauaaccaacuggcuuacgucgugauugggcuccuuuuuaugauccugaccguugccgccaaugagaugggacugcucgaaacaacgaagaaggaccugggcauugggcacguggcugccgagaaccaccaucacgcggccaugcuugaugucgaccugcauccugcuuccgccuggacccucuacgcuguggccacaaccaucauuacacccaugaugcggcacaccaucgaaaacacgaccgcgaauauuagccugacagccaucgcuaaccaggccgcuauccugaugggacucgauaaaggcuggccuauuucuaagauggacaucggcgucccccuucuggcccuggggugcuauucccaggugaauccgcucacccugacagcugccguucuuaugcugguggcgcauuacgccauuaucggaccuggccuccaagcuaaagccacccgcgaggcucagaagagaacggccgccgggauuaugaaaaaccccacagucgauggaaucguggcgaucgaccuggaucccguuguguaugacgcuaaguucgaaaagcagcugggccagauuaugcuccuuauccuguguaccagccaaauucugcucaugcggacaaccugggcccugugcgagucuaucacccuugcuacagggccucugacgacccucugggagggaagcccgggcaaauuuuggaauacaaccauugccgucuccauggccaacaucuuccgcggcucuuaccuggcuggggccggacuggcguucagccucaugaagucccuuggcgggggaagacggggcacaggggcccagggagaaacccugggcgagaaauggaagagacagcugaaucagcucagcaaauccgaauuuaacacguauaagcgcucuggcaucauggagguggaccggagcgaagcuaaggaggggcugaaaagaggagagacaaccaagcacgccgugucccgcggcaccgcuaaacuucggugguucguugaaagaaaucuggucaagcccgaggggaaagugauugaucucggauguggccgcgggggauggucuuacuauugcgccggccugaagaaggugacagaagucaaaggcuacaccaaagggggaccuggccacgaggaacccaucccuauggcgacauacggguggaaccugguuaaacuccauagcggaaaggacguguuuuucauucccccugagaaaugugauacgcuucugugcgacaucggcgaguccucuccgaaucccaccauugaagaggggcggacacugagagugcucaagauggucgaaccuuggcugcgcggaaaccaauuuuguaucaaaauucuuaaucccuauaugccuagcgugguugagacccuggagcagaugcagcggaagcacggcggcaugcucgugagaaacccccugucccgcaauagcacacaugaaauguacugggucucuugcgggaccggaaacaucguguccgccguuaauaugacgagccggaugcugcucaacagauucaccauggcucaccgcaagccgacauaugagagagauguggaccugggcgccgggacccggcacgucgcuguggaaccugagguggccaaccuugauaucauuggacagcgcaucgaaaauauuaaacaugagcacaagucuacauggcauuacgacgaggauaaccccuauaaaaccugggcuuaccacggcuccuaugaagucaagcccagcgggucugccuccagcaugguuaauggaguggugaaacugcucacaaagccuugggacgucauccccauggugacccaaauugcgaugacggauacaaccccuuuuggccagcagagaguuuucaaggagaaaguggacacccggacaccgaaggccaaaagaggcacggcucaaaucauggaagucaccgccaaguggcuguggggguuucuuucccggaacaaaaagccccgcaucuguacaagagaggaguucacccggaaggugcgcagcaaugcugccauuggagccguuuuuguggacgagaaccaguggaacucugcgaaagaggcugucgaagaugagagauucugggaccuggugcaucgggaacgcgagcuccacaagcagggcaaaugcgccacaugcguuuacaacaugauggggaagagagagaagaagcugggagaguuuggcaaggccaaagggagccgggcuaucugguacauguggcugggcgcccgcuuccucgaguucgaagcucugggauuuaugaaugaggaucacugguucuccagagaaaacucucuuagcggcguggagggggagggacugcauaagcucggcuauauucugcgggacaucuccaaaauuccugggggaaauauguacgccgaugacaccgcgggcugggauacacgcaucaccgaagacgaucuucagaacgaggccagaaucacggacauuauggaacccgagcacgcucugcucgccaagucuaucuuuaaacugaccuaucaaaauaaggucgugcggguccagcgcccugcuaaaaacgggacagugauggauguuauuagcagacgggaccagagaggcuccggacaggugggcaccuacgggcugaauacauucaccaacauggaagcccaacucauccgccagauggagucugagggaauuuuuagccccuccgaacuggagacgccgaaccuugcggaacggguccuggauuggcucgagaaguauggcguggaaagacugaagcgcauggccaucagcggggacgacugugugguuaaaccuaucgaugaccgguucgcuacagcccuuaccgcucugaaugauaugggaaaggugagaaaagacauuccccagugggagccuucuaagggcuggaacgauuggcagcaaguccccuuuugcucccaucacuuccaccagcucaucaugaaagacgggcgcgagauugugguuccuugucggaaucaggaugaacuggugggcagagcccgcgucagccagggagcuggcuggucucugcgggagacagccugccucgggaaguccuacgcgcaaauguggcagcugauguauuuucauagacgcgaccuucggcuggccgcuaacgccaucuguagcgccgugcccgucgauuggauuccgaccuccagaacgaccuggucuauccacgcucaucaccaguggaugacaaccgaagacaugcucagcguguggaaucggguuuggauugaggaaaacccuuggauggaggauaagacacauaucuccagcuggggagacgugcccuaccugggcaaaagagaggaccaauggugcgggucucuuaucggacugaccgcccgcgcgacaugggcuaccaauauucaggucgccaucaaccaggugcggagacucauuggcaaugaaaacuaccuggauuauaugacguccaugaagcgcuucaaaaaugagagcgaccccgaaggggcccugugguga

SEQ ID NO: 19242 - RNA, 9879 nt, Artificial Sequence
  derived and/or modified CDS sequence (opt5) from DENV-1__GU131818__SS-prME
agcgugaccaugcugcugaugcugaugcccaccgcccuugcuuuccaccugacgacccggggaggggagccucauaugaucgucuccaagcaggaacgggggaaaucucuccuguuuaagacaagcgccggcguuaacaugugcacccuuauugccauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggacaucuuacgugauguguaccggcuccuucaagcuggagaaagaagucgccgagacccagcauggaacagugcucguucagaucaaguaugagggcaccgacgcgccgugcaaaauuccuuuuagcacacaggaugaaaagggggugacgcaaaacggaagacugaucaccgcuaaucccaucgucacagacaaagagaagccugugaacauugaagccgagccgcccuucggcgagucuuacaucgugauuggggccggagaaaaggcucugaaacuuagcugguuuaagaaaggcuccucuaucgggaagauguucgaggccaccgcucggggcgccagacgcauggcgauucucggagauacagccugggacuuuggcagcaucgggggaguuuucaccuccgucggcaaacuggugcaccagaucuuugggacggcuuauggagugcuguucagcggcgucucuuggaccaugaagauugggaucggcgugcuccugacauggcuuggacucaauucccggagcaccucucucuccaugacauguauugccguuggccuggugacccuguaccuuggggucauggugcaggcugauagcggaugcguuaucaacuggaagggcagagaacucaaauguggguccggaauuuuugugacaaaugagguccauaccuggacggaacaguacaaguuccaagccgacucuccuaaacgccugagcgcggccaucggcaaggcuugggaggagggggugugcggcauucgguccgccacaagacuggaaaacaucauguggaaacagaucucuaacgagcucaaucacauucugcuugaaaacgacaugaaguuuaccguuguggucggagauguggcuggcauccuggcccaggggaaaaagaugauucgcccgcagcccauggaguauaaguacagcuggaaauccuggggaaaggccaaaaucauuggcgcugacgugcaaaauaccacauucaucaucgaugggccuaacacccccgaauguccugacgaucagcgggcguggaauauuugggaggucgaggacuauggauuuggcaucuucacgacaaacauuuggcucaagcugagagauagcuacacccagguuugcgaccaccgccugaugucugccgcuaucaaagauuccaaggccgugcaugccgacaugggcuauuggauugaaagcgagaagaaugaaacauggaaacuugcucgggccucuuucaucgaggugaagaccuguaucuggcccaaaucccacacacucuggagcaacgggguccuggaaucugagaugauuaucccgaagauuuacggaggcccuaucagccagcauaauuauagacccggguacuuuacccaaacggcgggaccuuggcaccugggcaaacucgagcuggauuucgaccuuugcgaagggaccacagugguuguggaugagcacugcggaaaccgcggccccucccugcggaccacaaccgucacgggcaagauuauccaugaaugguguugcagaagcuguacacucccuccccugcgguuuaagggggaggacggaugcugguacggcauggagauccgcccggugaaagaaaaggaggaaaaucugguuaaaucuaugguguccgcugggagcggagaggucgacuccuucucucuuggccuccuguguauuagcaucaugauugaagaggugaugagaucccgguggucuagaaagaugcugaugaccgggacacucgccgucuuuuuccugcuuaucaugggacagcugaccuggaacgaucucauucgccugugcaucauggugggcgccaaugcuagcgaccggaugggcauggggaccacauaucuggcccuuauggcgacguuuaaaaugagaccuauguucgcugucggacugcucuuucgcagacugaccucccgggaggugcuccugcuuacaauuggccugucucucguggccagcgucgaacugcccaacucccuggaggaacuuggggauggacuggccaugggcaucaugauccucaagcugcucaccgacuuccagagccaccaacugugggcuacacuucugucucucaccuuuauuaagacgacauucucccugcauuacgccuggaaaaccauggcuaugguucugagcaucgugucucuuuuuccccugugucucuccaccacaagccagaagaccacauggcugccugugcuccuggggucucuuggaugcaaaccgcugacgauguuccugauugccgagaauaagaucuggggccgcaaauccuggccccucaacgaaggcauuauggcggucgggaucgugagcauccugcuuuccagccugcucaagaacgauguuccucuggccggaccccucauugcuggcgggaugcugaucgccuguuaugugauuucuggaagcuccgcugaccuuucucuggagaaagccgccgaggucagcugggaagaggaagcugagcacuccggcgcgucucauaauauccugguggaaguucaggaugacgggaccaugaagauuaaggaugaggagagagacgauacacucaccauccugcuuaaagccacacugcucgcugugagcggagucuacccucuguccauccccgccacccucuucgugugguauuuuuggcagaagaaaaagcaacggucuggcguccugugggacacgccuagcccucccgaaguggagcgcgccguucuugaugacggcauuuacagaaucaugcagcgggggcugcugggacgcucccaggugggcgucgggguguuccaggaaaacguuuuucacaccauguggcacgugacaagaggagcuguccucauguaucaaggcaaacggcuggagcccagcugggccucugugaagaaggaccuuauuuccuacgggggaggcuggcgccugcagggcagcuggaauaccggggaggaagugcagguuaucgcggucgagcccggcaagaacccuaagaaugugcagacagcucccggcaccuucaaaacaucugaaggggaggugggagccauugcccucgauuuuaagccgggcacguccgggagcccuaucgucaacagagaaggaaaaauugugggccuguacggcaaugggguugugaccacauccggaaccuaugucucugcuaucgcccaagcgaaggcuagccaggagggcccccucccugagaucgaagacgagguguuccggaagagaaaccugaccauuauggaucuucaucccggguccggaaaaacacgccgguaccugcccgccaucguuagagaagccauuaagcgcaaacugcggacgcucauccuggcuccuaccagaguggucgccagcgagauggcugaagcccuuaagggcaugccgauucgcuaucagacaaccgcggugaaaucugagcacacagggaaggagaucguugaccugaugugccaugccaccuuuacgaugcggcuccugucccccgugagagucccuaauuacaacaugaucauuauggaugaagcucacuucacagaccccagcucuaucgccgcucgcggcuauauuagcacccgggugggaaugggcgaggccgccgcuaucuuuaugaccgcgacaccucccggguccguggaagccuucccucaaucuaaugcugucauucaggaugaggaaagagacaucccggagcggagcuggaacuccggauacgaguggaucaccgauuuucccggcaagacaguuugguucgugccuucuauuaaaagcgggaaugacaucgccaacugucugcgcaagaauggaaaaagagugauucagcucucccggaagaccuucgauacggaauaucagaaaacaaagaacaacgacugggacuacgucgugaccacagauaucagcgagaugggcgccaauuuucgcgcugacagaguuauugauccccggagaugccuuaagccugugauccugaaagacgggcccgaacgcgucauucuggccggcccgaugccugugaccguugcgucugcugcccaacggagaggacgcaucggccggaaccauaauaaggagggggaucaguacaucuauaugggacagccccucaacaaugacgaggaucacgcccacuggacggaagcuaaaaugcugcuugacaacauuaauacccccgagggcaucauuccugcccuguucgaacccgagagagaaaaguccgcggccaucgauggggaguaccgccuccggggagaggcuagaaaaacauuuguggaacugaugcgcagaggcgaccugccugucuggcucagcuauaagguggccuccgagggguuccaguacucugaucggcgcuggugcuuugacggcgaaagaaacaaucaaguccuugaggaaaacauggauguggagauuuggaccaaagagggagaacggaagaagcugcgcccgagauggcuggacgcucggacauauagcgacccccucgcccugagagaguucaaagaauuugcugccggccgccgguccguuucuggggaucuuauccuggagaucggaaagcucccucagcaucugacccagagagcgcagaaugcccuggacaaccucgugaugcuucacaauagcgaacaaggcgggcgcgcuuaccggcaugccauggaggagcugcccgauacaauugaaacccugaugcuccuggcucuuaucgccgugcugacgggaggcgucacacucuucuuucuguccggcagagggcugggaaaaaccagcauuggccuccuuuguguuauggccucuuccgcucugcuguggauggcgagcguggagccucacuggaucgccgcuucuauuauccucgaguucuuucugauggugcuucugauccccgagccggaccggcagcgcaccccucaggauaaccagcucgccuaugucgugauugggcugcuguucaugauccucacaguugccgcuaaugagaugggacuucuggaaaccacaaagaaagaccugggcauugggcacguggccgucgagaaccaucaccaugcggccaugcucgauguggaccugcaccccgcuuccgccuggacgcuuuacgcugucgccaccacaaucauuaccccuaugaugagacauacaaucgaaaacaccacggcgaauauuagccugaccgccaucgcuaaccaagccgcuauccucaugggacuggauaagggcuggcccauuucuaagauggacaucggcgugccucugcucgcccuugggugcuacagccagguuaauccccugacacugaccgcugccgugcucaugcuggucgcgcacuaugccauuaucggaccgggccuucaggcuaaagccacacgggaggcucaaaagcgcaccgccgccgggauuaugaaaaacccuacgguggauggaaucguugcgaucgaccuggaucccguggucuacgacgcuaaguuugaaaaacagcucggccagauuaugcugcuggugcucuguacaucccagauccuucugaugagaaccacaugggcccugugcgagucuauuacccucgcuaccgggccccugacaacgcuuugggagggaagcccuggcaaguucuggaauaccacaaucgccguguccauggccaacauuuuccggggcagcuaucuggcuggggccucccucgcguuuucucugaugaaaagccugggaggcgggcgcagaggaaccggcgcccaaggggaaacacucggagagaaauggaagcggcagcuuaaucagcuguccaaaucugaguucaacaccuacaagcgcagcggcaucauggagguugacagauccgaagcuaaagagggccugaagagaggggaaacgacaaagcacgccgucucuagaggaaccgcuaaacuccgcugguuuguggaacggaaucuggugaagccggagggcaaagucaucgaucuuggguguggaagaggcggguggagcuauuacugcgccggacugaagaaaguuaccgaagugaagggcuauacaaaaggcgggcccggacaugaggaaccuauucccauggcgaccuacggcuggaaccucgugaagcugcacuccgggaaggacgucuucuuuaucccucccgagaaaugugauacacugcucugcgacauuggagagagcucuccuaauccgacgaucgaagagggccgcacccuucgggugcugaagaugguugaacccuggcugagagggaaccaguucuguauuaaaauccucaauccuuacaugcccuccguggucgagacacuggagcaaaugcagcgcaagcauggaggcaugcuugugcggaacccucugagcagaaauucuacccacgaaauguauuggguuuccugcggcacagggaacauugugagcgccgucaauaugaccucucgcaugcuccugaaccgguuuacgauggcucacagaaaacccaccuacgagcgcgauguggaccugggagccggcacacggcauguggcugucgaaccggagguugccaaccucgauaucaucgggcagagaauugaaaauaucaagcacgagcauaaguccaccuggcacuaugacgaggauaacccuuacaaaacaugggcuuaucauggaagcuacgaagugaagcccuccggcagcgccucuagcauggugaauggggucgugaaacugcuuaccaagcccugggacguuauuccuauggugacacagaucgcgaugaccgauacgacacccuucggacaacagcgcgucuuuaaagagaagguggacaccagaaccccuaaggccaaacggggcacagcucagauuauggaaguuacggccaaguggcuguggggcuuccucucccgcaacaaaaagccgagaaucuguacccgggaggaauuuacaagaaaagugcggucuaaugcugccaucggggccgucuucguggacgagaaccaauggaauagcgcgaaggaggcuguugaagaugagcgcuuuugggaccuggugcacagagaacgggagcuucacaagcagggaaaaugcgcgaccugcgucuauaacaugaugggcaagcgcgagaaaaagcugggggaguucggaaaagccaagggcuccagagcuauuugguacauguggcucggggcccgguuccuggaguuugaagcucugggcuucaugaaugaggaucauugguuuucucgcgaaaacagccucuccggaguggagggcgaggggcugcacaaacuuggauacauccugagagacauuucuaagauccccggcgggaauauguaugccgaugacacagcgggaugggauacccggauuacagaagacgaucuccagaacgaggccaagaucaccgacaucauggaaccugagcaugcucugcuugccaaaagcauuuucaagcugacguaccagaauaaagucgugcgcguucaaagacccgcuaagaacggcaccgugauggaugucaucucccggcgcgaccagagagggagcggccaggugggaacauauggccucaauaccuuuacaaacauggaagcccagcugauucggcaaauggagucugaggaaaucuucuccccuagcgagcuggaaacccccaaccucgcggggcgcgugcuggauuggcuugagaaacacggaguugaaagacugaagcggauggccauuucuggcgacgacuguguggucaagccgaucgaugacagauuugcuacggcccucacagcucugaaugauauggggaaagugcgcaaggacaucccucagugggagcccuccaaaggauggaacgauuggcagcagguuccuuucugcagccaccauuuucaccaacuuauuaugaaggacggccgggagaucgugguccccuguagaaaucaggaugaacugguggggcgcgcccgggucucccagggcgcuggauggucucucaaagagaccgccugccugggcaagagcuacgcgcagauguggcaacugauguauuuccauagacgcgaccuccggcuggccgcuaacgccauuuguuccgccgugccuguugauugggugcccacaagcagaaccacguggucuauccacgcucaucaccaguggaugaccacagaagacaugcuuuccgucuggaaucgcguguggauugaggaaaacccguggauggaggauaagacccacaucagcucuuggggagacguuccuuaccugggaaaacgggaggaccaguggugcggcagccucauugggcugacagccagagcgaccugggcuacaaauauccaaguggccaucaaccagguccgccggcuuauuggaaaugaaaacuaucuggauuacaugaccuccaugaagagauuuaaaaaugagucugaccccgaaggcgcccucugguga

SEQ ID NO: 19243 - RNA, 9879 nt, Artificial Sequence
  derived and/or modified CDS sequence (opt5) from DENV-1__GU131820__SS-prME
uccgugaccaugcugcucaugcugaugcccaccgcccuugcuuuccaccugacgaccagaggcggggaaccucauaugaucgucacaaagcaggaacggggaaagucccuucuguuuaagaccucugccggcguuaauaugugcacccuuauugcgauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcggggcucggagaggucgacuccuuuagccugggccugcucuguaucuccauuaugaucgaagaggugaugcggucuagauggagccgcaagaugcugauggcugggacacuugccguuuuccugcuccugauuaugggacagcugaccuggaacgaucuuauccggcugugcauuauggugggcgccaaugcuuccgacagaaugggcauggggacaaccuaucucgcccugauggcgaccuuuaaaaugcgcccuauguucgcugucggacuccuguuuagacggcuuacaucucgcgaggugcugcuccugacgaucggccugagccuuguggccuccgucgaacugcccaacucucucgaggaacugggggauggacucgccaugggcaucaugauucugaaacuucugaccgacuuccaaagccaccagcucugggcuacacugcugucccuuaccuuuaucaaaacaacccugagccuccauuacgccuggaagacgauggcuaugguucugucuauugugucccucuucccccugugucuuagcacaaccucucagaagaccacauggcugccugugcugcucgggucccugggaugcaaaccgcuuaccauguuucugaucgccgagaauaagauuuggggcagaaaaagcuggccccucaacgaaggcaucauggcggucggggugguuucuauccugcucuccagccugcuuaagaacgaugugccucuggccggaccccugauugcuggcgggaugcucaucgccuguuaugucauuuccggaagcucugcugaccugagccuugagaaagccgccgagguguccugggaagaggaagcugagcacucuggcgcgagccauaauauccugguugaagugcaggaugacgggacaaugaagauuaaagaugaggagcgggacgauacgcucaccauccugcucaaggccacacugcuugcuaucuccggagucuacccucugucuauucccgccacccuguucgugugguauuuuuggcaaaagaaaaagcagcgcagcggcguccucugggacacaccuagcccucccgaaguggagagagccguucuggaugacggcaucuaccggauuaugcagcgcgggcuucugggaagaucucaggugggcgucgggguguuccaagaaaacguuuuccacaccauguggcacgugacgcggggagcuguccucauguaucagggcaaacgccuggagcccagcugggccuccgugaagaaagaccucaucagcuacgggggaggcuggagacugcagggcucuuggaauaccggggaggaagugcagguuauugcggucgagcccggaaagaacccuaagaaugugcaaacagcucccggcaccuuuaaaacaccggaaggggaggugggagccaucgcccuugauuucaagccuggcaccuccgggagccccauugucaaccgggaaggaaaaaucgugggccuguacggcaaugggguugugacaacgucuggaaccuaugucuccgcuaucgcccaggcgaaggcuagccaggagggcccucugcccgagauugaagacgagguguuuagaaaacgcaaccucacaaucauggaucugcaucccggguccggaaagacccggagauaccuuccugccauuguucgcgaagccaucaagcggaaacugagaacccucauucuggcuccgacacgcguggucgccucugagauggcugaagcccugaagggcaugcccauccgguaucaaacgaccgcggugaaaagcgagcacacagggaaggagaucguugaccucaugugccaugccaccuucacaaugagacuucuguccccugugcgcguccccaauuacaacaugauuaucauggaugaagcucacuuuaccgacccuagcucuauugccgcucggggcuauaucuccacgagagugggaaugggcgaggccgccgcuauuuucaugacagcgacacccccugggagcguggaagccuuuccgcagucuaaugcugucauccaggaugaggaacgggacauccccgagcgcagcuggaacuccggauacgaguggauuaccgauuucccuggcaaaacaguuugguuugugcccucuaucaagagcgggaaugacauugccaacugucugagaaagaauggaaaacgggugauccagcucucccgcaagaccuucgauacagaauaucagaagaccaagaacaacgacugggacuacgucgugacgacagauauuucugagaugggcgccaauuuuagagcugaccggguuaucgauccuagacgcugccugaaacccgugauucuuaaggacgggccggaacgggucauccuggccggcccuaugcccgugaccguugcgagcgcugcccagagacgcggacggaucggcagaaaccauaauaaggagggggaucaguacauuuauaugggacagccccucaacaaugacgaggaucacgcccacuggacagaagcuaaaaugcugcuggacaacaucaauaccccugagggcauuauccccgcccucuucgaaccugagcgcgaaaaguccgcggccauugauggggaguaccggcuuagaggagaggcucgcaaaacguucguggaacugaugagacggggcgaccugccggucuggcucagcuauaagguggccucugagggguuucaauacuccgaucgcagauggugcuucgacggcgaacggaacaaucagguccuggaggaaaacauggauguggagaucuggaccaaagagggagaacgcaagaaacuuagaccccgguggcuggacgcuagaacauauagcgacccucucgcccugcgcgaguuuaaggaguucgcugccggccggagauccguuucuggggaucugauccucgagauuggaaaacuuccccagcaucugacccagcgcgcgcaaaaugcccuggacaaccucgugaugcugcacaauagcgaacagggcgggcgggcuuacagacaugccauggaggagcuuccugauacaaucgaaacccugaugcuccuggcucugauugccgugcucacaggaggcgucacccucuuuuuccuguccggccgggggcugggaaaaacgucuaucggccuccuguguguuauggccagcuccgugcuucuguggauggcuagcguggagccccacuggauugcggccucuaucauccucgaauuuuuccugaugguccugcucauuccggagccugaccgccagagaacaccccaggauaaccaacuugcuuaugugguuaucgggcugcuguuuaugauucucaccguggccgccaaugagaugggacugcuugaaaccacaaagaaagaccugggcaucgggcacgucgcuguggagaaccaucaccaugccaccaugcucgaugucgaccugcacccugcguccgccuggacacuguacgcuguggccacgaccauuaucacacccaugaugcggcauaccauugaaaacacaaccgcuaauaucagccucacggccaucgcgaaccaggccgcuauucuuaugggacuggauaagggcuggccuaucucuaaaauggacauuggcguuccccugcucgcccuggggugcuacucccaggugaauccgcuuacccugacagcugccguccucaugcugguggcucacuaugccaucauuggaccuggccugcaagcgaaggccacccgcgaggcucagaagagaacagccgcugggaucaugaaaaaccccaccguugauggaaucguggccauugaccucgaucccgucguguacgacgccaaguucgaaaaacagcuuggccagaucaugcugcugauucucuguacgagccaaauccugcuuaugcggacaaccugggcgcugugcgagucuauuacacucgcuaccgggccucugaccacacugugggagggaagcccgggcaaguuuuggaauacgaccaucgccguguccauggcuaacaucuuccgcggcucuuaucucgccggggccggacuugcuuuuagccugaugaaaucccugggcgggggaagacggggcacaggggcccagggagaaacccucggcgagaaguggaagcgccagcugaaucagcuuagcaaauccgaguucaacauuuacaagagaucuggcaucauggagguugaccggagcgaagcgaaagaggggcugaagagaggagagacaacccgccacgccgucucccggggcacggcuaaacucagaugguucguggaacgcaaucuggugaagcccgaggggaaggucauugaucugggauguggcagagggggauggucuuauuacugcgccggccucaaaaagguuacagaagugaaaggcuauaccaaagggggaccuggccaugaggaacccaucccuauggcuaccuacggguggaaccuugugaaacugcacagcggaaaggacgucuuuuucacacccccugagagaugugauacccugcucugcgacauuggcgaguccucuccgaaucccacaaucgaagaggggcgcacgcugcgggugcuuaaaaugguugaaccuuggcugagaggaaaccaauuuuguauuaagauccucaaucccuacaugccuagcguggucgagacccuggagcagaugcagcgcaagcauggcggcaugcuggugcggaacccccucuccagaaauagcacacacgaaauguauuggguuucuugcgggaccggaaacaucguguccgccgucaauaugacaagccgcaugcugcuuaaccgguucaccauggcgcacagaaaaccgacguacgagcgcgauguggaccugggcgccgggaccagacauguggcugucgaaccugagguugccaaccucgauauuaucggacagcggauugaaaauaucaagcacgagcauaaaucuacauggcacuaugacgaggauaaccccuacaagaccugggcuuaucauggcuccuacgaagugaaacccagcgggucugccuccagcauggugaauggagucgugaagcugcuuacaaagccuugggacguuauucccauggugacccaaaucgcuaugacagauaccacgccuuuuggccagcagcgcgucuucaaagagaagguggacacaagaaccccgaaagccaagcggggcaccgcgcaaaucauggaaguuacagccagauggcuguggggguuucucucccggaacaaaaagccccgcauuuguacgagagaggaguucacccggaaggugcgcagcaaugcugccaucggagcugucuuuguggacgagaaccaguggaacucugccaaagaggccguugaagaugagagauucugggaccuggugcagaaggaacgggagcugcacaaacagggcaagugcgcgacaugcgucuauaacaugauggggaaacgcgaaaagaagcucggagaguuuggcaaagcuaaggggagcagagccauuugguacauguggcugggcgcccgguuccuugaguuugaagcucugggauucaugaaugaggaucacugguucucccgcgaaaacucucucagcggcguggagggggagggacugcauaaacuuggcuacauccugagagacauuuccaagaucccugggggaaauauguaugccgaugacaccgcuggcugggauacacggaucaccgaagacgaucuccaaaacgaggccaaaauuacagacaucauggaacccgagcacgcgcugcuggccaccucuauuuuuaagcucacguaccagaauaaagucgugcgcguucagagaccugcuaagaacgggaccgugauggaugucaucagccggcgcgaccagagaggcuccggacaagugggcacauaugggcugaauaccuucacaaacauggaagcccagcuuauucggcagauggagucugagggaaucuuucugcccagcgaacucgagaccccgaaccuggcugaaagagugcuugauuggcuggagaagcauggcguugaacgccucaaacggauggccaucuccggggacgacuguguggucaagccuauugaugacagauucgcgacggcccugacagcucugaaugauaugggaaaagugcgcaaggacaucccccagugggagccuagcaaaggcuggaacgauuggcaacagguucccuuuugcucucaccacuuccaucagcucauuaugaaggacgggcgggagaucguggucccuuguagaaaucaggaugaacuggugggccgcgcccgggucucccaaggagcuggcuggagccuuagagagaccgccugccuggggaagucuuacgcucagauguggcagcucauguauuuucaccgccgggaccugagacuugccgcgaacgccauuuguuccgcugugcccguugauugggugccgacaagccgcaccacgugguccauccaugcccaccaucaauggaugaccacagaagacaugcugucugucuggaaucggguguggauugaggaaaacccuuggauggaggauaaaacccacguuagcuccuggggagacgugcccuaccucggcaagagagaggaccaguggugcgggagccugaucggacugacagcccgggcuaccugggccucuaauauccaggucgcgauuaaccaggugagacgccucaucggcaaugaaaacuaucuggauuacaugacauccaugaaacgguucaagaaugagggggaccccgaaggcgcucuuugguga

SEQ ID NO: 19244 - RNA, 9879 nt, Artificial Sequence
  derived and/or modified CDS sequence (opt5) from DENV-1__HM181970__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuacgugauuuccggcagcucugcugaccugagccucgagaaggccgccgagguuuccugggaagaggaagcugagcauucuggggcgagccacaauauccugguggaaguccaggaugacggaacgaugaaaaucaaggaugaggagcgcgacgauacccuuacaauucugcucaaagccacccugcucgcuguguccggcguuuauccucugucuauccccgccacacuuuucgugugguacuucuggcaaaagaagaaacagagaagcggcguccugugggacaccccuagcccucccgaaguggagcgggccguccuggaugacgggauuuaucgcaucaugcagagaggacuccugggccggucucagguggggguuggaguguuucaagaagacgucuuccauacgauguggcacgugacccgcggcgcuguucuuauguaccaggggaagagacuggagcccagcugggccuccgugaaaaaggaucucauuagcuacggaggcggcuggcggcugagagggucuuggaacacaggagaggaaguccaggugaucgcgguggagcccggcaaaaauccuaagaacguucagaccgcucccgggacauuuaagaccccggaaggagaggucggcgccauugcccucgacuucaaaccugggacauccggaagccccaucgugaaucgcgaaggcaagaucgugggccuguaugggaacggagucgugacgaccucuggcacauacguuuccgcuauugcccaagcgaaagcuagccaggaggggccucuucccgagaucgaagaugagguguuucggaagagaaaucugaccauuauggaccugcaccccggauccggcaaaacccgccgguaucucccugccaucgucagagaagccauuaagcgcaagcugcggacacuuauccuggcuccgacgagagugguugccucugagauggcugaagcccucaaagggaugcccauccgcuaccagaccacagcggucaagagcgagcauaccggcaaagagauugucgaucugaugugccacgccacauucaccaugcggcugcucuccccugugagaguucccaacuauaauaugaucauuauggacgaagcucauuuuacggauccuagcucuaucgccgcucggggauacauuuccacacgcgugggcaugggggaggccgccgcuaucuucaugaccgcgacacccccuggaagcgucgaagccuuuccgcaaucuaacgcugugauccaggacgaggaaagagauauucccgagcggagcuggaacuccggccacgaguggaucacagacuucccugggaagaccgugugguuuguccccucuauuaaaagcggaaacgauaucgccaauugucuucgcaagaacggcaagagaguuauucagcugucccggaaaacauucgacaccgaauaucagaagacgaaaaauaacgacugggauuacguggugacaaccgacaucucugagaugggggccaacuucagagcugaucgcgucauugacccucggagaugccugaagcccgugauccucaaagauggcccggaacgcguuauccuggccggaccuaugcccgugacagucgcgagcgcugcccaacggagaggccgcauugggcggaaucauaacaaggagggagaccaguacaucuauaugggccagccccuuaauaacgaugaggaccacgcccacuggaccgaagcuaagaugcugcucgauaauauuaacacgccugaggggaucauucccgcccuguuugaaccugagagagaaaaauccgcggccguggacggagaguaccgccugagaggcgaggcucggaagaccuucguugaacucaugcgcagaggggaucuuccgguguggcugagcuauaaagucgccucugagggcuuucaguacuccgaccggcgcuggugcuucgauggagaaagaaauaaccaagugcuggaggaaaauauggacgucgagaucuggacaaaggagggcgaacggaaaaagcucagaccccgcuggcuggacgcucggaccuauagcgauccucuugcccugagagaguuuaaagaguucgcugccgggcgccgguccgugucuggagaccucauccuggagauuggcaagcugccccagcaucucacacagagagcgcagaacgcccuugauaaucugguuaugcugcacaacagcgaacaagggggacgggcuuaccgccaugccauggaggagcucccugacaccaucgaaacacugaugcuucuggcucucauugccgugcugaccggcggcgugacgcuguuuuuccucuccgggagaggacuuggcaagacaucuaucgggcugcugugugucauggccagcuccguucuccuguggauggcuagcguggagccccacuggauugcggccucuaucauccuugaauuuuuccugauggugcuccugauuccggagccugaucggcagcgcacaccccaggacaaucagcuggcuuaugucgugaucggacuccuuuuuaugauucugaccguugccgccaacgagaugggccugcucgaaacaaccaaaaaggaucuggggaucggacacguggcugucgagaaucaucaccaugccgcgaugcuugacguggaucugcacccugccuccgcuuggacacucuacgccgucgcuacgaccauuaucacacccaugaugagacauaccauugaaaacacaaccgccaacaucagccugacggcgaucgccaaucaagcugccauucugaugggccucgacaaaggcuggccuaucucuaagauggauauuggggugccccuucuggcucugggaugcuacucccagguuaacccgcucacccugacagccgcugugcuuaugcuggucgcccacuaugcgaucauuggcccugggcuccaggccaaagcuacccgggaggcccaaaagcgcacagcugccggaaucaugaagaaucccaccguggacggcaucguugccauugaucuggaccccguggucuacgacgcgaaauucgaaaagcagcuggggcagaucaugcuccuuauucuguguacgagccagauccugcucaugagaacaaccugggcucugugcgagucuauuacacuugccaccggaccucugaccacacucugggagggcagcccgggcaaauuuuggaacacgaccaucgcuguguccauggccaauaucuuccgggggucuuaucuggccggagcuggccuggccuucagccucaugaagucccuugggggaggccgcagagggacaggagcgcaaggcgaaacccugggcgagaaauggaagcggcagcugaaccagcucagcaaguccgaauuuaauacauacaaaagaucugggauuauggagguggaucgcagcgaagccaaggagggacugaaacggggcgagaccacgaagcacgcuguuuccagagggacagccaaacuucgcugguucgucgaacggaaccuggugaagcccgagggaaaggugaucgaccucggcugugggagaggaggcuggucuuauuacugcgcuggccugaaaaaggucaccgaaguuaaaggguauaccaagggaggcccugggcaugaggaacccauuccuauggccacauacggauggaaucuggugaaacuccacagcggcaaggauguguuuuucauucccccugagaaaugugacacccuucugugcgauaucggggaguccucuccgaaccccacaaucgaagagggacgcacgcugcggguccucaagaugguggaaccuuggcugagaggcaaucaguuuuguauuaagauccuuaaccccuacaugccuagcguuguggagacccuggagcaaaugcagcgcaaacauggcgggaugcucguccggaauccccuguccagaaacagcacacacgaaauguauugggugucuugcggaaccggcaauaucguuuccgcggugaacaugacaagccgcaugcugcucaaucgguucaccauggcccacagaaagccgacguacgagcgcgacgucgaucuggggaccggaacaagacauguggcuguggaaccugaggucgccaaccuugacauuaucggccagcggauugaaaacaucaaacacgagcauaagucuaccuggcacuaugaugaggacaaucccuacaaaacaugggcuuaucauggguccuacgaaguuaagcccagcggaucugccuccagcauggugaacggcguggucaagcugcucaccaaaccuugggaugugauucccaugguuacacagaucgcuaugaccgacacgacaccuuuuggccaacagcgcguguucaaggagaaagucgacaccagaaccccgaaggccaaacgggggacagcgcagaucauggaagugacggccagauggcuguggggauuucuuucccggaauaagaagccccgcauuuguaccagagaggaguucacacggaaaguucgcagcaacgcugccaucggcgcuguguuugucgaugagaaucaauggaacucugccaaggaggccguggaagacgagagauucugggaucugguucaccgggaacgcgagcuccacaaacaggggaagugcgcgaccugcguguauaauaugaugggaaaaagagaaaagaagcugggcgaguuugggaaagcuaagggcagccgggccauuugguacauguggcugggagcccgcuuccucgaguucgaagcucugggcuuuaugaacgaggaccauugguucuccagagaaaauucucuuagcggggucgagggagagggccugcacaaacucggguacauccugcgggauauuuccaagaucccuggaggcaacauguaugccgacgauacagcugggugggacacccgcaucacagaagaugaccuucagaaugaggccaaaauuaccgauaucauggaacccgagcaugcgcugcucgccaaggcuauuuuuaaacugacguaccagaacaagguggucagagugcaacggccugccaagaauggcaccguuauggacgugaucucucgcagagaucagcggggaagcggccaggucgggacauauggacugaacaccuucacaaauauggaagcucagcucauuagacaaauggaguccgagggcaucuuuucucccagcgaacuggagaccccgaaccuugccgaacgcgcgcuggacuggcucgagaaauacgggguggaacggcugaagagaauggccaucuccggagacgauugugugguuaaaccuauugacgaucgcuucgcuacggcccuuacagcucugaacgacaugggcaaggugcggaaagauaucccccagugggagccuagcaagggguggaaugacuggcagcagguccccuuuugcucucaccacuuccaucaacucauuaugaaggauggcagagagaucgugguuccuugucgcaaccaggacgaacuggugggacgggccagagucucccagggcgcuggguggagccugcgcgagaccgccugccucggaaaaucuuaugcgcagauguggcaacugauguacuuucaccggagagaucuucgccuggccgcuaaugccauuuguuccgccgugcccgucgacugggugccgacaagccggaccacgugguccauccaugcucaccaucaguggaugaccacagaagauaugcucucuguuuggaacagaguguggauugaggaaaauccuuggauggaggacaagacccacaucagcuccugggaggacguccccuaucugggcaaacgggaagaucaguggugcgggagccuuaucggacugacagccagagcgaccugggcuacaaacauucaaguggccaucaaucagguucgccggcucauuggcaacgagaauuaccuggacuacaugaccucuaugaagagauucaaaaacgaauccgaucccgagggggcccugugguga

SEQ ID NO: 19245 - RNA, 9879 nt, Artificial Sequence
  derived and/or modified CDS sequence (opt5) from DENV-1__GU131821__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggaugucuuacgugauguguacaggcuccuucaagcuggagaaagaagucgccgagacccagcauggaaccgugcucguucagaucaaguaugagggcacagacgcgccgugcaaaauuccuuuuagcacccaggaugaaaagggggugacacaaaacggaagacugaucacggcuaaucccaucgucaccgacaaagagaagccugugaacauugaagccgagccgcccuucggcgagucuuacaucgugauuggggccggagaaaaggcucugaaacuuagcugguuuaagaaaggcuccucuaucgggaagauguucgaggccacagcucggggcgccagacgcauggcgauucucggagauaccgccugggacuuuggcagcaucgggggaguuuucacauccgucggcaaacuggugcaccagaucuuugggaccgcuuauggagugcuguucagcggcgucucuuggacgaugaagauugggaucggcgugcuccugaccuggcuuggacucaauucccggagcacaucucucuccaugaccuguauugccguuggccuggugacacuguaccuuggggucauggugcaggcugauagcggaugcguuaucaacuggaagggcagagaacucaaauguggguccggaauuuuugugaccaaugagguccauacauggaccgaacaguacaaguuccaagccgacucuccuaaacgccugagcgcggccaucggcaaggcuugggaggagggggugugcggcauucgguccgccacgagacuggaaaacaucauguggaaacagaucucuaacgagcucaaucacauucugcuugaaaacgacaugaaguuuacaguuguggucggagauguggcuggcauccuggcccaggggaaaaagaugauucgcccgcagcccauggaguauaaguacagcuggaaauccuggggaaaggccaaaaucauuggcgcugacgugcaaaauaccaccuucaucaucgaugggccuaacacacccgaauguccugacgaucagcgggcguggaauauuugggaggucgaggacuauggauuuggcaucuucaccacgaacauuuggcucaagcugagagauagcuacacacagguuugcgaccaccgccugaugucugccgcuaucaaagauuccaaggccgugcaugccgacaugggcuauuggauugaaagcgagaagaaugaaaccuggaaacuugcucgggccucuuucaucgaggugaagacauguaucuggcccaaaucccacacccucuggagcaacgggguccuggaaucugagaugauuaucccgaagauuuacggaggcccuaucagccagcauaauuauagacccggguacuuuacacaaaccgcgggaccuuggcaccugggcaaacucgagcuggauuucgaccuuugcgaagggacgaccgugguuguggaugagcacugcggaaaccgcggccccucccugcggacaaccacagucaccggcaagauuauccaugaaugguguugcagaagcuguacgcucccuccccugcgguuuaagggggaggacggaugcugguacggcauggagauccgcccggugaaagaaaaggaggaaaaucugguuaaaucuaugguguccgcugggagcggagaggucgacuccuucucucuuggccuccuguguauuagcaucaugauugaagaggugaugagaucccgguggucuagaaagaugcugaugacagggacccucgccgucuuuuuccugcuuaucaugggacagcugacauggaacgaucucauucgccugugcaucauggugggcgccaaugcuagcgaccggaugggcauggggaccaccuaucuggcccuuauggcgacauuuaaaaugagaccuauguucgcugucggacugcucuuucgcagacugacgucccgggaggugcuccugcuuaccauuggccugucucucguggccagcgucgaacugcccaacucccuggaggaacuuggggauggacuggccaugggcaucaugauccucaagcugcucacagacuuccagagccaccaacugugggcuacccuucugucucucacauuuauuaagaccacguucucccugcauuacgccuggaaaacaauggcuaugguucugagcaucgugucucuuuuuccccugugucucuccaccaccagccagaagacaaccuggcugccugugcuccuggggucucuuggaugcaaaccgcugacaauguuccugauugccgagaauaagaucuggggccgcaaauccuggccccucaacgaaggcauuauggcggucgggaucgugagcauccugcuuuccagccugcucaagaacgauguuccucuggccggaccccucauugcuggcgggaugcugaucgccuguuaugugauuucuggaagcuccgcugaccuuucucuggagaaagccgccgaggucagcugggaagaggaagcugagcacuccggcgcgucucauaauauccugguggaaguucaggaugacgggacgaugaagauuaaggaugaggagagagacgauacccucacaauccugcuuaaagccacccugcucgcugugagcggagucuacccucuguccauccccgccacacucuucgugugguauuuuuggcagaagaaaaagcaacggucuggcguccugugggacaccccuagcccucccgaaguggagcgcgccguucuugaugacggcauuuacagaaucaugcagcgggggcugcugggacgcucccaggugggcgucgggguguuccaggaaaacguuuuucacacgauguggcacgugaccagaggagcuguccucauguaucaaggcaaacggcuggagcccagcugggccucugugaagaaggaccuuauuuccuacgggggaggcuggcgccugcagggcagcuggaauacaggggaggaagugcagguuaucgcggucgagcccggcaaaaauccuaagaaugugcagaccgcucccggcacauucaaaaccucugaaggggaggugggagccauugcccucgauuuuaagccgggcacauccgggagcccuaucgucaacagagaaggaaaaauugugggccuguacggcaaugggguugugacgaccuccggaacauaugucucugcuaucgcccaagcgaaggcuagccaggagggcccccucccugagaucgaagacgagguguuccggaagagaaaccugaccauuauggaucuucaucccggguccggaaaaacccgccgguaccugcccgccaucguuagagaagccauuaagcgcaaacugcggacacucauccuggcuccuacgagaguggucgccagcgagauggcugaagcccuuaagggcaugccgauucgcuaucagaccacagcggugaaaucugagcacaccgggaaggagaucguugaccugaugugccaugccacauuuaccaugcggcuccugucccccgugagagucccuaauuacaacaugaucauuauggaugaagcucacuucacggaccccagcucuaucgccgcucgcggcuauauuagcacacgggugggaaugggcgaggccgccgcuaucuuuaugaccgcgaccccucccggguccguggaagccuucccucaaucuaaugcugucauucaggaugaggaaagagacaucccggagcggagcuggaacuccggauacgaguggaucacagauuuucccggcaagaccguuugguucgugccuucuauuaaaagcgggaaugacaucgccaacugucugcgcaagaauggaaaaagagugauucagcucucccggaagacauucgauaccgaauaucagaaaacgaagaacaacgacugggacuacgucgugacaaccgauaucagcgagaugggcgccaauuuucgcgcugacagaguuauugauccccggagaugccuuaagccugugauccugaaagacgggcccgaacgcgucauucuggccggcccgaugccugugacaguugcgucugcugcccaacggagaggacgcaucggccggaaccauaauaaggagggggaucaguacaucuauaugggacagccccucaacaaugacgaggaucacgcccacuggaccgaagcuaaaaugcugcuugacaacauuaauacgcccgagggcaucauuccugcccuguucgaacccgagagagaaaaguccgcggccaucgauggggaguaccgccuccggggagaggcuagaaaaaccuuuguggaacugaugcgcagaggcgaccugccugucuggcucagcuauaagguggccuccgagggguuccaguacucugaucggcgcuggugcuuugacggcgaaagaaacaaucaaguccuugaggaaaacauggauguggagauuuggacaaaagagggagaacggaagaagcugcgcccgagauggcuggacgcucggaccuauagcgacccccucgcccugagagaguucaaagaauuugcugccggccgccgguccguuucuggggaucuuauccuggagaucggaaagcucccucagcaucugacacagagagcgcagaaugcccuggacaaccucgugaugcuucacaauagcgaacaaggcgggcgcgcuuaccggcaugccauggaggagcugcccgauaccauugaaacacugaugcuccuggcucuuaucgccgugcugaccggaggcgucacgcuguucuuucuguccggcagagggcugggaaaaacaagcauuggccuccuuuguguuauggccucuuccgcucugcuguggauggcgagcguggagccucacuggaucgccgcuucuauuauccucgaguucuuucugauggugcuucugauccccgagccggaccggcagcgcaccccucaggauaaccagcucgccuaugucgugauugggcugcuguucaugauccucaccguugccgcuaaugagaugggacuucuggaaacaaccaagaaagaccugggcauugggcacguggccgucgagaaccaucaccaugcgacaaugcucgauguggaccugcaccccgccuccgcuuggacgcuuuacgccgucgcuaccacaaucauuaccccuaugaugagacauacaaucgaaaacaccacggccaauauuagccugaccgcgaucgccaaccaagcugccauccucaugggacuggauaagggcuggcccauuucuaagauggacaucggcgugccucugcucgcucuugggugcuacagccagguuaauccccugacacugaccgccgcugugcucaugcuggucgcccacuaugcgauuaucggaccgggccuucaggccaaagcuacacgggaggcccaaaagcgcaccgcugccgggauuaugaaaaacccuacgguggauggaaucguugccaucgaccuggaucccguggucuacgacgcgaaguuugaaaaacagcucggccagauuaugcugcugauccucuguacaucccagauucuucugaugagaaccacaugggcucugugcgagucuaucacccucgccaccgggccccugacaacgcuuugggagggaagcccuggcaaguucuggaauaccacaauugcuguguccauggccaacaucuuccggggcagcuaucuggccggggcuggacucgccuuuucccugaugaagucucugggcgggggacgcagaggcaccggggcgcaaggagaaacacucggcgagaaauggaagcggcagcuuaaucagcugagcaaauccgaguucaacaccuacaagcgcucuggcaucauggagguggacagaagcgaagccaaagaggggcugaagcggggagagacgacaaagcacgcuguuuccagaggcaccgccaaacuccgcugguuugucgaacggaaucuggugaagccggaggggaaagugauugaucuuggauguggcagagggggauggucuuauuacugcgcuggccugaagaaagucaccgaaguuaagggcuauacaaaagggggacccggccaugaggaaccuauccccauggccaccuacggguggaaccucgugaagcugcacagcggaaaggacguguucuuuauuccucccgagaaaugugauacacugcucugcgacaucggcgaguccagcccuaauccgacgauugaagaggggcgcacccuucggguccugaagaugguggaacccuggcugagaggaaaccaguucuguaucaaaauucucaauccuuacaugcccucuguuguggagacacuggagcaaaugcagcgcaagcauggcggcaugcuuguccggaacccucuguccagaaauagcacccacgaaauguauugggugucuugcgggacaggaaacaucguuuccgcggugaauaugaccagccgcaugcuccugaaccgguuuacgauggcccacagaaaacccaccuacgagcgcgaugucgaccugggcgcugggacacggcauguggccguggaaccggaggucgcuaaccucgauaucauuggacagagaaucgaaaauauuaagcacgagcauaagucuaccuggcacuaugacgaggauaacccuuacaaaacaugggccuaucauggcuccuacgaaguuaagcccagcggguccgcuagcucuauggugaauggaguggucaaacugcuuaccaagcccugggacgugaucccuaugguuacacagauugccaugaccgauacgacacccuucggccaacagcgcguguuuaaagagaaggucgacaccagaaccccuaaggcgaaacggggcacagcccagaucauggaagugacggcuaaguggcuguggggguuccucagccgcaacaaaaagccgagaaucuguacccgggaggaauuuacaagaaaaguucgguccaaugccgcuauuggagccguguucgucgacgagaaccaauggaacucugccaaggaggcgguggaagaugagcgcuuuugggaccugguucacagagaacgggagcuucacaagcagggcaaaugcgcuaccugcguguauaacaugauggggaagcgcgagaaaaagcugggagaguucggcaaagccaaggggagcagagccaucugguacauguggcucggcgcucgguuccuggaguuugaagcccugggauucaugaaugaggaucauugguuuucccgcgaaaacucucucagcggcgucgagggggagggacugcacaaacuuggcuacauucugagagacaucuccaagauucccgggggaaauauguaugcugaugacacagccggcugggauacccggaucacagaagacgaucuccagaacgaggcgaagaucaccgacauuauggaaccugagcaugcccugcuugcuaaaucuaucuucaagcugacguaccagaauaaagugguccgcgugcaaagacccgccaagaacgggaccguuauggaugugauuagccggcgcgaccagagaggcuccggacaggucggcacauaugggcucaauaccuuuacaaacauggaagcucagcugauccggcaaauggagagcgagggaauuuucucuccuuccgaacuggagacccccaaccucgccggccgcgugcuggauuggcuugaaaaacacgggguggagagacugaagcggauggcgaucagcggagacgacuguguugugaagccgaucgaugacagauuugccacggcucucacagcccugaaugauaugggcaaaguccgcaaggacauuccucagugggaacccucuaaaggguggaacgauuggcaacaggugccuuucugcucccaccauuuucaccaacuuaucaugaaggacggccgggagauuguugugcccuguagaaaucaggaugagcuggucggacgcgcucgggugagccagggcgccggguggucccucagagaaaccgcuugccugggaaaaucuuacgcccagauguggcaacugauguauuuccaucgccgggaccucagacuggcggccaacgcuaucuguagcgccgucccuguggaguggguucccacaucccgcaccacguggagcauucacgcccaucaccaguggaugaccacagaagauaugcuuucuguguggaaucgggucuggaucgaggaaaacccguggauggaggacaagacccacauuuccagcuggggcgaugugccuuaccuggggaagagagaggaccaguggugcggaucucucaucggccugacagcucgcgccaccugggcgacaaauauccaaguugcuauuaaccaggugcggagacuuaucgggaaugaaaacuaucuggacuacaugaccagcaugaaacgguuuaagaaugaguccgaucccgaaggcgcccucugguga

SEQ ID NO: 19246 - RNA, 9879 nt, Artificial Sequence
  derived and/or modified CDS sequence (opt5) from DENV-1__JF937617__SS-prME
agcgugaccaugcugcugaugcugaugcccacagcccuugcuuuccaccugacgaccagaggcggggagccucauauggugguuuccaagcaggaacggggaaagucucuccuguuuaagaccagcgccggcgugaacaugugcacccuuaucgcgauggaccugggggagcucugugaagauacaaugaccuacaaaugcccccgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggcugggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacguuauguggaaacagaucuccaacgagcuuaaucauauccugcucgaaaacgacaugaaguucacaguggucgugggagauguggcuggcauucuggcccaggggaaaaagaugauccggccgcaacccauggaguacaaauauucuuggaaaagcuggggaaaggccaagauuaugggcgcugacguccagaauaccaccuuuaucauugaugggccuaacacacccgaauguccugacgaucagagagcguggaauaucugggagguugaggacuacggauucggcaucuuuaccacgaacauuuggcugaaacuucgcgauuccuauacacaggugugcgaccaccggcucaugagcgccgcuaucaaagauucuaaggccgugcacgccgacaugggcuacuggauugaauccgagaaaaaugaaaccuggaagcuggcuagagccagcuucaucgaggucaagacauguauuuggcccaaaucucauacccugugguccaacggggugcucgaaagcgagaugaucaucccgaagauuuauggaggcccuaucucucaacacaauuaccgccccggguacuucacacagaccgcgggaccuuggcaucugggcaaacuugagcuggauuuugaccucugcgaagggacgaccguuguggucgaugagcacugcggaaaccggggccccagccugagaacaaccacagugaccggcaagauuauccacgaaugguguugccgguccuguacgcugccuccccuucgcuucagaggggaggacggaugcugguauggcauggagauucggccgguuaaagaaaaggaggaaaaucucgucaagagcauggucucugcuggguccggagagguggacagcuuuucccugggccugcucuguaucucuaucaugauugaagagguuaugagaagccgcuggucccggaaaaugcugaugacagggacccuuguggucuuccugcuccugaucaugggacagcugacauggaacgaucuuauuagacugugcaucauggugggcgccaaugccucugaccgcaugggcauggggaccaccuaccucgcucugauggccacauuuaagaugagaccuauguucgcggugggacuccuguuucggcgccuuacgagcagagagguccugcuccugaccauuggccugucccuuguugcuucuguggaacugcccaacagccucgaggaacugggggauggacucgccaugggcaucaugauucugaaacuucugacagacuuccaaucccaucagcucugggccacccugcugagccuuacauuuaucaagaccacguucucucugcacuaugcuuggaaaacaauggccauggugcucuccaucgucagccuguuuccccucugucugucuaccaccucccagaagacaaccuggcuuccugugcugcuggggagccucggaugcaagccgcugacaauguuccuuauugcugagaauaaaaucuggggccggcgcucuuggccccugaacgaaggcauuauggccguugggaucguguccauucuccugagcucccuccugaagaacgaugucccucuugcgggaccccugaucgccggcgggaugcugaucgcuuguuacgugauuagcggaucuagcgccgaccucucccuggagaaagcugccgagguuucuugggaagaggaagccgagcauagcggcgcuucccacaauauccuuguggaaguccaggaugacgggacgaugaagauuaaagaugaggagagagacgauacccugacaauccuccugaaggcgacccuccuggccgugucuggagucuauccucuuagcauucccgcuacacuguuugugugguacuucuggcagaagaagaagcagcgguccggcguucugugggacaccccuucucccccggaaguggagcgcgccguccucgaugacggcaucuauagaaucaugcagcgggggcugcuuggacgcagccaggugggcguugggguguuccaagaaaacgucuuucauacgauguggcacgugaccagaggagccgugcugauguaccagggcaaacggcucgagccuuccugggcuagcguuaagaaagaccugauuucuuacgggggaggcuggagacuccagggcuccuggaauacaggggaggaaguccaggugaucgccguggagcccggaaagaacccuaaaaauguccaaaccgcgcccggcacauucaagaccccggaaggggagauuggagcuaucgcccuggauuuuaagccuggcacaagcgggucucccauugugaaccgcgaaggaaaaaucguuggccuuuauggcaaugggguggucacgaccuccggaacauacgugagcgccauugcucaggccaaggcgucccaggagggcccucugcccgagaucgaagacgagguuuuccggaaaagaaaccugaccaucauggaucuccaccccgggucuggaaagacccgccgguaucugccugcuauugugagagaagccaucaaacgcaaacuucggacacugauucucgccccgacgagagucguggcuagcgagauggccgaagcucugaagggcaugcccauccgcuaccaaaccacagccguuaaauccgagcauaccgggaaggagauuguggaccugaugugccacgcgacauuuaccaugcggcuccuuagcccugucagagugcccaauuauaacaugaucaucauggaugaagcccauuucacggacccuucuuccauugcugcccggggcuacaucagcacacgcgugggaaugggcgaggcugccgccauuuuuaugaccgcuacacccccugggucugucgaagcguucccgcagagcaaugccguuauccaggaugaggaaagagacauucccgagcgguccuggaacucuggauaugaguggaucacagauuuuccuggcaaaaccgugugguucgugcccagcaucaaguccgggaaugacauugcuaacugucugcgcaaaaauggaaagagagucauccagcugucucggaagacauuugauaccgaauaccagaagacgaagaacaacgacugggacuacgugguuacaaccgauauuagcgagaugggcgccaauuucagagccgaccgcgugaucgauccucggagaugccucaaacccgucauucugaaggacgggccggaacgcgugauccuugcuggcccuaugcccguuacaguggccuccgcggcucagcggagaggacgcauuggccggaaccacaauaaagagggggaucaguauaucuacaugggacagccccugaacaaugacgaggaucaugcccacuggaccgaagccaagaugcuccuggacaacaucaauacgccugagggcauuauccccgcucuguucgaaccugagagagaaaagagcgccgcgauugauggggaguaucgccucagaggagaggcccggaaaaccuuugucgaacuuaugcgcagaggcgaccugccgguguggcugucuuacaaggucgcuuccgagggguuccaauauagcgaucggcgcuggugcuuugacggcgaaagaaacaaucaggugcucgaggaaaacauggauguugagaucuggacaaaagagggagaacggaagaaacugagaccccgcuggcuugacgcccggaccuacuccgacccucuggcucucagagaguucaaggaauuugccgcuggccgccggucugugagcggggaucugauucuggagaucggaaaacucccccagcaccuuacacagagagcccaaaaugcgcuggacaaccuggugaugcuccauaauuccgaacagggcgggcgggccuaucgccacgcuauggaggagcugccugauaccaucgaaacacuuaugcugcucgcccugauugcuguccugaccggaggcguuacgcuguucuuucuuucuggcagagggcugggaaagacaagcaucggccugcucugugugauggccuccagcgugcugcuuuggauggccucugucgagccccauuggauugcugcguccaucauucuggaguucuuucucauggugcugcugaucccggagccugaccggcagcgcacaccccaagauaaccaacucgccuacguugugaucgggcuucuguucaugauucugaccgucgcugccaaugagaugggacuccuggaaaccaccaagaaagaccuuggcaucgggcacgccgcugugggaaaccaccaucacgccgcgaugcuggaugucgaccuccauccugccagcgcuuggacacuguacgccguggcuacgaccauuaucacacccaugaugagacacaccauugagaacacaaccgccaauaucucucugacggcgauugccaaccaggcugccauccucaugggccuugauaagggcuggccuaucuccaaaauggacauugggguuccccugcuggcucucggaugcuauagccaggugaauccgcugacccuuacagccgcuguccugaugcucguggcccauuacgcgaucauuggcccugggcugcaagccaaggcuacccgggaagcccagaaacgcacagcugccggaaucaugaagaaccccaccguugauggcauuguggccaucgaccuggaucccgucguguaugacgcgaaguuugagaaacagcucgggcagaucaugcuucugauucuguguacgucucaaauccuccugaugagaacaaccugggcucuuugcgaaagcauuacacuggccaccggaccucucaccacacugugggagggcuccccgggcaaguucuggaauacgaccaucgcugugucuauggccaacauuuuucgggggagcuaccuggccggagcuggccucgccuucucccuuaugaaaagccucgggggaggccgcagagggacaggagcgcagggcgagacccugggcgaaaaguggaaacggcagcucaaucagcuguccaagucugaguucaacacauauaagagaagcgggaucauggaaguugaccgcuccgaggccaaagaaggacuuaagcggggcgagaccacgaaacacgcugucucuagagggacagccaagcugcgcugguuuguggagcggaaucucgugaaacccgaaggaaaggucaucgaucugggcugugggagaggaggcuggagcuacuauugcgcuggccugaagaaaguuaccgaggugaagggguacaccaaaggaggcccugggcacgaagaacccauuccuauggccacauacggauggaaccucgugaaacuucauuccggcaaagacgucuucuuuauucccccugaaaagugugauacccugcugugcgacaucggggagucuagcccgaaucccacaaucgaggaaggacgcacgcuccgggugcugaaaaugguugagccuuggcuuagaggcaaccaauucuguauuaagauccugaaucccuauaugccuuccguggucgaaacccucgagcagaugcagcgcaagcacggcgggaugcuggugcggaacccccugagcagaaauucuacacaugagauguacuggguuuccugcggaaccggcaacauugugagcgcggucaauaugacaucucgcaugcuccugaaccgguuuaccauggcccacagaaaaccgacguaugaacgcgauguggaccuuggggcuggaaccagacacguggccgucgagccugaaguugcuaaccuggauaucaucggccagcggauugagaauaucaagcaugaacacaaauccacauggcauuacgacgaggauaaccccuauaagaccugggccuaccacgggagcuaugaggugaaacccucuggauccgcuagcuccauggugaauggcgucgugaagcuccugacaaagccuugggacguuauucccauggugacccaaaucgccaugacagauaccacgccuuucggccagcagcgcgucuuuaaagaaaagguggacacaagaaccccgaaagcgaagcgggggaccgcccaaauuauggagguuacagcuaaauggcuuuggggauuccugagcagaaacaagaagccccggaucuguacgcgcgaagaguuuaccagaaaagugcggucuaaugccgcuaucggcgccgucuucguggacgaaaaccaguggaauagcgccaaggaggcgguugaggaugaacgcuuuugggaccucgugcauagagagcgggaacugcacaaacaggggaagugcgcuacaugcgucuacaacaugaugggaaaacgcgagaagaagcugggcgaguucgggaaagccaagggcuccagagccauuugguacauguggcucggagcucgguuucuggaguucgaggcccuuggcuucaugaaugaagaucacugguuuucucgcgagaacagccuguccgggguggaaggagagggccuccauaaacugggguauauccuuagagacauuucuaagaucccuggaggcaauauguacgcugaugacaccgccgggugggauacacggauuaccgaggacgaucugcagaacgaagcgcgcaucacagacaucauggagcccgaacacgcccuccuggcuaaaagcauuuucaagcugaccuaucaaaauaaagucgugagaguucagcggccugccaagaacggcacggugauggaugucaucucccgcagagaccagcggggaucuggccagguggggaccuacggacucaauacauuuaccaacauggaggcucaacugauuagacagauggaaagcgagggcaucuucucccccagcgagcuugaaacaccgaaccuggccgagcgcgugcucgauuggcuggaaaaguaugggguugagcggcuuaaaagaauggcgauuucuggagacgacuguguggucaagccuaucgaugaccgcuuugccaccgcucugacggcccucaaugauaugggcaaagugcggaaggacaucccccagugggaaccuuccaaaggguggaacgauuggcagcaaguucccuucugcagccaucacuuucaccagcugauuaugaaggacggcagagagaucguggucccuugucgcaaucaggaugagcuggugggacgggcuagagucucucagggcgccggguggucccuccgcgaaacagcuugccugggaaagagcuacgcccaaauguggcagcuuauguauuuccaucggagagaccugcgccucgcggccaacgcuauuuguuccgccgugcccguugauuggaucccgaccucucggacaaccuggagcauucacgcccaucaccaguggaugacgaccgaggacaugcuguccguguggaauagagucuggaucgaagagaacccuuggauggaagauaaaacacauauuagcucuuggggcgacgugcccuaccuugggaagcgggaggaccaauggugcggaucccugaucggccucaccgcuagagccacaugggcgaccaauauccagguugcuauuaaccaggugcgccggcugaucgggaaugagaacuaccuggauuauaugacaagcaugaaaagauuuaagaaugaaucugaccccgagggcgcccucugguga

SEQ ID NO: 19247 - RNA, 9879 nt, Artificial Sequence
  derived and/or modified CDS sequence (opt5) from DENV-1__JF937618__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggagcucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaggacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccucgcaauguccaaacaacccccggcacauucaaaacgccggaaggggaggugggagcgauugcucucgauuuuaagccuggcaccagcgggucucccaucgugaaccgggaaggaaagaucgucggccuguauggcaauggggugguuacaaccuccggaaccuacgugagcgccauugcccaggcuaaagccucccaggagggcccucuucccgagaucgaagacgaggucuucagaaagcgcaaccugacaauuauggaucugcaccccgggucuggaaaaacgcggagauaucucccugcgaucgugcgcgaagcuauuaagcggaaacugagaacccuuauccuggccccgacacgcguuguggccagcgagauggcugaagcccucaagggcaugcccauccgguaccaaaccacagcugucaaguccgagcauaccgggaaagagauuguggaccugaugugccacgccacguuuacaaugagacugcucagcccuguucgggugcccaauuauaacaugaucauuauggaugaagcgcauuucaccgacccuucuuccaucgccgcucgcggcuacauuagcaccagagucggaaugggcgaggccgcugccaucuuuaugacagccacacccccugggucuguggaggcuuucccgcagagcaaugcggugauccaggaugaggaacgggacauucccgagcgcuccuggaacucuggauaugaguggaucacagauuuuccuggcaagaccgucugguucguucccagcauuaaauccgggaaugacaucgccaacugucuuagaaagaauggaaaacgggugauucagcugucuagaaagacguuugauacagaauaccaaaagaccaaaaacaacgacugggacuacguggucacaaccgauaucagcgagaugggcgcuaauuuccgcgccgaccgggugauugauccuagacgcugccugaagcccguuauccucaaagacgggccggaacgggugauccuggccggcccuaugcccgucacgguggcuuccgccgcgcagagacgcggacggauuggcagaaaccacaauaaggagggggaucaguauaucuacaugggacagccccuuaacaaugacgaggaucaugcucacuggaccgaagccaaaaugcugcucgacaacauuaauacaccugagggcaucauucccgcccuguucgaaccugagcgcgaaaagagcgcugccaucgauggggaguauagacugcggggagaggcgcgcaagaccuuuguugaacucaugagacggggcgaccuuccgguguggcugucuuacaaagucgccuccgagggguuccaauauagcgaucgcagauggugcuuugacggcgaacggaacaaucaggugcuggaggaaaacauggaugucgagaucuggacaaaggagggagaacgcaaaaagcuccgcccccgguggcuggacgcuagaaccuacuccgacccucuugcccugcgcgaguucaaagaauuugcugccggccggagaucugugagcggggaucucauucuggagaucggaaagcugccccagcaccucacacagcgggcucaaaaugcccuugacaaccugguuaugcugcauaauuccgaacagggcgggcgcgcguauagacacgccauggaggagcucccugauaccauugaaacgcugaugcuucuggcucucaucgccgugcugacaggaggcgugacccuguucuuucucucuggccgggggcuuggaaaaaccagcauuggccugcugugugucauggcuuccagcguucuccuguggacagccucuguggagccccauuggaucgccgcuuccaucauucuugaguucuuucugauggugcuccugaucccggagccugaccgccagagaacaccccaggauaaccaacuggcguacgucgugauugggcuccuuuucaugauccugacaguugccgcuaaugagaugggacugcucgaaacgaccaagaaggaccugggcauugggcacguggccgucggaaaccaccaucacgccgcuaugcuugauguggaccugcauccugccagcgcguggacacucuacgccgucgcuaccacaaucauuacccccaugaugcggcacacgaucgagaacaccacagccaauaucucucugaccgcuauugccaaccaggcggccauccugaugggccucgauaaaggcuggccuauuuccaagauggacaucggggugccccuucuggcucugggaugcuauagccagguuaauccgcucacacugaccgccgcugugcuuaugcuggucgcccauuacgcuauuaucggcccugggcuccaagccaaagcgacgcgcgaagcccagaagagaacagcugccggaaucaugaaaaaccccaccguggauggcauuguugcuaucgaccuggaucccguggucuaugacgccaaguuugagaagcagcuggggcagauuaugcuccuuauccuguguacaucucaaauucugcucaugcggaccaccugggcccugugcgaaagcaucacacuugcgacgggaccucugaccacacucugggagggcuccccgggcaaauucuggaauaccacaaucgcugugucuauggccaacauuuuucgcgggagcuaccuggcuggagccggccuggccuucucccucaugaaaagccuugggggaggcagacgggggaccggagcucagggcgagacgcugggcgaaaaauggaagagacagcugaaucagcucuccaaaucugaguucaacacauauaagcgcagcgggaucauggaaguggaccgguccgaggccaaggaaggacugaaaagaggcgagaccaccaagcacgcgguuucucgcgggacagccaaacuucggugguuugucgagagaaaucuggugaagcccgaaggaaaagugauugaucucggcugugggcgcggaggcuggagcuacuauugcgcuggccugaagaaggucaccgagguuaaaggguacacaaagggaggcccugggcacgaagaacccaucccuauggccacguacggauggaaccuggugaaacuccauuccggcaaggacguguucuuuauucccccugaaaaaugugauacccuucugugcgacaucggggagucuagcccgaaucccacaauugaggaaggacggacccugagaguccucaagaugguggagccuuggcugcgcggcaaccaauucuguaucaaaauccuuaaucccuauaugccuuccguuguggaaacacuggagcagaugcagcggaagcacggcgggaugcucgucagaaacccccugagccgcaauucuacccaugagauguacuggguguccugcggaacgggcaacauuguuagcgcugugaauaugaccucucggaugcugcucaacagauuuacaauggcccaccgcaagccgaccuaugaaagagaugucgaccugggggcgggaacacggcacguggccguggagccugaagucgcuaaccuugauaucauuggccagcgcaucgagaauauuaaacaugaacacaaguccaccuggcauuacgacgaggauaaccccuauaaaacaugggccuaccacgggagcuaugagguuaagcccucuggauccgcuagcuccauggugaauggcguggucaaacugcucaccaagccuugggacgugauccccaugguuacgcaaaucgccaugacagauaccaccccuuucggccagcagagaguguuuaaggaaaaagucgacacacggacgccgaaggcuaaaagagggaccgcccaaauuauggaggugacagcgaaguggcuguggggauuccuuagccggaacaaaaagccccgcaucuguaccagagaagaguuuacacggaagguucgcucuaaugccgcuauuggcgccguguucgucgacgaaaaccaguggaauagcgcuaaagaggccguggaggaugaaagauuuugggaccugguucaucgggagcgcgaacuccacaagcaggggaaaugcgcgaccugcguguacaacaugaugggaaagagagagaaaaagcugggcgaguucgggaaggcgaaaggcucccgggcuaucugguacauguggcugggagcccgcuuucucgaguucgaggcccugggcuucaugaaugaagaucacugguuuucuagagagaacagccuuuccggggucgaaggagagggccugcauaagcucggguauauucugcgggacaucucuaaaaucccuggaggcaauauguacgcugaugacacagccgggugggauacccgcauuacggaggacgaucuucagaacgaagcuagaaucaccgacauuauggagcccgaacacgcccugcucgccaagagcaucuucaaacugacauaucaaaauaaggugguccgggugcagcgcccugccaaaaacggcaccguuauggaugugauuuccagacgggaccagagaggaucuggccaggucgggacauacggacugaauaccuuuacgaacauggaggcucaacucauccgccagauggaaagcgagggcaucuucucccccagcgagcuggaaacaccgaaccuugccgagcgggugcuggauuggcucgaaaaguaugggguggagagacugaagcgcauggcuauuucuggagacgacuguguugugaaaccuaucgaugaccgguuugccaccgcgcuuacagcccugaaugauaugggcaaggucagaaaagacauuccccagugggaaccuuccaagggguggaacgauuggcagcaagugcccuucugcagccaucacuuucaccagcucaucaugaaagacggccgcgagauuguugugccuugucggaaucaggaugagcuggucggcagagcucgcgugucucagggcgccggguggucccugcgggaaaccgcuugccucggaaagagcuacgcccaaauguggcagcugauguauuuccauagacgcgaccuucggcuggcugccaacgcgaucuguuccgccguccccguggauuggauuccgacgucuagaaccacauggagcauccacgcucaucaccaguggaugaccacagaggacaugcucuccguuuggaaucggguguggaucgaagagaacccuuggauggaagauaagacccauauuagcucuuggggcgacguccccuaccuggggaaaagagaggaccaauggugcggaucccuuaucggccugacagcccgcgccaccugggcuacgaauauucagguggccaucaaccagguucggagacucauugggaaugagaacuaccuggauuauaugacaagcaugaagcgcuuuaaaaaugaaucugaccccgagggcgcgcugugguga

SEQ ID NO: 19248 - RNA, 9879 nt, Artificial Sequence
  derived and/or modified CDS sequence (opt5) from DENV-1__JF937619__SS-prME
agcgugaccaugcugcucaugcugaugcccacggcccuugcuuuccaccugacgaccagaggaggggagccucauaugaucguguccaagcaggaacggggaaagucucuccuguuuaagaccagcgccggcguuaacaugugcacccuuauugcgauggaccugggggagcucugugaagauacaaugaccuacaagugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugacuccggaugcguuaucaacuggaaaggccgcgagcugaagugugggagcggaauuuucgugaccaaugaaguccacacauggaccgagcaauauaaguuucaggccgauuccccuaaacggcucucugcggccaucggcaaggcuugggaggaaggggugugcggcauuagaagcgccacgcgccuggagaacaucauguggaaacagaucuccaacgaacuuaaucauauucugcucgagaacgacaugaaguucacaguuguggucggagacguggcuggcauccuggugcaggggaaaaagaugauucggccgcaacccauggaauacaaauauucuuggaaaagcuggggaaaggccaaaaucauuggcgccgauguccaaaauuccaccuuuaucaucgacgggccuaacacccccgaguguccugaugaccagagagcuuggaauauuugggagguugaagauuacggauucggcaucuuuacaaccaacauuuggcugaaacuucgcgacagcuauacacaggugugcgaucaccggcucaugucugcggccaucaaagacuccaaggcugugcacgccgauaugggcuacuggauugagagcgagaagaaugagacauggaagcuggccagagcuucuuucaucgaagucaagaccuguaucuggcccaaaucccauacacuguggagcaacggggugcucgagucugagaugauuaucccgaagauucacggaggcccuaucagccaacauaauuaucgccccggguacuucacccagacagccggaccuuggcaccugggcaaacuugaacuggacuuugaucucugcgaggggaccacgguuguggucgacgaacacugcggaaaccggggccccucccugagaaccacaaccgugacaggcaagauuauccaugagugguguugccggagcuguacccugccuccccuucgcuucagaggggaggauggaugcugguacggcauggaaauccggccgguuaaagagaaggaagagaaucucgugaagucuauggucuccgcggggagcggagaaguggacuccuuuucucugggccugcucuguauuagcaucaugauugaggagguuaugagaucccgcuggucucggaaaaugcugaugacggggacacuugcuguguucuuucugcucaucaugggacagcugaccuggaacgaccugauuagacuuugcaucauggucggcgccaaugccagcgaucgcaugggcauggggacaaccuaucuggcucucauggugaccuucaagaugagaccuauguuugccgugggacugcuguuccggcgccugacauccagagaaguccuucugcucacgauuggccugucucugguugcgagcguggagcuucccaacucccuggaagaacugggggacggacuggcuaugggcaucaugauccucaaacugcuuaccgauuuucaaagcuaccagcugugggccacacuccugucucugaccuucauuaagacaaccuuuucccuucacuaugccuggaaaacgauggcuauggugcugagcaucgucucucucuucccccugugucucuccacaaccagccagaagaccacauggcugccugugcuucuggggucucugggaugcaagccgcucaccauguuucugauugccgaaaauaaaaucuggggccggaaguccuggccccuuaacgagggcauuauggcuguugggaucgugagcauccugcucuccagccugcucaaaaacgacgucccucuggccggaccccuuauugcgggcgggaugcugaucgccuguuacgugauuucuggaagcuccgcugaucugucucucgagaaggccgcugaaguuagcugggaggaagaggccgaacauuccggcgccucucacaauauccugguggagguccaggacgaugggacaaugaaaauuaaggacgaggaacgcgaugacacgcuuaccauccugcucaaagcuacacugcucgcggugagcggagucuauccucuguccauccccgccacccuuuucguguggcauuucuggcaaaagaagaaacagagaucuggcguucugugggauacaccuagcccucccgagguggaacgggcuguccuggacgauggcauuuaccgcaucaugcagagagggcuccugggacggucccaggugggcguugggguguuucaagagaacgucuuccacaccauguggcacgugacgcgcggagccgugcuuauguaucagggcaagagacuggagcccagcugggccucuguuaaaaaggaccucauuuccuacgggggaggcuggcgguuucagggcagcuggaauaccggggaagagguccaggugaucgcuguggaacccggcaagaacccuaagaauguccaaacagcccccggcaccuucaagacaccggagggggaagugggagcgauugcucuggacuuuaaaccuggcaccucugggucccccaucguuaacagagagggaaagauugugggccucuacggcaauggggucgugacaacgagcggaaccuauguuuccgccaucgcccaggcuaaagccucucaggagggcccucugcccgaaaucgaggaugaaguguuccgcaagcggaaccuuacaauuauggaccugcaucccgggagcggaaaaaccagacgcuaccugccugcgaucguccgggaggcuauuaagagaaagcuccgcacccugauccuugccccgacacgggugguugccuccgaaauggcugaggcccugaaaggcaugcccauuagauaucaaacgaccgcugucaagagcgagcacacagggaaagaaaucgucgaucucaugugccaugccaccuuuacaaugcgccugcugucuccugugcgggugcccaauuacaacaugaucauuauggacgaggcgcacuucaccgauccuuccagcaucgccgcuagaggcuauauuucuacgcgggucggaaugggcgaagccgcugccaucuuuaugacagccacacccccugggagcauggaggcuuucccgcaguccaaugcgguuauucaggacgaagaacgcgauauccccgagagaucuuggaacagcggauacgaauggaucaccgacuuuccuggcaagacagugugguucgugcccuccauuaaagccgggaaugauaucgcuaacugucuccggaagaauggaaagcgcgucauucagcuuucuagaaaaaccuucgacacagaguaucaaaagaaaaagaacaacgauugggacuacgugguuaccacggacaucagcgaaaugggcgccaauuuucgggccgauagagugauugacccucgccggugccugaaacccgucauccugaaggaugggccggagagagugauucucgcuggcccuaugcccguuacaguggccuccgcggcucagcgccggggaagaaucggccgcaaccauaauaaggagggggaccaguacaucuauaugggacagccccugaacaaugaugaagaccacgcccacuggaccgaggccaaaaugcuucuggauaacauuaauacaccugaaggcaucauucccgcucucuucgagccugaacgggaaaagagcgccgcgaucgacggggaguacagacugcgcggagaagccagaaaaaccuuugucgagcugaugcggcgcggcgaucucccgguguggcuuucuuauaaggucgcuuccgaaggguuccaauacagcgacagacgguggugcuuugauggcgagcgcaacaaucaggugcuggaagagaacauggacguugagauuuggacgaaagaaggagagagaaagaaacugcggcccagauggcucgaugcccgcaccuauuccgacccucuggcccuucgggaguucaaggaguuugccgcuggcagacgcucugugagcggggaccugauccucgaaaucggaaagcugccccagcaucugacacagcgggcccaaaaugcgcucgauaaccuugugaugcugcacaauuccgagcagggcgggagagccuaccggcaugcuauggaggaacugccugacaccauugagacacucaugcugcuugcccugaucgcuguccucaccggaggcguuacacuguucuuucugucuggcaaagggcucggaaagaccagcauuggccuucugugugugauggccuccagcgugcugcucuggauggccucugucgaaccccacuggaucgcugcguccauuauccuggaguucuuucuuauggugcugcucaucccggagccugaucgccagagaacgccccaggacaaccaacuggccuauguugugauugggcuccucuucaugauccuuacagucgcugccaaugaaaugggacugcuggagaccaccaaaaaggaucucggcauugggcacguggccgucgaaaaccaucaccaugcugccaugcuggacguggaucuucacccugcgagcgccuggacacuguacgcuguugccaccacaaucauuacgcccaugaugcggcauaccaucgagaacacaaccgcuaauauuucucucacagccaucgcgaaccaggccgcuauccugaugggacuggacaaaggcuggccuauuuccaagauggauaucggcgugccccuccuugcccuggggugcuacagccaggucaauccgcugacccucacggcugccgugcugaugcuuguugcucacuaugccauuaucggaccuggccugcaagcgaaggccacccgcgaagcucagaaaagaacagccgcugggauuaugaagaaccccaccaucgacggaaucguggccauugaucucgaccccgucaucuacgaugccaaauuugagaagcagcugggccagauuaugcugcucauccuuuguacaucucaaauucugcugaugcggaccacgugggcgcucugcgagagcaucacacuggcuaccgggccucuuacaacccugugggaaggauccccgggcaaauucuggaauaccacaaucgccgugucuauggcuaacauuuuccgcggcagcuaucucgccggggccggacuggcuuuuucccugaugaaaagccucggcgggggaagacggggcacgggggcccagggagagacccuuggcgaaaaguggaaacgccagcugaaucagcuguccaagucugaguucaacacauacaaaagaagcggcaucauggaaguggaccgguccgaggcgaaggaggggcucaaaagaggagaaaccacaaagcacgccguuucucgcggcaccgcuaagcugcggugguuugucgagagaaaucuugugaaacccgaagggaaggugauugaccugggauguggccgcgggggauggagcuauuacugcgccggccucaaaaaggucacggagguuaaaggcuauacaaaagggggaccuggccaugaggaacccaucccuauggcuaccuacggguggaaccuggugaaacugcacuccggaaaggauguguucuuuauucccccugagaagugugacacccuccuuugcgauaucggcgaaucuagcccgaaucccacaauugaggaagggcggacccugagaguccugaaaaugguggagccuuggcuccgcggaaaccaauucuguaucaagauccugaaucccuacaugccuuccguuguggagacacuugaacagaugcagcggaaacauggcggcaugcuggucagaaacccccucagccgcaauucuacgcacgagauguauuggguguccugcgggaccggaaacauuguuagcgccgugaauaugacaucucggaugcugcugaacagauuuaccauggcgcaccgcaagccgacauacgaacgggacgucgaucucggcgccgggaccagacauguggcuguggagccugaagucgccaaccuggacaucauuggacagcgcaucgagaauauuaaacacgagcauaaguccacguggcacuaugaugaagacaaccccuacaagaccugggcuuaucauggcagcuacgagguuaaacccucuggguccgccagcuccauggugaauggaguggucaaacuucugacaaaaccuugggaugugauccccaugguuacccaaaucgcuaugacagacaccacaccuuucggccagcagagaguguuuaaggaaaaagucgauacccggacgccgaaggccaagcgcggcacagcgcaaauuauggaggugaccgccagauggcucuggggguuccugagccggaacaaaaagcccagaaucuguacccgggaagaguuuacacgcaaaguuagaucuaaugcugccauuggagcuguguucgucgacgagaaccaguggaauagcgccaaggaagccguggaggacgaucgguuuugggaccuuguucaccgcgaaagagagcugcacaaacagggcaagugcgcgacgugcguguauaacaugauggggaagcgggagaagaagcucggagaguucggcaaagcuaaggggucccgcgccaucugguacauguggcugggcgccagauuccuggaguuugaagcucucggauucaugaaugaggaucauugguuuucucgggaaaacagccuguccggcgucgagggggagggacuucacaaacugggcuacauucuccgcgacaucucuaagaucccugggggaaauauguaugccgaugacaccgcuggcugggauacaagaauuaccgaagacgaucugcagaacgaggccaaaaucacagacauuauggaacccgagcaugcgcuucuggccaagagcaucuucaagcucaccuaccaaaauaaagugguccgggugcagcgcccugcuaagaacgggacaguuauggaugugauuuccagacgggaccagcgcggcucuggacaggucggcaccuaugggcugaauacguuuaccaacauggaagcccaacugaucagacagauggagagcgagggaaucuuccuccccaacgaacuggagacaccgaaucuugcuggccgggugcuggauuggcucgaaaaauacgggguggagagacugaagcgcauggccauuuccggagacgacuguguugugaaaccuaucgaugaccgguuugcgaccgcccuuacagcucugaacgauaugggcaaggucagaaaggacauuccccagugggaaccuagcaaaggguggaaugauuggcagcaagugcccuucugcucucaccacuuucaucagcucaucaugaaggacggccgcgagauuguugugccuugucggaaccaggaugagcuggucggcagagcucgcgugucccagggagcuggguggagccugcgggaaaccgccugccucggaaaaucuuaugcucaaauguggcagcugauguacuuccacagacgcgaccuucggcuggccgcgaaugccaucuguuccgcuguccccguggauuggguuccgacgagcagaacaaccugguccauucaugcccaccaucaguggaugacaaccgaggacaugcucucuguguggaaccgcgucuggaucgaagagaauccuuggauggaagauaagacgcggaucagcuccugggaggacgugcccuaucugggcaaaagagaggaccaauggugcgggagccuuauuggacugaccgcccgggcuacaugggccaccaacauccagguugcgauuaaucaggugagacgccucaucggcaacgaaaauuacucugauuacaugacauccaugaagcgguuuaagaacgagagcgaacccgagggggcucugugguga

SEQ ID NO: 19249 - RNA, 9879 nt, Artificial Sequence
  derived and/or modified CDS sequence (opt5) from DENV-1__GU131827__SS-prME
agcgugaccaugcugcucaugcugaugcccaccgcccuugcuuuccaccugacgaccagaggaggggaaccucauaugauuguguccaagcaggaacggggaaaaucucuccuguuuaagacaagcgccggcguuaacaugugcacccuuauugcgauggaccugggggagcucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucagaaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcgcuauuaacuggaagggccgggaacugaaaugugggagcggaaucuucguuacaaaugaggugcacaccuggacggaacaauauaaguuucaggccgacuccccuaagagacugucugcggccauuggcaaggcuugggaggagggggucugcggcauccgcagcgccacacggcucgaaaacaucauguggaagcagauuuccaacgagcugaaucauauccuucuggaaaacgacaugaaauucaccgugguugugggagaugucgcuggcauucucgcccaggggaagaaaaugaucagaccgcaacccauggaguacaaguauucuuggaaaagcuggggaaaggccaagauuaucggcgcugacgugcagaauaccacauuuaucauugaugggccuaacacccccgaauguccugacgaucagcgcgcguggaauaucugggagguggaggacuacggauucggcauuuuuacgacaaacaucuggcugaaacugcgggauuccuauacccaggucugcgaccacagacuuaugagcgccgcuauuaaggauucuaaagccguucacgccgacaugggcuacuggaucgaauccgagaagaaugaaacauggaaacucgcucgcgccagcuucaucgaggugaagaccuguauuuggcccaagucucauacacugugguccaacggggugcuggaaagcgagaugaucauuccgaaaaucuauggaggcccuauuucucaacacaauuaccggcccggguacuucacccagacggcgggaccuuggcaucucggcaagcuggagcuugauuuugaccugugcgaagggaccacagucgugguugaugagcacugcggaaacagaggccccagccuccggaccacaaccgugacgggcaaaaucauccacgaaugguguugccgcuccuguacacugccuccccugagauucagaggggaagacggaugcugguauggcauggagauucggccggucaaggaaaaagaggaaaaucuugugaaaagcaugguuucugcuggguccggagagguggacagcuuuucccucggccugcuguguaucucuauuaugaucgaagaggucaugcgcagccggugguccagaaagaugcucaugaccgggacacuggccguguucuuucuucugauuaugggacagcucaccuggaacgaucugauccgccugugcauuaugguuggcgccaaugcuucugacagaaugggcauggggaccacauaccuugcccugauggcgacguucaaaaugcggccuauguuugcugugggacuccuguuccgcagacucaccagccgggagguccugcuucugacaaucggccucucccugguggccucuguggaacugcccaacagccuugaggaacugggggauggacucgccaugggcaucaugauucugaagcuccugaccgacuuucaaucccaucagcuuugggcuacacugcucagccugaccuucaucaaaacgacauuuucucugcacuaugccuggaagaccauggcuaugguccuuuccauuguuagccuguucccccucugucugucuaccacaucccagaaaaccacauggcucccugugcugcuugggagccugggaugcaagccgcugacgauguuucucaucgccgagaauaagauuuggggccgcagaucuuggccccugaacgaaggcaucauggcgguggggaucgucuccauucuucugagcucccuccugaaaaacgaugugccucucgccggaccccugaucgcuggcgggaugcuuauugccuguuacguuaucagcggaucuagcgcugaccugucccuggagaaggccgccgaggugucuugggaagaggaagcugagcauagcggcgcgucccacaauauucucgucgaagugcaggaugacgggaccaugaaaaucaaggaugaggagcgggacgauacacugaccauccuucugaaagccacacuccuggcuguuucuggaguguauccucucagcauucccgccacccuguucgucugguacuucuggcaaaagaaaaagcagcgcuccggcgugcuuugggacacgccuucucccccggaagucgagagagccgugcuggaugacggcaucuaucggauuaugcagcgcgggcugcucggaagaagccagguuggcgugggggucuuucaagaaaacguguuccauaccauguggcacguuacacggggagcugugcugauguaccagggcaagagacuugagccuuccugggccagcgucaaaaaggaccugaucucuuacgggggaggcuggcgccuccagggcuccuggaauaccggggaggaaguccaggugauugcgguugagcccggcaagaacccuaagaauguccaaacagcucccggcaccuuuaaaacaccggaaggggaggugggagccaucgcccuggauuucaagccuggcacgagcgggucucccauugugaaccgggaaggaaagaucgucggccucuauggcaauggggugguuaccacauccggaaccuacgugagcgcuaucgcccaggcgaaggcuucccaggagggcccucugcccgagauugaagacgaggucuuuagaaagcgcaaccuuaccaucauggaucugcaccccgggucuggaaaaacacggagauaucugccugccauugugcgcgaagccaucaagcggaaacucagaacgcugauucuugcuccgacccgcguuguggccagcgagauggcugaagcccugaagggcaugcccauccgguaccaaacaaccgcggucaaguccgagcauacagggaaagagaucguggaccucaugugccacgccaccuucacgaugagacugcugagcccuguucgggugcccaauuauaacaugauuaucauggaugaagcucauuuuacagacccuucuuccauugccgcucgcggcuacaucagcaccagagucggaaugggcgaggccgccgcuauuuucaugaccgcgacacccccugggucuguggaagccuuuccgcagagcaaugcugugauccaggaugaggaacgggacauccccgagcgcuccuggaacucuggauaugaguggauuaccgauuucccuggcaagacagucugguuuguucccagcaucaaauccgggaaugacauugccaacugucucagaaagaauggaaaacgggugauccagcuuucuagaaagaccuucgauacggaauaccaaaagaccaaaaacaacgacugggacuacguggucaccacagauauuagcgagaugggcgccaauuuccgcgcugaccgggugaucgauccuagacgcugccugaagcccguuauucugaaagacgggccggaacgggugauccucgccggcccuaugcccgucaccguggcguccgcugcccagagacgcggacggaucggcagaaaccacaauaaggagggggaucaguauauuuacaugggacagccccugaacaaugacgaggaucaugcccacuggacggaagcuaaaaugcuucuggacaacaucaauaccccugagggcauuguucccgcccucuuugaaccugagcgcgaaaagagcgcggccaucgauggggaguauagacugcggggagaggcucgcaagacauucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagauuuggaccaaggagggagaacgcaaaaagcugcgcccccgguggcucgacgcuagaacauacuccgacccucuggcccuucgcgaguuuaaagaguucgcugccggccggagaucuguuagcggggaucugauccucgagaucggaaagcugccccagcaccugacccagcgggcgcaaaaugcccucgacaaccuugugaugcugcauaauuccgaacagggcgggcgcgcuuauagacacgccauggaggagcugccugauacaauugaaacccucaugcugcuugcucugaucgccgugcucacgggaggcgucacacuguuuuuccugucuggccgggggcucggaaaaaccagcauuggccuucuguguguuauggccuccagcgugcugcucuggauggcuucuguggagccccauuggaucgcggccuccauuauccuggaauuuuuccuuaugguccugcucaucccggagccugaccgccagagaacaccccaggauaaccaacuggcuuacgugguuauugggcugcucuuuaugauccuuacaguggccgccaaugagaugggacugcuggaaaccacaaagaaggaccucggcauugggcacgucgcuguggagaaccaccaucacgccgcgaugcuggaugucgaccuucauccugccagcgcuuggacgcuguacgccguggcuaccacaaucauuacccccaugaugcggcacacaaucgaaaacaccacggccaauauuucucucaccgcgaucgccaaccaggcugccauccugaugggacuggauaaaggcuggccuauuuccaagauggacaucggcguuccccuccuugcucuggggugcuauagccaggugaauccgcugacacucaccgccgcuguccugaugcuuguggcccauuacgcgauuaucggaccuggccugcaagccaaagcuacacgcgaggcccagaagagaaccgcugccgggauuaugaaaaaccccacgguugauggaaucguggccaucgaccucgaucccgucguguaugacgcgaaguucgaaaagcagcugggccagauuaugcugcucauccuuuguacaucucaaauucugcugaugcggaccacaugggcucucugcgagagcaucacccuggccaccgggccucuuacaacgcugugggagggauccccgggcaaauuuuggaauaccacaauugcugugucuauggccaacaucuuccgcggcagcuaccucgccggggcuggacuggccuucucccugaugaaaagccucggcgggggaagacggggcaccggggcgcagggagaaacacuuggcgagaaauggaagagacagcugaaucagcuguccaaaucugaauuuaacaccuauaagcgcagcggcaucauggagguugaccgguccgaagccaaggaggggcucaaaagaggagagacgacaaagcacgcugucucucgcggcaccgccaaacugcggugguucguggaaagaaaucuugugaagcccgaggggaaagucauugaucugggauguggccgcgggggauggagcuacuauugcgcuggccucaagaagguuaccgaagugaaaggcuacacaaaaggcgggccugggcacgaggaacccaucccuauggccaccuacggguggaaccuggugaaacugcauuccggaaaggacgucuuuuucauucccccugagaaaugugauacacuccuuugcgacaucggcgagucuagcccgaaucccacgauugaagaggggcggacccugagagugcugaagaugguugaaccuuggcuccgcggaaaccaauuuuguaucaaaauucugaaucccuauaugccuuccguggucgagacacuugagcagaugcagcggaagcacggcggcaugcuggugagaaacccccucagccgcaauucuacccaugaaauguacuggguuuccugcgggacaggaaacaucgugagcgcggucaauaugaccucucggaugcugcugaacagauucacgauggcccaccgcaagccgaccuaugagagagauguggaccucggcgcugggacacggcacguggccgucgaaccugagguugcuaaccuggauaucauuggacagcgcaucgaaaauauuaaacaugagcacaaguccaccuggcauuacgacgaggauaaccccuauaaaacaugggccuaccacggcagcuaugaagugaagcccucuggguccgcuagcuccauggugaauggagucgugaaacuucugaccaagccuugggacguuauccccauggugacacaaauugccaugaccgauacgacaccuuuuggccagcagagagucuucaaggagaaaguggacacccggaccccgaaggcgaaaagaggcacagcccaaaucauggaaguuacggcuaaguggcucuggggguuucugagccggaacaaaaagccccgcaucuguaccagagaggaguucacacggaaggugcgcucuaaugccgcuauuggagccgucuuuguggacgagaaccaguggaauagcgccaaagaggcgguugaagaugagagauucugggaccuugugcaucgggaacgcgagcugcacaagcagggcaaaugcgcuaccugcgucuacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcguggagggggagggacuucauaagcugggcuauauucuccgggacaucucuaaaauuccugggggaaauauguacgcugaugacacagccggcugggauacccgcaucacagaagacgaucugcagaacgaggcgagaaucaccgacauuauggaacccgagcacgcccuucuggcuaagagcaucuuuaaacucacguaucaaaauaaggucgugcggguucagcgcccugccaaaaacgggaccgugauggaugucauuuccagacgggaccagagaggcucuggacaggugggcacauacgggcugaauaccuucacaaacauggaagcucaacugauccgccagauggagagcgagggaaucuuuucccccagcgaacucgagaccccgaaccuggccgaacgggugcuugauuggcuggagaaguauggcguugaaagacucaagcgcauggcgaucucuggggacgacuguguggucaaaccuaucgaugaccgguucgccacggcucugacagcccuuaaugauaugggaaaggugagaaaagacauuccccagugggagccuuccaagggcuggaacgauuggcagcaaguucccuuuugcagccaucacuuccaccagcugaucaugaaagacgggcgcgagauuguggucccuugucggaaucaggaugaacucgugggcagagcucgcgucucucagggagccggcuggucccugcgggagaccgcuugccugggaaagagcuacgcccaaauguggcagcucauguauuuucauagacgcgaccugcggcuugcggccaacgcuaucuguuccgccgugcccguugauuggauuccgacaucuagaaccacguggagcauccacgcccaucaccaguggaugaccacagaagacaugcuguccguguggaaucgggucuggauugaggaaaacccuuggauggaggauaagacccauaucagcucuuggggagacgugcccuaccucggcaaaagagaggaccaauggugcgggucccugaucggacuuacagcucgcgccaccugggcgacaaauauucagguugcuaucaaccaggugcggagacugauuggcaaugaaaacuaccucgauuauaugaccagcaugaagcgcuucaaaaaugagucugaccccgaaggggcccugugguga

SEQ ID NO: 19250 - RNA, 9879 nt, Artificial Sequence
  derived and/or modified CDS sequence (opt5) from DENV-1__GU131831__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggauuagcuaugugauguguaccggcucuuucaaacucgagaaggaacuggcugagacccagcacggaacaguccuggugcagaucaaguacgagggcaccgacgccccgugcaaaaucccuuucuccacacaagaugaaaaggggguuacgcagaacggacggcuuauuaccgcgaaucccaucgugacagacaaagagaagccugucaacauugaagcugagccgcccuuuggcgagagcuauaucgugauuggggccggagaaaaagcccucaagcugucuugguucaagaaaggcagcuccaucgggaagauguuugaggcuaccgccagaggcgcucgccggauggccauccugggagauacagcgugggacuucggcucuauugggggaguguuuaccagcguuggcaaacucguccaucagaucuucgggacggccuacggagugcuguuuuccggcgugagcuggaccaugaagauugggaucggcguccuucugacauggcucggacucaauucuagauccaccagccugucuaugacauguauugcugugggccuuguuacccucuaccugggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcucucugccgcgaucggcaaggccugggaggagggggucugcggcaucagaagcgcuacacgccuggaaaacauuauguggaaacagaucuccaacgagcuuaaucauauucugcucgaaaacgacaugaaguucaccgugguugugggagaugucgccggcauccuggcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauuccuauacccaggucugcgaccaccggcucaugagcgcggccaucaaagauucuaaggcuguucacgccgacaugggcuacuggaucgaauccgagaaaaaugaaacauggaagcuggccagagcuagcuucauugaggugaagaccuguaucuggcccaaaucucauacacugugguccaacggggugcucgaaagcgagaugauuaucccgaagauuuauggaggcccuaucucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauucacgaaugguguugccgguccuguacacugccuccccuucgcuucagaggggaggacggaugcugguauggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugaccgggacacuugcuguguucuuucugcucaucaugggacagcugaccuggaacgaucugauuagacuuugcaucaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcauuaugauccucaaacugcuuaccgacuuucaaucccaucagcugugggccacacuccugagccugaccuucauuaagacgacauuuucucuucacuaugcuuggaaaaccauggccaugauccuguccauugucagccucuucccccugugucucucuaccacaucccagaagaccacauggcugccuguucuucuggggagccugggaugcaagccgcucacgauguuucugaucgcugagaauaaaaucuggggccggcgcucuuggccccuuaacgaaggcauuauggccguggggaucguguccauucugcucagcucccugcucaagaacgaugucccucuggcgggaccccuuaucgccggcgggaugcugauugcuuguuacgugaucagcggaucuagcgccgaccugucccucgagaaagcugccgagguuucuugggaagaggaagccgagcauagcggcgcuucccacaauauccugguggaaguccaggaugacgggaccaugaagauuaaagaugaggagagagacgauacacuuaccauccugcucaaggcgacacugcucgccgugucuggaguuuauccucugagcauucccgcuacccuuuucgugugguacuucuggcagaagaagaagcagcgguccggcguccugugggacacgccuucucccccggaaguggagcgcgccguccuggaugacggcaucuauagaauuaugcagcgggggcuccugggacgcagccaggugggcguugggguguuucaagaaaacgucuuccauaccauguggcacgugacaagaggagccguucuuauguaccagggcaaacggcuggagccuuccugggcuagcgugaagaaagaccucaucucuuacgggggaggcuggagacugcagggcuccuggaauaccggggaggaaguccaggugauugccguggagcccggaaagaacccuaaaaauguucaaacagcgcccggcaccuuuaagacaccggaaggggaggucggagcuaucgcccucgauuucaagccuggcacgagcgggucucccaucgugaaccgcgaaggaaaaauugugggccuguauggcaauggggucgugaccacauccggaaccuacguuagcgccaucgcucaggccaaggcgucccaggagggcccucuucccgagauugaagacgagguguuucggaaaagaaaccugaccaucauggaucugcaccccgggucuggaaagacacgccgguaucucccugcuauugucagagaagccaucaaacgcaagcugcggacgcuuauccuggccccgaccagagugguugcuagcgagauggccgaagcucucaagggcaugcccauucgcuaccaaacaaccgccgugaaauccgagcauacagggaaggagaucgucgaccugaugugccacgcgaccuucacgaugcggcugcucagcccugugagaguucccaauuauaacaugauuaucauggaugaagcccauuuuacagacccuucuuccauugcugcccggggcuacaucagcacccgcgugggaaugggcgaggcugccgccaucuucaugaccgcuacacccccugggucugucgaagcguuuccgcagagcaaugccgugauucaggaugaggaaagagacauccccgagcgguccuggaacucuggauaugaguggauuaccgauuucccuggcaaaacagugugguuuguccccagcaucaaguccgggaaugacauugcuaacugucuucgcaaaaauggaaagagaguuauccagcugucucggaagaccuucgauacggaauaccagaagaccaagaacaacgacugggacuacguggugaccacagauauuagcgagaugggcgccaauuucagagccgaccgcgucaucgauccucggagaugccugaaacccgugauccucaaggacgggccggaacgcguuauucuggcuggcccuaugcccgugaccgucgccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaagagcgccgcgaucgauggggaguaucgccugagaggagaggcccggaaaacauucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagauuuggaccaaagagggagaacggaagaaacucagaccccgcuggcuggacgcccggacauacuccgacccucuugcucugagagaguuuaaggaguucgccgcuggccgccggucugucagcggggaucucauccuggagauuggaaaacugccccagcaccucacccagagagcccaaaaugcgcuugacaaccuggugaugcugcauaauuccgaacagggcgggcgggccuaucgccacgcuauggaggagcucccugauacaaucgaaacccugaugcuucuggcccucauugcuguucugacgggaggcgugacacuguuuuuccucucuggcagagggcuuggaaagaccagcaucggccugcugugugugauggccuccagcguccuccuguggauggccucuguugagccccauuggaucgcugcguccauuauccuugaauuuuuccugauggugcuccugauuccggagccugaccggcagcgcacaccccaggauaaccaacuggccuacguggucaucgggcuccuuuuuaugauucugacaguggcugccaaugagaugggacugcucgaaaccacaaagaaagaccugggcaucgggcacguugccguggagaaccaccaucacgcugccaugcuugaugucgaccugcauccugcgagcgccuggacgcucuacgcuguggccaccacaauuaucacccccaugaugagacacacaaucgaaaacaccacggcuaauauuucucugaccgccaucgcgaaccaggccgcuauucugaugggacucgauaagggcuggccuaucuccaaaauggacauuggcgucccccuucuggcccuggggugcuauagccaggugaauccgcucacacugaccgcugccguucuuaugcugguggcucauuacgccaucaucggaccuggccuccaagcgaaggccacacgggaggcucagaaacgcaccgccgcugggauuaugaagaaccccacggucgauggaaucguggccauugaccuggaucccguuguguaugacgccaaguucgaaaaacagcugggccagaucaugcuccuuauucuguguacaucucaaauccugcucaugagaaccacaugggcgcugugcgagagcaucacccuugcuaccgggccucugacaacgcucugggagggauccccgggcaaguuuuggaauaccacaauugccgucucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaacacgccgugucuagaggcaccgcuaaacuucgcugguucguugaacggaaucuggucaaacccgaggggaaggugaucgaucucggauguggcagagggggauggagcuacuauugcgccggccugaagaaagugaccgaagucaagggcuacacaaaagggggaccuggccacgaggaacccauuccuauggcuaccuacggguggaaccugguuaagcuccauuccggaaaagacguguuuuucauucccccugagaagugugauacacuucugugcgacaucggcgagucuagcccgaaucccacgaucgaagaggggcgcacccugcgggugcucaaaauggucgaaccuuggcugagaggaaaccaauuuuguaucaagauucuuaaucccuauaugccuuccgugguugagacacuggagcagaugcagcgcaagcacggcggcaugcucgugcggaacccccugagcagaaauucuacccaugaaauguacugggucuccugcgggacaggaaacaucgugagcgccguuaauaugaccucucgcaugcugcucaaccgguucacgauggcgcacagaaaaccgaccuaugagcgcgauguggaccugggcgccgggacaagacacgucgcuguggaaccugagguggccaaccuugauauuaucggacagcggauugaaaauaucaagcaugagcacaaauccaccuggcauuacgacgaggauaaccccuauaagacaugggcuuaccacggcagcuaugaagucaaacccucuggguccgccagcuccaugguuaauggaguggugaagcugcucaccaagccuugggacgucauccccauggugacacaaauugcuaugaccgauacgacaccuuuuggccagcagcgcguuuucaaagagaagguggacaccagaaccccgaaagccaagcggggcacagcgcaaaucauggaagucacggccaaauggcuguggggguuucuuagcagaaacaagaagccccggauuuguacccgcgaggaguucacaagaaaagugcggucuaaugcugccaucggagcuguuuuuguggacgagaaccaguggaauagcgccaaggaggccgucgaagaugagcgcuucugggaccuggugcauagagaacgggagcuccacaaacagggcaagugcgcgaccugcguuuacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcguggagggggagggacugcauaaacucggcuauauccugagagacaucucuaagauuccugggggaaauauguacgccgaugacacagcuggcugggauacccggaucacagaagacgaucuucagaacgaggcccgcauuaccgacaucauggaacccgagcacgcgcugcucgccaaaagcauuuuuaagcugacguaucaaaauaaagucgugagaguccagcggccugcuaagaacgggaccgugauggauguuaucucccgcagagaccagcggggcucuggacaggugggcacauacgggcugaauaccuucacaaacauggaagcccaacucaucagacagauggagagcgagggaaucuuuucccccagcgaacuggagaccccgaaccuugcugaacgcguccuggauuggcucgagaaguauggcguggaacggcugaaaagaauggccaucucuggggacgacugugugguuaagccuauugaugaccgcuucgcgacggcccuuacagcucugaaugauaugggaaaagugcggaaggacaucccccagugggagccuuccaaaggcuggaacgauuggcagcaaguccccuuuugcagccaucacuuccaccagcucauuaugaaggacgggagagagaucgugguuccuugucgcaaucaggaugaacuggugggccgggccagagucucucagggagcuggcuggucccugcgcgagaccgccugccucggaaagagcuacgcucaaauguggcagcugauguauuuucaucggagagaccuucgccuggccgcgaacgccauuuguuccgcugugcccgucgauuggaucccgacaucucggaccacguggagcauccacgcccaucaccaguggaugaccacagaagacaugcucuccguguggaauagaguuuggauugaggaaaacccuuggauggaggauaaaacccauaucagcucuuggggagacgugcccuaccugggcaagcgggaggaccaauggugcgggucccuuauuggacugacagccagagcuaccugggccacaaauauccaggucgcgauuaaccaggugcgccggcucaucggcaaugaaaacuaccuggauuauaugaccagcaugaaaagauucaagaaugagucugaccccgaaggggcucugugguga

SEQ ID NO: 19251 - RNA, 9879 nt, Artificial Sequence
  derived and/or modified CDS sequence (opt5) from DENV-1__EU482789__SS-prME
agcgugaccaugcugcugaugcugaugcccaccgcccuugcuuuccaccugacgaccagaggcggggaaccucauaugaucgucaccaagcaggaacgggggaagucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaaauggagggaaagaucgugcaguacgaaaaccuuaaauauucuguuaucgugaccguccacacaggcgaccagcaucaaguggggaaugaguccaccgaacacggaacaaccgcuacgauuacaccccaggccccuacaagcgagauccagcugaccgacuacggcgcccucacacuggauuguucuccccggaccggccuggacuucaacgaaaugguucuccugacgaugaaggagaaauccuggcuugugcauaagcagugguuucuggaucucccucugcccuggacaagcggggcuuccaccucucaagagacauggaaucgccaggaccuucuggucaccuucaaaaccgcgcacgccaagaagcaggaaguggucgugcucggaagccaagagggcgcuaugcacacagcccugacgggggccaccgaaauucagacauccggaaccacaaccaucuuugcuggccaucugaaaugcagacucaagauggauaaacugacgcuuaaggggaugagcuauguuauguguacaggcucuuucaaacuggagaaggaaguggccgagacccagcacggaaccguccucgugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucugaaacuuucuugguucaagaaaggcagcuccauugggaagauguuugaggccacagcuagaggcgcccgccggauggcgauccucggagauaccgccugggacuucggcucuaucgggggaguguuuacaagcguuggcaaacugguccaucagauuuucgggaccgcuuacggagugcuguuuuccggcgugagcuggacgaugaagaucgggauuggcguccuccugaccuggcuuggacucaauucuagauccacaagccucucuaugaccuguaucgccgugggccugguuacacuguaccuuggggugaugguccaggcugauuccggaugcgugauuaacuggaaaggccgcgaacucaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccuggaaaacaucauguggaaacagauuuccaacgagcucaaucauauccugcuugaaaacgacaugaaguucacagugguugugggagaugucgugggcauucuggcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcucaagcugcgcgauuccuacacacagguuugcgaccaccggcugaugagcgcggccauuaaagauucuaaggcugugcaugccgacaugggcuauuggaucgaauccgagaaaaaugaaaccuggaaacuugccagagcuagcuucaucgaggugaagacauguauuuggcccaaaucucacacccucugguccaacgggguccuggaaagcgagaugaucauuccgaagaucuacggaggcccuauuucucaacauaauuaucgccccggguacuucacacagaccgccggaccuuggcaccugggcaaacucgagcuggauuuugaccuuugcgaagggacgaccgugguuguggaugagcacugcggaaaccggggccccagccugagaacaaccacagucaccggcaagaucauccaugaaugguguugccgguccuguacgcucccuccccugcgcuucaaaggggaggacggaugcugguacggcauggagauuagaccggugaaggaaaaggaggaaaaucugguuaaaagcauggugucugcgggguccggagaggucgacagcuuuucccuuggccuccuguguaucucuauuaugaucgaagaggugaugcggagcagauggucccgcaagaugcugaugacagggacccucgcuguuuuccugcuucugauuaugggacagcucacauggaacgaucugauccggcugugcauuauggugggcgccaaugccucugacagaaugggcauggggaccaccuaucuugcucugauggccacauuuaaaaugcgcccuauguucgcggucggacuccuguuuagacggcucacgagccgcgaggugcugcuucugaccaucggccucucccugguggcuucugucgaacugcccaacagccuugaggaacugggggauggacucgccaugggcaucaugauucugaagcuccugacagacuuccaaucccaccagcuuugggccacccugcucagccugacauuuaucaaaaccacgcugucucuucauuacgcuuggaagacaauggccaugguucuguccauugugagccucuucccccugugucucucuaccaccucccagaagacaaccuggcugccugugcuucuggggagccugggaugcaaaccgcucacaauguuucugaucgcugagaauaagauuuggggcagaaaaucuuggccccuuaacgaaggcaucauggccgucggggugguuuccauccugcucagcucccugcucaagaacgaugugccucuggcgggaccccuuauugccggcgggaugcugaucgcuuguuaugucauuagcggaucuagcgccgaccugucccucgagaaagcugccgaggugucuugggaagaggaagccgagcacagcggcgcuucccauaauauccugguugaagugcaggaugacgggacgaugaagauuaaagaugaggagcgggacgauacccuuacaauccugcucaaggcgacccugcucgccgucucuggaguguacccucugagcauccccgcuacacuuuucgucugguauuuuuggcaaaagaaaaagcagcgcuccggcgugcugugggacaccccuucucccccggaaguugagagagccgugcuggaugacggcauuuaccggaucaugcagcgcgggcuccugggaagaagccaggucggcguggggguuuuccaagaaaacguguuccacacgauguggcacgucacccggggagccgugcuuauguaucagggcaaacgccuggagccuuccugggcuagcgugaagaaagaccucauuucuuacgggggaggcuggagacugcagggcuccuggaauacaggggaggaaguucaggucaucgccguggagcccggaaagaacccuaagaaugugcaaaccgcgcccggcacauuuaaaaccccggaaggggaggucggagcuauugcccucgauuucaagccuggcacaagcgggucucccaucgugaaccgggaaggaaaaauuguuggccuguacggcaaugggguggucacgaccuccggaacauaugugagcgccaucgcucaggccaaggcgucccaggagggcccucuucccgagaucgaagacgagguuuuuagaaaacgcaaccugaccauuauggaucugcaucccgggucuggaaagacccggagauaccucccugcuaucgugcgcgaagccauuaagcggaaacugagaacacuuauccuggccccgacgcgcgucguggcuagcgagauggccgaagcucucaagggcaugcccauucgguaucaaaccacagccguuaaauccgagcacaccgggaaggagaucguggaccugaugugccaugcgacauucaccaugagacugcucagcccuguccgcgugcccaauuacaacaugaucauuauggaugaagcccacuuuacggacccuucuuccaucgcugcccggggcuauauuagcacaagagugggaaugggcgaggcugccgccaucuucaugaccgcuacacccccugggucugucgaagcguuuccgcagagcaaugccguuauucaggaugaggaacgggacauccccgagcgcuccuggaacucuggauacgaguggaucacagauuucccuggcaaaaccgugugguuugugcccagcauuaaguccgggaaugacaucgcuaacugucuuagaaagaauggaaaacgggucauucagcugucucgcaagacauucgauaccgaauaucagaagacgaagaacaacgacugggacuacgugguuacaaccgauaucagcgagaugggcgccaauuuuagagccgaccgggugauugauccuagacgcugccugaaacccgucauccucaaggacgggccggaacgggugauucuggcuggcccuaugcccguuacaguggccuccgcggcucagagacgcggacggaucggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguucgaaccugagcgcgaaaagagcgccgcgaucgauggggaguaccggcugagaggagaggcccgcaaaaccuucgucgaacucaugagacggggcgaccuuccgguguggcugucuuauaaggucgcuuccgagggguuucaauacagcgaucgcagauggugcuucgacggcgaacggaacaaucaggugcuggaggaaaacauggauguugagauuuggacaaaagagggagaacgcaagaaacucagaccccgguggcuggacgccagaaccuauuccgacccucuugcucugcgcgaguuuaaggaguucgccgcuggccggagaucugugagcggggaucucauccuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcuguccugaccggaggcguuacgcuguuuuuccucucuggccgggggcuuggaaaaacaagcauuggccugcugugugugauggccuccagcgugcuccuguggauggccucugucgagccccacuggaucgcugcguccauuauccuugaauuuuuccugauggugcuccugaucccggagccugaccgccagagaacaccccaggauaaccaacuggccuauguugugauugggcuccuuuuuaugauccugaccgucgcugccaaugagaugggacugcucgaaacaaccaagaaagaccugggcauugggcacguggccgucgagaaccaucaccaugcuacaaugcuugauguggaccugcacccugccagcgcguggacgcucuacgccguugcuaccacaaucauuacccccaugaugcggcauacaaucgaaaacaccacggccaauauuucucugaccgcuaucgccaaccaggcggccauccugaugggacucgauaagggcuggccuauuuccaaaauggacaucggcgugccccuucuggcucuggggugcuacagccaggucaauccgcucacacugaccgccgcugugcuuaugcugguugcccacuaugcuauuaucggaccuggccuccaagccaaggcgacacgcgaggcccagaagagaaccgcugccgggauuaugaaaaaccccacgguggauggaaucgucgcuaucgaccuggaucccgugguguacgacgccaaguucgaaaaacagcugggccagauuaugcuccuuauccuguguacaucucaaauucugcucaugcggaccacaugggcccugugcgagagcaucacccuugcgaccgggccucugacaacgcucugggagggauccccgggcaaguuuuggaauaccacaauugcuguuucuauggccaacaucuuccgcggcagcuaucuggcuggggccggacuggccuuuucccucaugaaaagccuuggcagagggcggcgcggaaccggcgcucagggggaaacacugggagagaaguggaagagacagcugaaucagcucuccaaaucugaguucaacaucuacaagcggagcggcauuauggaggucgacagauccgaagccaaagagggccugaagcgcggggagaccacgcggcacgcggugucuagaggaacagccaaacuucgcugguucguggaacggaaucuggucaagcccgagggcaagguuaucgaucucggguguggaagaggcggguggagcuauuacugcgcuggacugaaaaaggugaccgaagugaaaggcuauaccaagggcgggccuggacaugaggaacccauuccuauggccacauacggcuggaaccuggucaaacuccacuccgggaaggacguguuuuucacacccccugagaaaugugauacacuucugugcgacaucggagagucuagcccgaaucccacgauugaagagggccgcacccugcggguucucaagaugguggaaccuuggcugagagggaaccaauuuuguaucaagauucuuaaucccuacaugccuuccgucguggagacacuggagcagaugcagcgcaaacauggaggcaugcucguucggaacccccugagcagaaauucuacccacgaaauguauuggguguccugcggcacagggaacaucgucagcgcugugaauaugaccucucgcaugcugcucaaccgguucacgauggcccacagaaagccgaccuacgagcgcgauguggaccugggagcgggcacaagacaugucgccguugaaccugagguggcuaaccuugauaucauugggcagcggaucgaaaauauuaaacacgagcauaaguccaccuggcacuaugacgaggauaaccccuacaaaacaugggccuaucauggaagcuacgaagugaagcccucuggcuccgcuagcuccauggucaauggggugguuaagcugcucaccaaaccuugggacgugauccccauggucacacaaauugccaugaccgauacgacaccuuuuggacagcagcgcguguucaaggagaaaguugacaccagaaccccgaaggcuaaacggggcacagcccaaaucauggaagugacggcgagauggcuguggggcuuucuuagccggaacaagaagccccgcaucuguaccagagaggaguucacacggaaaguccgcucuaaugccgcuauuggggccguguuuguugacgagaaccaguggaauagcgcuaaggaggccguggaagaugagagauucugggaccugguccagaaagaacgggagcuccacaagcagggaaaaugcgcgaccugcguguauaacaugaugggcaagcgcgaaaagaaacugggggaguuuggaaaggcgaaaggcuccagagcuaucugguacauguggcugggggcccgguuccucgaguuugaagcccugggcuucaugaaugaggaucacugguucucucgcgaaaacagccuuuccggagucgagggcgaggggcugcauaagcucggauacauucugagagacaucucuaaaauuccuggcgggaauauguaugcugaugacacagccggaugggauacccggaucacagaagacgaucuucaaaacgaggcuaagaucaccgacauuauggaacccgagcacgcccugcucgcgacgagcaucuuuaaacugaccuaccagaauaaggugguucgcgugcagagaccugccaaguccggcacagucauggaugugauuucucggcgcgaccagagagggagcggccaagugggaaccuauggccugaacacauucaccaauauggaagcucagcucauccggcagauggaguccgaggggauuuuucugcccagcgaacuugagacgccgaaccuggccgaaagaguucucgauuggcuggagaaauacggaguggaacgccuuaagcggauggcuaucucuggcgacgacugugucgugaaaccuaucgaugacagauucgccacagcgcugaccgcccucaacgauauggggaagguucgcaaagacauuccccagugggagccuuccaagggauggaaugauuggcaacaggugcccuuuugcagccaucacuuccaccagcugaucaugaaggacggccgggagauugucgugccuuguagaaaccaggaugaacuggucgggcgcgcucgggugucucaaggcgccggauggucccucagagagacagcuugccugggcaaaagcuaugcccagauguggcagcuuauguacuuucaucgccgggaccugagacucgcugccaaugcgaucuguuccgccguucccguggauugggucccgaccucucgcacgaccuggagcauucacgcucaucaccaauggaugacaaccgaagacaugcuguccguguggaaccggguuuggaucgaggaaaauccuuggauggaggauaagacacaugugagcucuuggggagacguccccuaucuuggaaaaagagaggaccaguggugcggcucccugauugggcucaccgcccgggccacaugggcuagcaacauccagguggccaucaaucaggugagacgccugauuggaaacgaaaauuaccuggauuacaugaccucuaugaagcgguucaaaaacgagggcgaccccgaaggggcgcucugguga

SEQ ID NO: 19252 - RNA, 9879 nt, Artificial Sequence
  derived and/or modified CDS sequence (opt5) from DENV-1__EU482790__SS-prME
uccgugaccaugcugcucaugcugaugcccacggcccuugcuuuccaccugacgaccagaggcggggaaccucauaugaucgucuccaagcaggaacggggaaaaucucuccuguuuaagacauccgccggcguuaacaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccgggucuagcacaucccaagagaccuggaaucgccaggaccuucuggugacauuuaaaaccgcucacgcgaagaagcaggaagucgugguucucggaagccaagagggcgccaugcacaccgcucugacaggggccacggaaauucagaccucuggaacaaccacaaucuucgccggccaucugaaaugcagacucaagauggauaaacugacccuuaaggggauguccuaugugauguguacgggcagcuucaaacuggagaaggaagucgcugagacacagcacggaaccgugcucguucagauuaaguacgagggcaccgacgugccgugcaaaaucccuuuuucuacacaagaugaaaagggggucacccagaacggacggcugaucacagccaaucccauugugacggacaaagagaagccugugaacaucgaagcggagccgcccuucggcgagagcuauauuguuaucggggcuggagaaaaagcccugaaacuuuccugguuuaagaaaggcucuagcauugggaagauguucgaggccaccgcuagaggcgcccgccggauggcuauccucggagauacagccugggacuuuggcuccaucgggggagucuucaccagcgugggcaaacuggugcaucagauuuuugggacagcguacggaguccuguucucuggcguguccuggaccaugaagaucgggauuggcguucuccugacguggcuuggacugaauagcagaucuaccucccucagcaugacauguaucgccgugggccuggucacccuguaccuuggggugaugguucaggcugauuccggaugcgugauuaacuggaaaggccgcgaacucaagugugggucuggaaucuuugucacaaaugaggugcacaccuggacagaacaauauaaguuccaggccgacagcccuaaacggcuguccgcugccauuggcaaggcgugggaggaggggguuugcggcaucagaucugccacccgccuggaaaacaucauguggaaacagauuagcaacgagcucaaucauauccugcuugaaaacgacaugaagcugacgguggucgugggagauguggcuggcauucucgcccaggggaaaaagaugauccggccgcaacccauggaguacaaauauuccuggaaaagcuggggaaaggcuaagauuaucggcgccgacguccagaauacaaccuuuaucauugaugggccuaacacccccgaauguccugacgaucagagagccuggaauaucugggagguugaggacuacggauucggcauuuuuacaaccaacaucuggcugaagcugcgcgauucuuauacacaggugugcgaccaccggcuuauguccgcugcgauuaaagauagcaaggccgugcacgcugacaugggcuacuggaucgaaucugagaaaaaugaaacauggaagcucgccagagccuccuucaucgaggucaagaccuguauuuggcccaaaagccauacacuguggucuaacggggugcuggaaagcgagaugaucauuccgaagaucuauggaggcccuauuucccaacacaauuaccgccccggguacuucacccagacagcuggaccuuggcaucucggcaaacuggagcuugauuuugaccugugcgaagggaccacgguuguggucgaugagcacugcggaaaccggggccccagccucagaaccacaaccgugacaggcaagaucauccacgaaugguguugccggucuuguacccugccuccccugcgcuucaaaggggaggacggaugcugguauggcauggagauuagaccgguuaaggaaaaggaggaaaaucuugugaaauccauggucagcgccggguccggagagguggacucuuuuagccucggccugcuguguaucuccauuaugaucgaagagguuaugcggucuagauggagccgcaagaugcucaugacggggacacuggcgguguucuuucuucugauuaugggacagcucaccuggaacgaucugauccggcugugcauuauggucggcgcuaaugccuccgacagaaugggcauggggacaaccuaccuugcccugauggcuaccuucaaaaugcgcccuauguuugccgugggacuccuguucagacggcucacaucucgcgaggugcugcuucugacgaucggccucagccuggucgcguccguugaacugcccaacagccuugaggaacugggggauggacucgcuaugggcaucaugauucugaagcuccugaccgacuuucaaucucaucagcuuugggccacacugcucucccugaccuucaucaaaacaaccuuuagccugcacuaugccuggaagacgauggcuauggugcuuucuauugugucccuguucccccucugucugagcacaaccucucagaagaccacauggcucccuguccugcuugggucccugggaugcaaaccgcugaccauguuucucaucgccgagaauaagauuuggggcagaaaaagcuggccccugaacgaaggcaucauggcuguggggaucguuuccauucuucugagcucucuccugaagaacgaugugccucucgccggaccccugaucgcgggcgggaugcuuauugccuguuacgucaucagcggauccucugcugaccugagccuggagaaagccgcugagguguccugggaagaggaagccgagcauucuggcgccagccacaauauucucguugaagugcaggaugacgggacaaugaagaucaaagaugaggagcgggacgauacgcugaccauccuucugaaggcuacacuccuggcggucuccggaguguauccucucucuauucccgccacccuguucgucugguacuucuggcaaaagaaaaagcagcgcagcggcgugcuuugggacacaccuagcccucccgaaguugagagagcugugcuggaugacggcaucuaucggauuaugcagcgcgggcugcucggaagaagccaggucggcguggggguuuuucaagaaaacguguuccauaccauguggcacgucacgcggggagccgugcugauguaccagggcaaacgccuugagcccucuugggccuccgugaagaaagaccugaucagcuacgggggaggcuggagacuccagggcucuuggaauaccggggaggaaguucaggucauugcuguggagcccggaaagaacccuaagaaugugcaaacagcccccggcaccuuuaaaacauccgaaggggaggucggagcgaucgcucuggauuucaagccgggcaccagcggguccccuauugugaaccgggaaggaaaaaucguuggccucuauggcaaugggguggucacaacgucuggaaccuacgugagcgccaucgcccaggcuaaggccucccaggagggcccccugccugagauugaagacgagguuuuuagaaaacgcaaccuuacaaucauggaucugcaccccgggagcggaaagacccggagauaucugcccgcgauugugcgcgaagcuaucaagcggaaacucagaacccugauucuugccccuacacgcgucguggccucugagauggcugaagcccugaagggcaugccgauccgguaccaaacgaccgcuguuaaauccgagcauacagggaaggagaucguggaccucaugugccacgccaccuucacaaugagacugcugagccccguccgcgugccuaauuauaacaugauuaucauggaugaagcgcauuuuaccgaccccucuagcauugccgcucggggcuacaucuccacgagagugggaaugggcgaggccgcugccauuuucaugacagccaccccucccgggucugucgaggcuuuuccucagagcaaugcgguuauccaggaugaagaacgggacaucccggagcgcuccuggaacucuggauaugaguggauuaccgauuuccccggcaaaacagugugguuugugccuagcaucaaguccgggaaugacauugccaacugucucagaaagaauggaaaacgggucauccagcuuagccgcaagaccuucgauacagaauaccagaagaccaagaacaacgacugggacuacgugguuacgacagauauuucugagaugggcgcuaauuucagagccgaccgggugaucgaucccagacgcugccugaaaccugucauucugaaggacgggcccgaacgggugauccucgccggcccgaugccuguuaccguggcuuccgccgcgcagagacgcggacggaucggcagaaaccacaauaaggagggggaucaguauauuuacaugggacagccccugaacaaugacgaggaucaugcucacuggacagaagccaaaaugcuucuggacaacaucaauacccccgagggcauuaucccugcccucuuugaacccgagcgcgaaaagagcgcugccauugauggggaguaucggcugagaggagaggcgcgcaaaacguucgucgaacugaugagacggggcgaccucccuguguggcuuuccuacaaggucgccucugagggguuucaauauagcgaucgcagauggugcuucgacggcgaacggaacaaucaggugcuggaggaaaacauggauguugagaucuggaccaaagagggagaacgcaagaaacugagaccgcgguggcucgacgcuagaacauacuccgacccccuggcccuucgcgaguuuaaggaguucgcugccggccggagaucugugagcggggaucugauccucgagauuggaaagcugccucagcaccugacccagcgcgcucaaaaugcccucgacaaccuugugaugcugcauaauuccgaacagggcgggcgggcguauagacacgccauggaggagcugcccgauacaaucgaaacccucaugcugcuugcucugauugccguccucacaggaggcguuacccuguuuuuccugagcggccgggggcucggaaaaacgucuaucggccuucugugugugauggcuuccagcgugcugcucuggauggccucugucgagccucauuggauugccgcuuccaucauccuggaauuuuuccuuauggugcugcucauucccgagccggaccgccagagaacaccucaggauaaccaacuggcguacguugugaucgggcugcucuuuaugauucuuaccgucgccgcuaaugagaugggacugcuggaaaccacaaagaaagaccucggcaucgggcacguggccgucgagaaccaccaucacgccgcuaugcuggauguggaccuucaucccgccagcgcguggacccuguacgccguugcuacaacgauuaucaccccuaugaugcggcacacaauugaaaacaccacagccaauaucucucucaccgcuaucgccaaccaggcggccauucugaugggacuggauaagggcuggcccaucagcaaaauggacauuggcgugccucuccuugcucuggggugcuauucccaggucaauccccugacgcucaccgccgcugugcugaugcuuguugcccauuacgcuaucauuggaccgggccugcaagccaaggcgacacgcgaggcccagaagagaaccgcugccgggaucaugaaaaacccuacaguggauggaaucgucgcuauugaccucgaucccgugguguaugacgccaaguucgaaaaacagcugggccagaucaugcugcucauucuuuguaccucucaaauccugcugaugcggacgacaugggcccucugcgagagcauuacccuggcgacagggccccuuaccacccugugggagggauccccuggcaaguuuuggaauacaacgaucgcuguuagcauggccaacaucuuccgcggcuccuaccucgcuggggccggacuggccuucucucugaugaaaagccucggcgggggaagacggggcaccggggcucagggagaaacacuuggcgagaaguggaagcgccagcugaaucagcuguccaaaucugaauuuaacaccuauaagagaagcggcauuauggaggucgaccgguccgaagccaaagaggggcucaagagaggagagacaaccaaacacgcggugucucgcggcacggccaagcugcggugguucguggaaagaaaucuugucaagccggaggggaaaguuaucgaucugggauguggccgcgggggauggagcuacuauugcgcuggccucaagaaagugacagaagugaagggcuacaccaaagggggacccggccacgaggaaccuauucccauggccaccuacggguggaaccuggucaagcuguauuccggaaaagacguguuuuucaucccucccgagaagugugauacacuccuuugcgacauuggcgagagcucuccuaauccgaccaucgaagaggggcggacacugagaguucugaagaugguggaacccuggcuccgcggaaaccaauuuuguauuaaaauccugaauccuuacaugcccuccgucguggagacgcuugagcagaugcagcggaagcauggcggcaugcugguuagaaacccucucagccgcaauucuacccacgaaauguauuggguguccugcgggacaggaaacaucgucagcgcugugaauaugaccucucggaugcugcugaacagauucacaauggcccaucgcaaacccaccuacgagcgggauguggaccucggcgcggggacgagacacgucgccguugaaccggaggugccuaaccuggauauuaucggacagcgcauugaaaauaucaagcacgagcauaaauccaccuggcacuaugacgaggauaaccccuacaagacaugggcuuaucauggcagcuacgaagugaagcccuccgggagcgccucuagcauggucaauggagugguuaaacuucugaccaagccuugggacgugauucccauggucacacaaaucgcuaugaccgauacaaccccuuuuggccagcagagaguguucaaagagaagguugacacgcggacaccgaaagccaagcgcggcaccgcucaaaucauggaagugaccgccaaguggcucuggggguuucuguccagaaacaaaaagccccggauuuguacaagagaggaguucacgcggaaaguccgcucuaaugcggccaucggagcuguguuuguugacgagaaccaguggaauagcgccaaggaggcuguggaagaugagagauucugggaccuuguccaccgggaacgcgagcugcauaaacagggcaagugcgcuaccugcguguacaacaugauggggaagagagagaaaaagcucggagaguuuggcaaagccaaggggucccgggcgauuugguauauguggcugggcgcucgcuuccuggaguucgaagcccucggauuuaugaaugaggaucacugguucucuagagaaaacagccuguccggcgucgagggggagggacuucacaaacugggcuacauccuccgggacauuucuaagaucccugggggaaauauguaugccgaugacacagcuggcugggauacccgcaucacagaagacgaucugcagaacgaggccaaaauuaccgacaucauggaacccgagcaugcccuucuggccaagagcauuuuuaagcucacauaccaaaauaaagugguuagagugcagcggccugcgaagaacgggaccgucauggaugugaucucccgcagagaccagcggggcagcggacaggugggcacguaugggcugaauaccuucacaaacauggaagcccaacugauucgccagauggagucugagggaaucuuuucccccagcgaacucgagaccccgaaccuggcuggcagaguucuugauuggcuggaaaaacacgggguggagcggcucaagagaauggccaucucuggagacgacugugucgugaaaccuauugaugaccgcuucgcuacagcccugaccgcgcuuaaugauaugggcaagguucggaaggacaucccccagugggaaccuuccaaaggguggaacgauuggcagcaagugcccuuuugcagccaucacuuccaccagcugauuaugaaggacggcagagagaucgucgugccuugucgcaaucaggaugagcucgucggacgggccagagugucccagggcgcuggguggucucugcgcgaaacggccugccugggaaaaagcuacgcucaaauguggcagcucauguauuuucaucggagagaccugcgccuugccgcuaacgccauuuguuccgcgguucccguggauugggucccgacaagccggaccacauggucuauccacgcccaucaccaguggaugaccacggaggacaugcuguccguguggaauagaguuuggauugaagagaacccuuggauggaagauaagacccauaucagcucuuggggcgacgugcccuaccucgggaaacgcgaggaccaauggugcggaagccugaucggccuuacagcucgggccaccugggccacaaauauucaggucgcuaucaaccaggugagacggcugauugggaaugagaacuaccucgauuauaugaccuccaugaagagauucaagaaugaaucugaccccgagggcgcccugugguga

SEQ ID NO: 19253 - RNA, 9879 nt, Artificial Sequence
  derived and/or modified CDS sequence (opt5) from DENV-1__EU482791__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaaaaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaagggggacgggccuacagacaugcuauggaggagcugccugacacaaucgaaacccuuaugcugcucgcccugauugcuguccugacgggcggcguuacacucuuuuuccuuucugggcggggacugggcaaaaccagcaucgggcugcucugugugauggccuccagcgugcugcuuuggauggccucugucgagccccacuggauugcugcguccaucauucuggaauuuuuccucauggugcugcugaucccggagccugaucgccagagaacaccccaggacaaccaacucgccuauguugugaucggacuucuguuuaugauucugacagucgcugccaaugagaugggccuccuggaaaccacaaagaaagaucuugggaucggacacguggccgucgagaaccaucaccaugcuacgaugcuggacguggaucuccacccugccagcgcguggacccuguacgccguugcuacaaccauuaucacacccaugaugcggcauaccauugaaaacacgaccgccaauaucucucugacagcuauugccaaccaggcggccauccucaugggccuugacaagggcuggccuaucuccaaaauggauauuggggugccccugcuggcucucggaugcuacagccaggucaauccgcugacccuuacagccgcugugcugaugcucguugcccacuaugcuaucauuggcccugggcugcaagccaaggcgacccgcgaggcccagaagagaacggcugccggaaucaugaaaaaccccacaguggacggcauugucgcuaucgaucuggaccccgugguguacgaugccaaguucgaaaaacagcucgggcagaucaugcuucugauucuguguaccucucaaauccuccugaugcggacaaccugggcccuuugcgagagcauuacccuggcgacaggaccucucacgacccugugggagggcuccccgggcaaguuuuggaauacaaccaucgcuguuucuauggccaacauuuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacaucuacaagagaagcgggaucauggaggucgaccgguccgaagccaaagagggacuuaagagaggcgagacgacacgccacgcggugucucgggggaccgccaaacugagaugguucguggaacgcaaucucgucaagcccgagggaaagguuauugaccugggcugugggcggggaggcuggagcuauuacugcgcuggccugaaaaaggugaccgaagugaaaggguauacaaagggaggcccugggcaugaggaacccaucccuauggccaccuacggauggaaccucgucaaacuucacuccggcaaggauguguuuuucacacccccugagaaaugugacacgcugcugugcgauauuggggagucuagcccgaaucccaccaucgaagagggaagaacacuccgcguucugaagaugguggaaccuuggcuucggggcaaccaauuuuguauuaagauccugaaucccuacaugccuuccgucguggagacccucgagcagaugcagagaaaacauggcgggaugcugguucgcaacccccugagcagaaauucuacacacgaaauguauuggguguccugcggaaccggcaacauugucagcgcugugaauaugacgucuagaaugcuccugaaccgcuucaccauggcccaccggaagccgacauacgagagagacguggaucuuggggcgggaacccgccaugucgccguugaaccugagguggcuaaccuggacaucaucggccagagaauugaaaauaucaaacacgagcauaaguccacauggcacuaugaugaggacaaccccuacaaaaccugggccuaucaugggagcuacgaagugaagcccucuggauccgcuagcuccauggucaauggcgugguuaagcuccugacaaaaccuugggaugugauucccauggucacccaaaucgccaugacggacacaaccccuuuuggccagcagcggguguucaaggagaaaguugauacccgcacaccgaaggcuaaaagagggacggcccaaauuauggaagugaccgcgcgguggcuuuggggauuucugagcagaaacaagaagccccggaucuguacacgcgaggaguucaccagaaaaguccggucuaaugccgcuaucggcgccguguuuguugacgagaaccaguggaauagcgcuaaggaggccguggaagacgagcgcuucugggaucucguccagaaagaaagagagcugcacaagcaggggaaaugcgccacaugcguguauaacaugaugggaaagcgggaaaagaaacugggcgaguuugggaaggcgaaaggcucccgcgcuauuugguacauguggcucggagccagauuccuggaguuugaagcccuuggcuucaugaaugaggaccacugguucucucgggaaaacagccuguccggggucgagggagagggccuccauaagcugggguacauccuucgcgauauuucuaaaaucccuggaggcaauauguaugcugacgauaccgccgggugggacacaagaauuaccgaagaugaccugcaaaacgaggcuaagaucacggauaucauggaacccgagcacgcccuccuggcgaccagcauuuuuaaacugacauaccagaauaaggugguucgggugcagcgcccugccaagaacggcaccgucauggacgugaucuccagacgggaucagcgcggaucuggccaaguggggacauauggacucaauaccuucacgaacauggaagcucagcugauuagacagauggagagcgagggcaucuuucuucccuccgaacuggagacaccgaaccucgccgaacggguucuggacuggcuugagaaauacgggguggaaagacugaagcgcauggcuauuagcggagaugacugugucgugaaaccuaucgacgaucgguucgccaccgcgcucacagcccugaaugacaugggcaagguuagaaaagauaucccccagugggagccuucuaagggguggaacgacuggcaacaggugcccuuuugcucccaucacuuccaccagcugauuaugaaggauggccgcgagaucgucgugccuugucggaaucaggacgaacucgucggacgggcucgcgugagccaaggcgccggguggucucugcgggagaccgcuugccuuggaaaauccuaugcccagauguggcagcugauguacuuucauagacgcgaucuccggcuggcugccaacgcgauuuguagcgccguucccguggacugggucccgacguccagaaccacauggucuauccacgcucaucaccaauggaugaccacagaagauaugcuuagcguguggaaucgcguuuggauugaggaaaacccuuggauggaggacaagacccauguguccagcuggggcgauguccccuaucuggggaaacgggaggaccaguggugcggaucucucaucggccugacagccagagccaccugggcuuccaauauucagguggccaucaaccaggugcggagacugaucgggaaugaaaacuaccucgacuacaugacgagcaugaagcgcuucaaaaaugagggcgaucccgaaggagcgcugugguga

SEQ ID NO: 19254 - RNA, 9879 nt, Artificial Sequence
  derived and/or modified CDS sequence (opt5) from DENV-1__EU482792__SS-prME
agcgugaccaugcugcucaugcugaugcccacagcccuugcuuuccaccugacgacccggggcggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaaacggaacccgacgauguggacuguuggugcaaugcuaccgauacaugggugaccuauggaacauguagccaaaccggcgagcaccggcgggacaagcgcuccgucgcccuggccccucauguggggcugggacucgagacgagaacagaaaccuggaugucuagcgagggcgcuuggaaacagauucagcggguugaaacaugggcccugcgccaccccggcuucaccgugaucgcucuuuuucuggcccaugcgauugggaccuccaucacacagaagggaaucauuuucauccuccugaugcuugucacgccuucuauggccaugagaugcgugggcauugggagccgggauuuuguugagggacuguccggcgcuaccuggguggacgucgugcucgagcacgggagcugugugacaaccauggccaaggauaaacccacacuggacaucgaacugcucaagaccgaggucacgaacccugcuguucugcgcaaacuuugcauugaagccaagaucucuaauacaaccaccgauuccagauguccgacacaaggagaggcgacccugauggaagaacaagacgccaacuucgugugccggcgcacauuuguggauagaggcuggggcaauggguguggacucuucggcaaagggagccugauuacgugcgcuaaguuuaagugcgucaccaaacuugagggaaagaucgugcaguacgaaaaccugaaauauucuguuaucgugacaguccacaccggcgaccagcaucaaguggggaaugaguccacagaacacggaaccacggccaccauuacaccccaggcuccuaccagcgagauccagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauucagaccuccggaacaaccacgaucuuugccggccaucucaaaugcagacugaagauggauaaacuuacacugaaggggaugagcuauguuauguguaccggcucuuucaaacucgagaaggaaguggcugagacccagcacggaacaguccuggugcagauuaaguacgagggcaccgacgccccgugcaaaaucccuuucuccacacaagaugaaaaggggguuacgcagaacggacggcugaucaccgcgaaucccauugugacagacaaagagaagccugucaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguguuuaccagcguuggcaaacugguccaucagauuuucgggacggccuacggagugcucuuuuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguucaccgugguugugggagaugucgugggcauucucgcccaggggaaaaagaugauccggccgcaacccauggagcacaaauacucuuggaaaagcuggggaaaggcuaagauuaucggcgccgacgugcagaauaccacauuuaucauugaugggccuaacacccccgaauguccugacgaucagagagccuggaauaucugggaggucgaggacuauggauucggcauuuuuacgacaaacaucuggcugaagcugcgcgauuccuacacccagguuugcgaccaccggcuuaugagcgcugcgauuaaagauucuaaggccgugcaugcugacaugggcuauuggaucgaauccgagaaaaaugaaacauggaagcucgccagagccagcuucaucgaggugaagaccuguauuuggcccaaaucucacacacugugguccaacgggguccuggaaagcgagaugaucauuccgaagaucuacggaggcccuauuucucaacauaauuaucgccccggguacuucacccagacggcuggaccuuggcaccucggcaaacuggagcuugauuuugaccugugcgaagggaccacagugguuguggaugagcacugcggaaaccggggccccagccucagaaccacaaccgucacgggcaagaucauccaugaaugguguugccgguccuguacacugccuccccugcgcuucaaaggggaggacggaugcugguacggcauggagauuagaccggugaaggaaaaggaggaaaaucuuguuaaaagcauggugucugccggguccggagaggucgacagcuuuucccucggccugcuguguaucucuauuaugaucgaagaggugaugcggagcagauggucccgcaagaugcucaugaccgggacacuggcgguuuuccuucugcucauuaugggacagcugaccuggaacgaucugauccggcuuugcauuauggugggcgcuaaugccucugacagaaugggcauggggaccacauaucuggcccucauggcuacguuuaaaaugcgcccuauguucgccgucggacugcucuuuagacggcugaccagccgcgaggugcuucugcucacaaucggccugucccugguggcgucugucgaacuucccaacagccuggaggaacucggggauggacuggcuaugggcaucaugauucucaagcugcuuaccgacuuccaaucccaccagcugugggccacacuccugagccugaccuuuaucaaaacgacacuuucucugcauuacgccuggaagaccauggcuaugguucucuccauugugagccuguucccccucugucugucuaccacaucccagaagaccacauggcuuccugugcugcuggggagccucggaugcaaaccgcugacgauguuucuuaucgccgagaauaagauuuggggcagaaaaucuuggccccugaacgaaggcaucauggcugucggggugguuuccauccuccugagcucccuccugaagaacgaugugccucuugccggaccccugauugcgggcgggaugcugaucgccuguuaugucauuagcggaucuagcgcugaccucucccuggagaaagccgcugaggugucuugggaagaggaagccgagcacagcggcgccucccauaauauccuuguugaagugcaggaugacgggaccaugaagauuaaagaugaggagcgggacgauacacugaccauccuccugaaggcuacacuccuggcggucucuggaguguacccucuuagcauccccgccacccuguucgucugguauuuuuggcaaaagaaaaagcagcgcuccggcgugcugugggacacgccuucucccccggaaguugagagagcugugcucgaugacggcauuuaccggaucaugcagcgcgggcugcuuggaagaagccaggucggcguggggguuuuccaagaaaacguguuccacaccauguggcacgucacacggggagccgugcugauguaucagggcaaacgccucgagccuuccugggccagcgugaagaaagaccugauuucuuacgggggaggcuggagacuccagggcuccuggaauaccggggaggaaguucaggucaucgcuguggagcccggaaagaacccuaagaaugugcaaacagcccccggcaccuuuaaaacaccggaaggggaggucggagcgauugcucuggauuucaagccuggcacgagcgggucucccaucgugaaccgggaaggaaaaauuguuggccuuuacggcaaugggguggucaccacauccggaaccuaugugagcgccaucgcccaggcuaaggccucccaggagggcccucugcccgagaucgaagacgagguuuuuagaaaacgcaaccugaccauuauggaucuccaucccgggucuggaaagacacggagauaccugccugcgaucgugcgcgaagcuauuaagcggaaacuuagaacgcugauccucgccccgacccgcgucguggccagcgagauggcugaagcccugaagggcaugcccauucgguaucaaacaaccgcuguuaaauccgagcacacagggaaggagaucguggaccugaugugccaugccaccuucacgaugagacuccuuagcccuguccgcgugcccaauuacaacaugaucauuauggaugaagcgcacuuuacagacccuucuuccaucgccgcucggggcuauauuagcaccagagugggaaugggcgaggccgcugccaucuucaugaccgccacacccccugggucugucgaggcuuuuccgcagagcaaugcgguuauucaggaugaggaacgggacauccccgagcgcuccuggaacucuggauacgaguggaucaccgauuucccuggcaaaacagugugguuugugcccagcauuaaguccgggaaugacaucgccaacugucugagaaagaauggaaaacgggucauucagcugucucgcaagaccuucgauacggaauaucagaagaccaagaacaacgacugggacuacgugguuaccacagauaucagcgagaugggcgcuaauuuuagagccgaccgggugauugauccuagacgcugccucaaacccgucauccugaaggacgggccggaacgggugauucuugccggcccuaugcccguuaccguggcuuccgccgcgcagagacgcggacggaucggcagaaaccauaauaaggagggggaucaguacaucuauaugggacagccccugaacaaugacgaggaucacgcucacuggacggaagccaaaaugcuccuggacaacauuaauaccccugagggcaucauucccgcccuguucgaaccugagcgcgaaaagagcgcugccaucgauggggaguaccggcucagaggagaggcgcgcaaaacauucgucgaacuuaugagacggggcgaccugccgguguggcugucuuauaaggucgccuccgagggguuucaauacagcgaucgcagauggugcuucgacggcgaacggaacaaucaggugcucgaggaaaacauggauguugagauuuggaccaaagagggagaacgcaagaaacugagaccccgguggcuugacgcuagaacauauuccgacccucuggcccuccgcgaguuuaaggaguucgcugccggccggagaucugugagcggggaucugauccuggagaucggaaagcucccccagcaucuuacccagcgcgcucaaaaugcccuggacaaccuggugaugcuccacaauuccgaacagggcgggcgggcguacagacaugccauggaggagcugccugauacaauugaaacccuuaugcugcucgcucugaucgccguccugacgggaggcguuacacucuuuuuccuuucuggccgggggcugggaaaaaccagcauuggccugcucugugugauggcuuccagcgugcugcuuuggauggccucugucgagccccacuggaucgccgcuuccauuauccuggaauuuuuccucauggugcugcugaucccggagccugaccgccagagaacaccccaggauaaccaacucgcguauguugugauugggcuucuguuuaugauccugacagucgccgcuaaugagaugggacuccuggaaaccacaaagaaagaccuuggcauugggcacguggccgucgagaaccaucaccaugccacgaugcuggauguggaccuccacccugcuagcgccuggacccuguacgcgguugccacaaccaucauuacacccaugaugcggcauaccaucgaaaacacgaccgcuaauauuucucugacagccaucgcuaaccaggccgcgauccucaugggacuugauaagggcuggccuauuuccaaaauggacaucggcgugccccugcuggcccucgggugcuacagccaggucaauccgcugacccuuacagcugccgugcugaugcucguugcucacuaugccauuaucggaccuggccugcaagcuaaggccacccgcgaggcgcagaagagaacggccgcugggauuaugaaaaaccccacaguggauggaaucgucgccaucgaccuggaucccgugguguacgacgcuaaguucgaaaaacagcucggccagauuaugcuucugauccuguguaccucucaaauucuccugaugcggacaaccugggcccuuugcgagagcaucacccuggccacagggccucucacgacccugugggagggauccccgggcaaguuuuggaauacaaccauugcgguuucuauggcuaacaucuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcauuauggaggucgaccgguccgaagcuaaagaggggcuuaagagaggagagacgacacgccacgccgugucucggggcaccgcgaaacugagaugguucguggaacgcaaucucgucaagcccgaggggaagguuaucgaucugggauguggcagagggggauggagcuauuacugcgccggccugaaaaaggugaccgaagugaaaggcuauacaaaagggggaccuggccaugaggaacccauuccuauggcuaccuacggguggaaccucgucaaacuucacuccggaaaggacguguuuuucacacccccugagaaaugugauacgcugcugugcgacaucggcgagucuagcccgaaucccaccauugaagaggggagaacacuccgcguucugaagaugguggaaccuuggcuucggggaaaccaauuuuguaucaagauucugaaucccuacaugccuuccgucguggagacccucgagcagaugcagagaaaauauggcggcaugcugguucgcaacccccugagcagaaauucuacacaugaaauguacuggguguccugcgggaccggaaacaucgucagcgccgugaauaugacgucuagaaugcuccugaaccgcuucaccauggcucaccggaagccgacauaugagagagauguggaccuuggcgccgggacccgccacgucgcgguugaaccugagguggccaaccuggauaucauuggacagagaaucgaaaauauuaaacaugagcacaaguccacauggcauuacgacgaggauaaccccuauaaaaccugggcuuaccacggcagcuaugaagugaagcccucuggguccgccagcuccauggucaauggagugguuaagcuccugacaaaaccuugggacgugauccccauggucacccaaauugcuaugacggauacaaccccuuuuggccagcagcggguguucaaggagaaaguugacacccgcacaccgaaggccaaaagaggcacggcucaaaucauggaagugaccgcccgguggcuuuggggguuucugagcagaaacaagaagccccggaucuguacacgcgaggaguucaccagaaaaguccggucuaaugcggccauuggagcuguguuuguugacgagaaccaguggaauagcgccaaggaggcuguggaagaugagcgcuucugggaccucguccagaaagaaagagagcugcauaagcagggcaaaugcgccacaugcguguacaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcgucgagggggagggacuccacaagcugggcuauauucuucgcgacaucucuaaaauuccugggggaaauauguacgccgaugacaccgcuggcugggauacaagaaucaccgaagacgaucugcaaaacgaggccaagaucacggacauuauggaacccgagcaugcucuccuggccaccagcaucuuuaaacugacauaucagaauaaggugguucgggugcagcgcccugcgaagaacgggaccgucauggaugugauuuccagacgggaccagcgcggcucuggacaagugggcacauacgggcucaauaccuucacgaacauggaagcccagcugaucagacagauggagagcgagggaauuuuucuucccuccgaacuggagacaccgaaccucgcugaacggguucuggauuggcuugagaaauauggcguggaaagacugaagcgcauggccaucagcggggacgacugugucgugaaaccuaucgaugaccgguucgcuaccgcccucacagcgcugaaugauaugggaaagguuagaaaagacauuccccagugggagccuucuaagggcuggaacgauuggcaacaggugcccuuuugcucccaccauuuccaccagcugaucaugaaggacgggcgcgagauugucgugccuugucggaaucaggaugaacucgucggcagagcccgcgugagccaaggagcuggcuggucucugcgggagaccgccugccuugggaaauccuacgcucagauguggcagcugauguauuuucacagacgcgaccuccggcuggccgcuaacgccaucuguagcgcgguucccguggauugggucccgacguccagaaccacauggucuauucaugcccaccaucaauggaugaccacagaagacaugcuuagcguguggaaucgcguuuggaucgaggaaaacccuuggauggaggauaagacccacguguccagcuggggagacguccccuaccugggcaaacgggaggaccaguggugcgggucucucauuggacugacagcuagagccaccugggccuccaauauccagguggcuaucaaccaggugcggagacugauuggcaaugaaaacuaccucgauuauaugacgagcaugaagcgcuucaaaaaugagggggaccccgaaggcgcccugugguga

SEQ ID NO: 19255 - RNA, 9879 nt, Artificial Sequence
  derived and/or modified CDS sequence (opt5) from DENV-1__EU482707__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgccggucuguuagcggagaucucauccuggagaucggcaagcugccccagcaccucacacagagagcgcagaaugcccuugacaaccuggugaugcugcauaauuccgaacaagggggacgggcuuaucgccacgccauggaggagcucccugauaccauugaaacacugaugcuucuggcucucaucgccgugcugaccggcggcgucacgcuguucuuucucucugggagaggacuuggcaagacaagcauugggcugcuguguguuauggccuccagcgugcuccuguggauggcuucuguggagccccauuggaucgcggccuccauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuacgccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuauagccaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccuguguacgucucagauucugcucaugagaacaaccugggcucugugcgagagcaucacacuugccaccggaccucugaccacacucugggagggcuccccgggcaaauucuggaauacgaccauugcugugucuauggccaacaucuuucgggggagcuaccuggccggagcuggccuggccuucucccucaugaaaagccuugggggaggccgcagagggacaggagcgcaaggcgaaacccugggcgagaaauggaagcggcagcugaaucagcucuccaagucugaguucaacacauauaaaagaagcgggaucauggagguugaccgcuccgaagccaaggagggacugaaacggggcgagaccacgaagcacgcugucucuagagggacagccaaacuucgcugguuuguggaacggaaucuggugaagcccgagggaaaggucauugaucucggcugugggagaggaggcuggagcuacuauugcgcuggccugaaaaagguuaccgaagugaaaggguacaccaagggaggcccugggcacgaggaacccaucccuauggccacauacggauggaaccuggugaaacuccauuccggcaaggacgucuucuuuauucccccugagaaaugugauacccuucugugcgacaucggggagucuagcccgaaucccacaauugaagagggacgcacgcugcgggugcucaagaugguugaaccuuggcugagaggcaaccaguucuguaucaagauucuuaaucccuauaugccuuccguggucgaggcgcuggagcaaaugcagcgcaaacacggcgggaugcucgugcggaacccccugagcagaaauucuacccaugaaauguacuggguuuccugcggaacaggcaacaucgugagcgccgucaauaugaccucucgcaugcugcucaaccgguuuacaauggcucacagaaagccgaccuaugagcgcgauguggaccuggggacgggaaccagacacguggccgucgaaccugagguugcuaaccuugauaucauuggccagcggaucgaaaauauuaaacaugagcacaaguccacauggcauuacgacgaggauaaccccuauaaaaccugggccuaccacgggagcuaugaagugaagcccucuggauccgcuagcuccauggugaauggcgucgugaagcugcucacaaaaccuugggacguuauccccauggugacccagauugccaugacagauaccacgccuuucggccaacagcgcgucuuuaaggagaaaguggacacaagaaccccgaaggcgaaacgggggaccgcccagaucauggaaguuacagcuagauggcuguggggauuccuuagccggaacaagaagccccgcaucuguacgagagaggaauuuacccggaaagugcgcucuaaugccgcuauuggcgccgucuucguggacgagaaccaauggaauagcgccaaggaggcgguugaagaugagagauuuugggaccuggugcaucgggaacgcgagcuccacaaacaggggaagugcgcuacaugcgucuacaacaugaugggaaaaagagaaaagaagcugggcgaguucgggaaagccaagggcucccgggccaucugguacauguggcugggagcucgcuuucucgaguucgaagcccugggcuucaugaaugaggaucacugguuuucuagagaaaacagccuuuccgggguggagggagagggccugcauaaacucggguauauucugcgggacaucucuaagauuccuggaggcaauauguacgcugaugacaccgccgggugggauacacgcaucaccgaagacgaucuucagaacgaggcgaaaaucacagacauuauggaacccgagcacgcccugcucgcuaaggccaucuucaaacugaccuaucagaauaaggucgugagaguucaacggccugcuaagaacggcacggugauggaugucauuagccgcagagaccagcggggauccggccagguggggaccuacggacugaauacauuuaccaacauggaagcccagcucaucagacaaauggagucugagggcauuuucagccccuccgaacuggagacaccgaaccuugcggaacgcgcccuggauuggcucgagaaauaugggguggaacggcugaagagaauggcuaucagcggagacgacuguguugugaaaccuaucgaugaccgcuuugccaccgcucuuacggcccugaaugauaugggcaagguccggaaagacauuccccagugggagccuucuaagggguggaacgauuggcaacaggugcccuucugcucccaucacuuucaccaacucaucaugaaggacggcagagagauuguugugccuugucgcaaucaggaugaacuggucggacgggcuagagugagccagggcgccggguggucucugcgcgagacagcgugccucggaaaauccuacgcccagauguggcaacugauguauuuccaucggagagaccuucgccuggcugccaacgccaucuguagcgcuguccccguggauuggguuccgaccucccggacaaccuggucuauucacgcccaucaccaguggaugacgaccgaagacaugcucagcguguggaauagagucuggaucgaggaaaacccuuggauggaggauaagacacauauuuccagcugggaggacgugcccuaccugggcaaacgggaagaccaguggugcgggucucuuaucggacugaccgcgagagcuacaugggccaccaauauccaaguugccauuaaccaggugcgccggcucaucggcaaugagaacuaccuggauuauaugacauccaugaagagauuuaaaaaugaaagcgaccccgagggggcucugugguga

SEQ ID NO: 19256 - RNA, 9879 nt, Artificial Sequence
  derived and/or modified CDS sequence (opt5) from DENV-1__EU482708__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaaaaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugaucuccgagauuggaaaacucccccagcaccugacccagagagcccaaaaugcgcuggacaaccucgugaugcuucauaauucugaacagggcgggcgggccuaucgccacgcuauggaggagcugccugauacaaucgaaacccugaugcuccuggcccuuauugcugugcugacgggaggcgucacacucuuuuuccugagcggcagagggcugggaaagaccuccaucggccuccuuuguguuauggccagcucugugcugcuguggauggccuccguggagccccauuggauugcugcgagcaucauccucgaauuuuuccugaugguccuucugauuccggagccugaccggcagcgcacaccccaggauaaccaacucgccuacgugguuaucgggcugcuguuuaugauucucacaguggcugccaaugagaugggacuucuggaaaccacaaagaaagaccugggcaucgggcacgucgccguggagaaccaccaucacgcugccaugcucgaugucgaccugcauccugcgucugccuggacgcuuuacgcuguggccaccacaauuaucacccccaugaugagacacacaauugaaaacaccacggcuaauaucucccugaccgccaucgcgaaccaggccgcuauucucaugggacuggauaagggcuggccuaucagcaaaauggacauuggcguuccccugcucgcccuugggugcuauucucaggugaauccgcugacacugaccgcugccguccucaugcugguggcucauuacgccaucauuggaccuggccuucaagcgaaggccacacgggaggcucagaaacgcaccgccgcugggaucaugaagaaccccacgguugauggaaucguggccauugaccuggaucccgucguguaugacgccaaguucgaaaaacagcucggccagaucaugcugcugauucucuguacaagccaaauccuucugaugagaaccacaugggcgcugugcgaguccauuacccucgcuaccgggccucugacaacgcuuugggagggaucuccgggcaaguuuuggaauaccacaaucgccgugagcauggcuaacaucuuccggggcuccuaccuggccggggccggacucgcuuucagccugaugaaaucccugggcgggggacgcagaggcaccggggcccagggagaaacacucggcgagaaguggaaacggcagcuuaaucagcugucuaagagcgaauuuaacaccuauaagagauccggcauuauggagguugaccgcucugaagcgaaagaggggcugaagcggggagagacgacaaaacacgccgucagcagaggcaccgcuaagcuccgcugguucguggaacggaaucuggugaaacccgaggggaaggucaucgaucuuggauguggcagagggggaugguccuacuauugcgccggccugaagaaaguuaccgaagugaagggcuacacaaaagggggaccuggccacgaggaacccauuccuauggcuaccuacggguggaaccucgugaagcugcauucuggaaaagacgucuuuuucauucccccugagaagugugauacacugcucugcgacauuggcgagagcuccccgaaucccacgaucgaagaggggcgcacccuucgggugcugaaaaugguugaaccuuggcugagaggaaaccaauuuuguauuaagauccucaaucccuauaugccuagcguggucgagacacuggagcagaugcagcgcaagcacggcggcaugcuugugcggaacccccugucuagaaauuccacccaugaaauguacuggguuagcugcgggacaggaaacaucgugucugccgucaauaugaccucccgcaugcuccugaaccgguucacgauggcgcacagaaaaccgaccuaugagcgcgauguggaccugggcgccgggacaagacacguggcugucgaaccugagguugccaaccucgauauuaucggacagcggauugaaaauaucaagcaugagcacaaaagcaccuggcauuacgacgaggauaaccccuauaagacaugggcuuaccacggcucuuaugaagugaaacccuccgggagcgccuccagcauggugaauggagucgugaagcugcuuaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcuguggggguuucucucuagaaacaagaagccccggauuuguacccgcgaggaguucacaagaaaagugcggagcaaugcugccaucggagcugucuuuguggacgagaaccaguggaacuccgccaaggaggccguugaagaugagcgcuucugggaccuggugcauagagaacgggagcuucacaaacagggcaagugcgcgaccugcgucuacaacaugauggggaaacgcgaaaagaagcugggagaguuuggcaaagcuaaggggucuagagccauuugguacauguggcucggcgcccgguuccuggaguucgaagcucugggauuuaugaaugaggaucacugguucagccgcgaaaacucccucucuggcguggagggggagggacugcauaaacuuggcuauauccugagagacauuagcaagaucccugggggaaauauguacgccgaugacacagcuggcugggauacccggaucacagaagacgaucuccagaacgaggcccgcauuaccgacaucauggaacccgagcacgcgcugcuugccagauccauuuuuaaacugacguaucaaaauaaggucgugcggguucagcgcccugcuaaaaacgggaccgugauggaugucaucucuagacgggaccagagaggcagcggacaggugggcacauacgggcucaauaccuucacaaacauggaagcccaacugauucgccagauggaguccgagggaaucuuuagccccucugaacuggagaccccgaaccucgcugaacgggugcuggauuggcuugagaaguauggcguugaaagacugaagcgcauggccaucuccggggacgacuguguggucaaaccuauugaugaccgguucgcgacggcccucacagcucugaaugauaugggaaaggugagaaaagacaucccccagugggagccuagcaagggcuggaacgauuggcagcaaguucccuuuugcucucaucacuuccaccagcuuauuaugaaagacgggcgcgagaucguggucccuugucggaaucaggaugaacuggugggcagagcccgcgucucccagggagcuggcuggagccuccgggagaccgccugccuggggaaguccuacgcucaaauguggcagcugauguauuuucauagacgcgaccuccggcuggccgcgaacgccauuuguucugcugugcccguugauuggaucccgacaagcagaaccacgugguccauucacgcccaucaccaguggaugaccacagaagacaugcuuagcguguggaaucgggucuggaucgaggaaaacccuuggauggaggauaagacccauaucucuuccuggggagacgugcccuaccugggcaaaagagaggaccaauggugcgggagccucauuggacugacagcccgcgcuaccugggccacaaauauccagguugcgauuaaccaggugcggagacuuaucggcaaugaaaacuaccuggauuauaugaccucuaugaagcgcuucaaaaaugagagcgaccccgaaggggcucucugguga

SEQ ID NO: 19257 - RNA, 9879 nt, Artificial Sequence
  derived and/or modified CDS sequence (opt5) from DENV-1__EU482709__SS-prME
agcgugaccaugcugcucaugcuggugcccacagcccuugcuuuccaccugacgaccagaggcggggaaccucauaugaucguuuccaagcaggaacgggggaaaucucuccuguuuaagacaagcgccggcgugaacaugugcacccuuaucgcgauggaccugggggagcucugugaagauacaaugaccuacaaaugcccccgcaucacagagaccgaacccgacgauguggacuguuggugcaaugcuacggauaccugggucacauauggaaccuguucccaaacaggcgagcacagacgggacaagcgcucuguggcccuggccccucauguugggcugggacucgagaccagaacggaaacauggaugagcuccgagggcgcuuggaaacagauucagcggguggaaaccugggcccugcgccaccccggcuucacagucaucgcucuuuuucuggcccaugcgauugggaccucuaucacccagaagggaaucauuuucauccuccugaugcuugugacaccuagcauggccaugagaugcguuggcauugggucccgggauuuuguggagggacugagcggcgcuacgugggucgacguggugcucgagcacgggucuugugucaccacaauggccaaggauaaacccacccuggacaucgaacugcucaagacagagguuaccaacccugcugugcugcgcaaacuuugcauugaagccaagaucuccaauacgacaaccgauagcagauguccgacccaaggagaggcgacacugguggaagaacaagacgccaacuucgucugccggcgcaccuuuguggauagaggcuggggcaauggguguggacucuucggcaaagggucucugauuacaugcgcuaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgccacgauuacaccccaagcuccuaccaccgagauccagcucacagacuacggcgcccugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaagugguugugcugggaagccaagagggcgccaugcacacggcucugaccggggccacagaaauucagaccuccggaacaaccacgaucuuugccggccaucucaaaugcagacugaagauggauaaacuuacacugaaggggaugagcuaugucauguguaccggcucuuucaaacucgagaaggaaguggcugagacccagcacggaacaguucuggugcagauuaaguacgagggcaccgacgccccgugcaaaaucccuuucuccacacaagaugaaaagggggucacgcagaacggacggcugaucaccgcgaaucccauugugacagacaaagagaagccugugaacaucgaagcugagccgcccuuuggcgagagcuauauuguuaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggagucuuuaccagcgugggcaaacuggugcaucagauuuucgggacggccuacggaguccucuuuuccggcgugagcuggaccaugaagaucgggauuggcguucugcuuacauggcugggacucaauucuagauccaccagccugucuaugacauguaucgcugugggccuggucacccuuuaccucggggugaugguucaggccgauuccggaugcgugauuaacuggaaaggccgcgaacugaagugugggagcggaaucuucgucacaaaugaggugcacaccuggacggaacaauauaaguuucaggcugacuccccuaaacggcugucugccgcgauuggcaaggccugggaggaggggguuugcggcaucagaagcgcuacacgccucgaaaacaucauguggaaacagauuuccaacgagcugaaucauauccuucuggaaaacgacaugaaguucaccguggucgugggagauguggccggcauucucgcucaggggaaaaagaugauccggccgcaacccauggaguacaaauauucuuggaaaagcuggggaaaggccaagauuaucggcgccgacguccagaauaccacauuuaucauugaugggccuaacacccccgaauguccugacgaucagagagcuuggaauaucugggagguugaggacuacggauucggcauuuuuacgacaaacaucuggcugaagcugcgcgauuccuauacccaggugugcgaccaccggcuuaugagcgcggccauuaaagauucuaaggcugugcacgccgacaugggcuacuggaucgaauccgagaaaaaugaaacauggaagcucgccagagcuagcuucaucgaggucaagaccuguauuuggcccaaaucucauacacugugguccaacggggugcuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacaguuguggucgaugagcacugcggaaaccggggccccagccucagaaccacaaccgugacgggcaagaucauccacgaaugguguugccgguccuguacacugccuccccugcgcuucagaggggaggacggaugcugguauggcauggagauucggccgguuaaagaaaaggaggaaaaucuugucaagagcauggucucugcgggguccggagagguggacagcuuuucccucggccugcuguguaucucuauuaugaucgaagagguuaugagaagccgcuggucccggaaaaugcucaugaccgggacacuggcuguguucuuucuucugauuaugggacagcucaccuggaacgaucugaucagacugugcauuauggucggcgccaaugccucugaccgcaugggcauggggaccacauaccuugcucugauggccacguucaagaugagaccuauguuugcggugggacuccuguuccggcgccucaccagcagagaggugcugcuucugacaaucggccucucccuggucgcuucuguugaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccauggugcuuuccauugugagccuguucccccucugucugucuaccacaucccagaagaccacauggcucccuguccugcuugggagccugggaugcaagccgcugacgauguuucucaucgcugagaauaaaauuuggggccggcgcucuuggccccugaacgaaggcaucauggccguggggaucguuuccauucuucugagcucccuccugaagaacgaugugccucucgcgggaccccugaucgccggcgggaugcuuauugcuuguuacgucaucagcggaucuagcgccgaccugucccuggagaaagcugccgaggugucuugggaagaggaagccgagcauagcggcgcuucccacaauauucucguugaagugcaggaugacgggaccaugaagaucaaagaugaggagagagacgauacacugaccauccuucugaaggcgacacuccuggccgucucuggaguguauccucucagcauucccgcuacccuguucgucugguacuucuggcagaagaagaagcagcgguccggcgugcuuugggacacgccuucucccccggaaguugagcgcgccgugcuggaugacggcaucuauagaauuaugcagcgggggcugcucggacgcagccaggucggcguggggguuuuucaagaaaacguguuccauaccauguggcacgucacaagaggagccgugcugauguaccagggcaaacggcuugagccuuccugggcuagcgugaagaaagaccugaucucuuacgggggaggcuggagacuccagggcuccuggaauaccggggaggaaguucaggucauugccguggagcccggaaagaacccuaaaaaugugcaaacagcgcccggcaccuuuaagacaccggaaggggaggucggagcuaucgcccuggauuucaagccuggcacgagcgggucucccauugugaaccgcgaaggaaaaaucguuggccucuauggcaaugggguggucaccacauccggaaccuacgugagcgccaucgcucaggccaaggcgucccaggagggcccucugcccgagauugaagacgagguuuuucggaaaagaaaccuuaccaucauggaucugcaccccgggucuggaaagacacgccgguaucugccugcuauugugagagaagccaucaaacgcaagcuccggacgcugauucuugccccgaccagagucguggcuagcgagauggccgaagcucugaagggcaugcccauccgcuaccaaacaaccgccguuaaauccgagcauacagggaaggagaucguggaccucaugugccacgcgaccuucacgaugcggcugcugagcccugucagagugcccaauuauaacaugauuaucauggaugaagcccauuuuacagacccuucuuccauugcugcccggggcuacaucagcacccgcgugggaaugggcgaggcugccgccauuuucaugaccgcuacacccccugggucugucgaagcguuuccgcagagcaaugccguuauccaggaugaggaaagagacauccccgagcgguccuggaacucuggauaugaguggauuaccgauuucccuggcaaaacagugugguuugugcccagcaucaaguccgggaaugacauugcuaacugucuccgcaaaaauggaaagagagucauccagcuuucucggaagaccuucgauacggaauaccagaaaaccaagaacaacgacugggacuacgugguuaccacagauauuagcgagaugggcgccaauuucagagccgaccgcgugaucgauccucggagaugccugaaacccgucauucugaaggacgggccggaacgcgugauccucgcuggcccuaugcccguuaccguggccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucgucgaacugaugcgcagaggcgaccucccgguguggcuuucuuacaaggucgcuuccgagggguuucaauauagcgaucggcgcuggugcuucgacggcgaaagaaacaaucaggugcuggaggaaaacauggauguugagaucuggaccaaagagggagaacggaagaaacugagaccccgcuggcucgacgcccggacauacuccgacccucuggcucuuagagaguuuaaggaguucgccgcuggccgccggucugugagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcuguccucacgggaggcguuacacuguuuuuccugucuggcagagggcucggaaagaccagcaucggccuucugugugugauggccuccagcgugcugcucuggauggccucugucgagccccauuggauugcugcguccaucauccuggaauuuuuccuuauggugcugcucauuccggagccugaccggcagcgcacaccccaggauaaccaacuggccuacguugugaucgggcugcucuuuaugauucuuacagucgcugccaaugagaugggacugcuggaaaccacaaagaaagaccucggcaucgggcacguggccgucgagaaccaccaucacgcugccaugcuggauguggaccuucauccugcgagcgccuggacgcuguacgcuguugccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcgugccccuccuugcccuggggugcuauagccaggucaauccgcugacacucaccgcugccgugcugaugcuuguugcucauuacgccaucauuggaccuggccugcaagcgaaggccacacgggaggcucagaaacgcaccgccgcugggaucaugaagaaccccacgguggauggaaucgucgccauugaccucgaucccgugguguaugacgccaaguucgaaaaacagcugggccagaucaugcugcucauucuuuguacaucucaaauccugcugaugagaaccacaugggcgcucugcgagagcauuacccuggcuaccgggccucuuacaacgcugugggagggauccccgggcaaguuuuggaauaccacaaucgccguuucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggaggucgaccgcuccgaagcgaaagaggggcucaagcggggagagacgacaaaacacgccgugucuagaggcaccgcuaagcugcgcugguucguggaacggaaucuugucaaacccgaggggaagguuaucgaucugggauguggcagagggggauggagcuacuauugcgccggccucaagaaagugaccgaagugaagggcuacacaaaagggggaccuggccacgaggaacccauuccuauggcuaccuacggguggaaccuggucaagcugcauuccggaaaagacguguuuuucauucccccugagaagugugauacacuccuuugcgacauuggcgagucuagcccgaaucccacgaucgaagaggggcgcacccugcggguucugaaaaugguggaaccuuggcucagaggaaaccaauuuuguauuaagauccugaaucccuauaugccuuccgucguggagacacuugagcagaugcagcgcaagcacggcggcaugcugguucggaacccccucagcagaaauucuacccaugaaauguacuggguguccugcgggacaggaaacaucgucagcgccgugaauaugaccucucgcaugcugcugaaccgguucacgauggcgcacagaaaaccgaccuaugagcgcgauguggaccucggcgccgggacaagacacgucgcuguugaaccugagguggccaaccuggauauuaucggacagcggauugaaaauaucaagcaugagcacaaauccaccuggcauuacgacgaggauaaccccuauaagacaugggcuuaccacggcagcuaugaagugaaacccucuggguccgccagcuccauggucaauggagugguuaaacuucugaccaagccuugggacgugauucccauggucacacaaaucgcuaugaccgauacgacaccuuuuggccagcagcgcguguucaaagagaagguugacaccagaaccccgaaagccaagcggggcacagcgcaaaucauggaagugacggccaaauggcucuggggguuucugagcagaaacaagaagccccggauuuguacccgcgaggaguucacaagaaaaguccggucuaaugcugccaucggagcuguguuuguugacgagaaccaguggaauagcgccaaggaggccguggaagaugagcgcuucugggaccuuguccauagagaacgggagcugcacaaacagggcaagugcgcgaccugcguguacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcgucgagggggagggacuucauaaacugggcuauauccucagagacauuucuaagaucccugggggaaauauguacgccgaugacacagcuggcugggauacccggaucacagaagacgaucugcagaacgaggcccgcauuaccgacaucauggaacccgagcacgcgcuucuggccaaaagcauuuuuaagcucacguaucaaaauaaagugguuagagugcagcggccugcuaagaacgggaccgucauggaugugaucucccgcagagaccagcggggcucuggacaggugggcacauacgggcugaauaccuucacaaacauggaagcccaacugauuagacagauggagagcgagggaaucuuuucccccagcgaacucgagaccccgaaccuggcugaacgcguucuugauuggcuggagaaguauggcguggaacggcucaaaagaauggccaucucuggggacgacugugucgugaagccuauugaugaccgcuucgcgacggcccugacagcucuuaaugauaugggaaaaguucggaaggacaucccccagugggagccuuccaaaggcuggaacgauuggcagcaagugcccuuuugcagccaucacuuccaccagcugauuaugaaggacgggagagagaucgucgugccuugucgcaaucaggaugaacucgucggccgggccagagugucucagggagcuggcuggucccugcgcgagaccgccugccugggaaagagcuacgcucaaauguggcagcucauguauuuucaucggagagaccugcgccuugccgcgaacgccauuuguuccgcuguucccguggauuggaucccgacaucucggaccacguggagcauucacgcccaucaccaguggaugaccacagaagacaugcuguccgucuggaauagaguguggaucgaggaaaacccuuggauggaggauaaaacccauaucagcucuuggggagacguucccuaccucggcaagcgggaggaccaauggugcgggucccugauuggacuuacagccagagcuaccugggccacaaauauccagguggcgauuaaccagguccgccggcugaucggcaaugaaaacuaccucgauuauaugaccagcaugaaaagauucaagaaugagucugaccccgaaggggcucugugguga

SEQ ID NO: 19258 - RNA, 9879 nt, Artificial Sequence
  derived and/or modified CDS sequence (opt5) from DENV-1__EU482710__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaauaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaacacucuuggaaaagcuggggaaaggccaagaucauuggcgccgacguccagaauaccaccuuuaucaucgaugggccuaacacacccgaauguccugacgaucagagagcuuggaauauuugggagguugaggacuacggauucggcaucuuuaccacgaacauuuggcugaagcugcgcgauuccuauacacaggugugcgaccaucggcuuaugagcgcggccaucaaagauucuaaggcugugcacgccgacaugggcuacuggauugaauccgagaaaaaugaaaccuggaagcucgccagagcuagcuucaucgaggucaagacauguaucuggcccaaaucucauacccugugguccaacggggugcuggaaagcgagaugauuaucccgaagauuuauggaggcccuaucucucaacacaaucaccgccccggguacuucacacagaccgccggaccuuggcaucucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguauggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaccuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcuggggagccucggaugcaaaccgcugacaauguuucuuauuacggagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuaugugaucagcggaucuagcgcugaccucucccuggagaaagccgcugagguuucuugggaagaggaagccgagcacagcggcgccucccacaauauucuuguggaaguccaggaugacgggaccaugaagaucaaagaugaggagcgggacgauacacugaccauucuccugaaggcuacacuccuggcggugucuggagucuacccucuuagcauccccgccacccuguucgugugguauuuuuggcaaaagaaaaagcagcgcuccggcguucugugggacacgccuucucccccggaaguggagagagcuguccucgaugacggcaucuaccggauuaugcagcgcgggcugcuuggaagaagccaggugggcguugggguguuccaagaaaacgucuuccauaccauguggcacgugacacggggagccgugcugauguaucagggcaaacgccucgagccuuccugggccagcguuaagaaagaccugaucucuuacgggggaggcuggagacuccagggcuccuggaauaccggggaggaaguccaggugauugcuguggagcccggaaagaacccuaagaauguccaaacagcccccggcaccuuuaaaacaccggaaggggaggugggagcgaucgcucuggauuucaagccuggcacgagcgggucucccauuguuaaccgggaaggaaaaaucgugggccuuuauggcaauggggucgugaccacauccggaaccuacguuagcgccauugcccaggcuaaggccucccaggagggcccucugcccgagaucgaagacgagguguuuagaaaacgcaaccugaccaucauggaucuccaucccgggucuggaaagacacggagauaccugccugcgauuguccgcgaagcuaucaagcggaaacuuagaacgcugauucucgccccgacccgcgugguugccagcgagauggcugaagcccugaagggcaugcccauccgguaucaaacaaccgcugugaaauccgagcacacagggaaggagauugucgaccugaugugccaugccaccuucacgaugagacuccuuagcccugugcgcgugcccaauuacaacaugaucaucauggaugaagcgcacuuuacagacccuucuuccauugccgcucggggcuauaucagcaccagagucggaaugggcgaggccgcugccauuuucaugaccgccacacccccugggucuguugaggcuuuuccgcagagcaaugcggugauccaggaugaggaacgggacauucccgagcgcuccuggaacucuggauacgaguggaucaccgauuucccuggcaaaacagugugguuuguccccagcaucaaguccgggaaugacauugccaacugucugagaaagaauggaaaacgggugauccagcugucucgcaagaccuucgauacggaauaucagaagaccaagaacaacgacugggacuacguugugaccacagauauuagcgagaugggcgcuaauuuuagagccgaccgggucaucgauccuagacgcugccucaaacccgugauucugaaggacgggccggaacggguuauccuugccggcccuaugcccgugaccgucgcuuccgccgcgcagagacgcggacggauuggcagaaaccacaauaaggagggggaucaguauaucuacaugggacagccccugaacaaugacgaggaucaugcucacuggacggaagccaaaaugcuccuggacaacaucaauaccccugagggcauuauccccgcccuguucgaaccugagcgcgaaaagagcgcugccauugauggggaguaccggcucagaggagaggcgcgcaaaacauucguggaacuuaugagacggggcgaccugccggucuggcugucuuauaagguggccuccgagggguuucaauacagcgaucgcagauggugcuucgacggcgaacggaacaaucagguucucgaggaaaacauggauguggagaucuggaccaaagagggagaacgcaagaaacugagaccccgguggcuugacgcuagaacauauuccgacccucuggcccuccgcgaguuuaaggaguucgcugccggccggagaucugugagcggggaucugauuuccgagaucggaaagcugccccagcaucucacccagcgcgcucaaaaugcccuugacaaccuggucaugcugcacaauucugaacagggcgggcgggcguacagacacgccauggaggagcucccugauacaaucgaaacccugaugcuucuggcucucauugccguucugacgggaggcgugacacuguuuuuccucagcggccgggggcuuggaaaaaccuccaucggccugcugugugugauggcuagcucuguccuccuguggauggccuccguggagccccauuggauugccgcuagcaucauucuugaauuuuuccugaugguucuccugaucccggagccugaccgccagagaacaccccaggauaaccaacuggcguauguggucaucgggcuccuuuuuaugauucugacaguggccgcuaaugagaugggacugcucgaaaccacaaagaaagaccugggcaucgggcacgucgccguggagaaccaucaccaugccacgaugcuugauguugaccugcacccugcuucugccuggacccucuacgcgguggccacaaccauuaucacacccaugaugcggcacaccauugaaaacacgaccgcuaauaucucccugacagccauugcuaaccaggccgcgauccugaugggacucgauaagggcuggccuaucagcaaaauggacauuggcgucccccuucuggcccuggggugcuauucucaggugaauccgcucacccugacagcugccguucuuaugcugguggcucauuacgccaucauuggaccuggccuccaagcuaaggccacccgcgaggcgcagaagagaacggccgcugggaucaugaaaaaccccacagucgauggaauuaucgccaucgaccuggaucccgugguguacgacgcuaaguucgaaaaacagcugggccagauuaugcuccuuauccuguguaccagccaaauucugcucaugcggacaaccugggcccugugcgaguccaucacccuugccacagggccucugacgacccucugggagggaucuccgggcaaguuuuggaauacaaccauugcgguuagcauggcuaacaucuuccgcggcuccuaucuggccggggcuggacuggccuuuagccucaugaaaucccuuggcgggggaagacggggcacaggggcccagggagaaacccugggcgagaaguggaagcgccagcugaaucagcucucuaaaagcgaguucaacaucuacaagagauccggcauuauggaggucgaccggucugaagcuaaagaggggcugaagagaggagagacgacacgccacgccgugagccggggcaccgcgaaacuuagaugguucguggaacgcaaucuggucaagcccgaggggaagguuaucgaucucggauguggcagagggggaugguccuauuacugcgccggccugaaaaaggugaccgaagugaaaggcuauacaaaagggggaccuggccaugaggaacccauuccuauggcuaccuacggguggaaccuggucaaacuccacucuggaaaggacguguuuuucacacccccugagaaaugugauacgcuucugugcgacaucggcgagagcuccccgaaucccaccauugaagaggggagaacacugcgcguucucaagaugguggaaccuuggcugcggggaaaccaauuuuguaucaagauucuuaaucccuauaugccuagcgucguggagacccuggagcagaugcagagaaaacacggcggcaugcucguucgcaacccccugucuagaaauuccacacaugaaauguacugggugagcugcgggaccggaaacaucgucucugccgugaauaugacguccagaaugcugcucaaccgcuucaccauggcucaccggaagccgacauacgagagagauguggaccugggcgccgggacccgccaugucgcgguugaaccugagguggccaaccuugauaucauuggacagagaaucgaaaauauuaaacacgagcauaagagcacauggcacuaugacgaggauaaccccuacaaaaccugggcuuaucacggcucuuacgaagugaagcccuccgggagcgccuccagcauggucaauggagugguuaagcugcucacaaaaccuugggacgugauccccauggucacccaaauugcuaugacggauacaaccccuuuuggccagcagcggguguucaaggagaaaguugacacccgcacaccgaaggccaaaagaggcacggcucaaaucauggaagugaccgcccgguggcuguggggguuucuuucuagaaacaagaagccccggaucuguacacgcgaggaguucaccagaaaaguccggagcaaugcggccauuggagcuguguuuguugacgagaaccaguggaacuccgccaaggaggcuguggaagaugagcgcuucugggaccugguccagaaagaaagagagcuccauaagcagggcaaaugcgccacaugcguguauaacaugauggggaagcgggaaaagaaacugggagaguuuggcaaggccaaagggucucgcgcgaucugguacauguggcugggcgcuagauuccucgaguuugaagcccugggauucaugaaugaggaucacugguucagccgggaaaacucccuuucuggcgucgagggggagggacugcauaagcucggcuauauucugcgcgacaucagcaaaauuccugggggaaauauguacgccgaugacaccgcuggcugggauacaagaaucaccgaagacgaucuucaaaacgaggccaagaucacggacauuauggaacccgagcacgcucugcucgccaccuccaucuuuaaacugacauaccagaauaaggugguucgggugcagcgcccugcgaagaacgggaccgucauggaugugauuucuagacgggaccagcgcggcagcggacaagugggcacauaugggcugaauaccuucacgaacauggaagcccagcucaucagacagauggaguccgagggaauuuuucugcccagcgaacuugagacaccgaaccuggcugaacggguucucgauuggcuggagaaauacggcguggaaagacuuaagcgcauggccaucucuggggacgacugugucgugaaaccuaucgaugaccgguucgcuaccgcccugacagcgcucaaugauaugggaaagguuagaaaagacauuccccagugggagccuuccaagggcuggaacgauuggcaacaggugcccuuuugcagccaccauuuccaccagcugaucaugaaggacgggcgcgagauugucgugccuugucggaaucaggaugaacuggucggcagagcccgcgugucucaaggagcuggcuggucccuccgggagaccgccugccuggggaaaagcuaugcucagauguggcagcuuauguacuuucauagacgcgaccugcggcucgccgcuaacgccaucuguuccgcgguucccguggauugggucccgacgucuagaaccacauggagcauucacgcccaucaccaauggaugaccacagaagacaugcuguccguguggaaucgcguuuggaucgaggaaaacccuuggauggaggauaagacccacgugagcucuuggggagacguccccuaucuuggcaaacgggaggaccaguggugcgggucccugauuggacucacagcuagagccaccugggccagcaauauccagguggcuaucaaccaggugcggagacugauuggcaaugaaaacuaccuggauuauaugacgucuaugaagcgcuucaaaaaugagggggaccccgaaggcgcccucugguga

SEQ ID NO: 19259 - RNA, 9879 nt, Artificial Sequence
  derived and/or modified CDS sequence (opt5) from DENV-1__EU482712__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaaauuauggaggcccuauuagccagcacaacuaccgccccggguacuuuacacaaaccgcgggaccuuggcaucugggcaagcucgagcuggauuucgaccuuugcgaagggacgaccgugguuguggaugagcacugcggaaaucggggccccucccugagaacaaccacagucaccggcaaaaucauucacgaaugguguugccggagcuguacgcucccuccccugcgcuuuaagggggaggacggaugcugguauggcauggagaucagaccggugaaggaaaaagaggaaaaccugguuaagucuaugguguccgcugggagcggagaggucgacuccuucucucuuggccuccuguguaucagcauuaugaucgaagaggugaugcgguccagauggucucgcaaaaugcugaugacagggacccucgccguucuguuucuucugauuaugggacagcucacauggaaugaucugauccggcugugcauuauggugggcgccaacgcuagcgacagaaugggcauggggaccaccuaccuugcccugauggcgacauucaagaugcgcccuauguuugcugucggacuccuguucagacggcucacgucccgcgaggugcugcuucugaccaucggccucucucugguggccagcgucgaacugcccaauucccuugaggaacugggggauggacucgccaugggcauuaugauccugaaacuccugacagacuuucagagccaucaacuuugggcuacccugcucucucugacauucaucaagaccacguuuucccugcacuaugccuggaagacaauggcuaugguucuuagcauugugucucuguucccccucugucuguccaccaccagccagaaaacaaccuggcucccugugcugcuugggucucugggaugcaagccgcugacaauguuucucaucgccgagaacaaaauuuggggcagaaaguccuggccccugaacgaaggcaucauggcggucgggauugugagcauccuucuguccagccuccugaaaaaugauguuccucucgccggaccccugaucgcuggcgggaugcuuauugccuguuacgugaucucuggaagcuccgcugaccugucucuggagaaggccgccgaggucagcugggaagaggaagcugagcauuccggcgcgucucacaacauucucguggaaguucaggaugacgggacgaugaaaaucaaggaugaggagcgggacgauacccugacaauucuucugaaggccacccuccuggcugugagcggagucuauccucucuccauccccgccacacuguucgugugguacuucuggcagaaaaagaaacaacgcucuggcguccuuugggacaccccuuccccucccgaaguggagagagccguucuggaugacggcaucuaucggauuaugcagcgcgggcugcucggaagaucccaggugggcgucgggguguuucaggaaaauguuuuccauacgauguggcacgugacccggggagcuguccugauguaccaaggcaagcgccuugagcccagcugggccucugugaaaaaggaccugaucuccuacgggggaggcuggagacuccagggcagcuggaacacaggggaggaagugcagguuauugcggucgagcccggaaagaauccuaaaaacgugcagaccgcucccggcacauuuaagaccucugaaggggaggugggagccaucgcccuggauuucaaaccgggcacauccgggagcccuauugucaaucgggaaggaaagaucgugggccucuauggcaacgggguugugacgaccuccggaacauacgucucugcuauugcccaagcgaaagcuagccaggagggcccccugccugagaucgaagacgagguguuuagaaagcgcaaucuuaccaucauggaucugcaccccggguccggaaagacccggagauaucugcccgccauuguucgcgaagccaucaaacggaagcucagaacacugauucuugcuccuacgcgcguggucgccagcgagauggcugaagcccugaaaggcaugccgauccgguaccagaccacagcggugaagucugagcauaccgggaaagagauuguugaccucaugugccacgccacauucaccaugagacugcugucccccgugcgcgucccuaacuauaauaugaucaucauggaugaagcucauuuuacggaccccagcucuauugccgcucggggcuacaucagcacaagagugggaaugggcgaggccgccgcuauuuucaugaccgcgaccccucccggguccguggaagccuuuccucaaucuaacgcugucauccaggaugaggaacgggacauuccggagcgcagcuggaacuccggauaugaguggaucacagauuuccccggcaagaccguuugguuugugccuucuaucaagagcgggaacgacauugccaauugucuccgcaagaauggaaagcgggugauccagcuuucccgcaaaacauucgauaccgaauaccagaagacgaaaaacaaugacugggacuacgucgugacaaccgauauuagcgagaugggcgccaacuucagagcugaccggguuaucgaucccagacgcugccugaagccugugauucugaaggacgggcccgaacgggucauccucgccggcccgaugccugugacaguugcgucugcugcccaaagacgcggacggauuggcagaaaucacaacaaagagggggaucaguauaucuacaugggacagccccugaauaacgacgaggaucaugcccacuggaccgaagcuaagaugcuucuggacaauaucaacacgcccgagggcauuaucccugcccucuuugaacccgagcgcgaaaaauccgcggccauugauggggaguaucggcugagaggagaggcucgcaagaccuucguggaacugaugagacggggcgaccucccugucuggcuuagcuacaaaguggccuccgagggguuucaguauucugaucgcagauggugcuucgacggcgaacggaauaaccaaguccuggaggaaaauauggauguggagaucuggacaaaggagggagaacgcaaaaagcugagaccgcgguggcucgacgcuagaaccuacagcgacccccuggcccuucgcgaguuuaaggaguucgcugccggccggagauccguuucuggggaucugauucucgagaucggaaaacugccucagcaccugacacagcgcgcgcagaacgcccucgacaaucuugugaugcugcauaacagcgaacaaggcgggcgggcuuauagacacgccauggaggagcugcccgauaccaucgaaacacucaugcugcuugcucugauugccgugcucaccggaggcgucacgcuguuuuuccuguccggccgggggcucggaaagacaagcaucggccuucuguguguuauggccucuuccgugcugcucuggauggcuagcguggagccucauuggauugcggccucuaucauucuggaauuuuuccuuaugguccugcucauccccgagccggaccgccagagaaccccucaggauaaucagcuggcuuacgugguuaucgggcugcucuuuaugauucuuaccguggccgccaacgagaugggacugcuggaaacaaccaaaaaggaccucggcaucgggcacgucgcuguggagaaccaccaucacgccgcgaugcuggaugucgaccuucaucccgccuccgcuuggacacuguacgccguggcuacgaccauuaucacaccuaugaugcggcacaccauugaaaauacaaccgccaacaucagccucacggcgauugccaaucaagcugccauccugaugggacuggauaaaggcuggcccaucucuaagauggacauuggcguuccucuccuugcucuggggugcuauagccaggugaacccccugacccucacagccgcuguccugaugcuuguggcccauuacgcgaucauuggaccgggccugcaggccaaggcuacccgcgaggcccagaagagaacagcugccgggaucaugaagaauccuaccguugauggaauuguggccaucgaccucgaucccgucguguaugacgcgaaauucgaaaagcagcugggccagaucaugcugcucauucuuuguacgucccagauccugcugaugcggacaaccugggcucucugcgagucuauuacacuggccaccgggccccuuaccacacugugggagggaagcccuggcaaauuuuggaacacgaccaucgcuguguccauggccaauauuuuccgcggcagcuaccucgccggggcuggacuggccuucucccugaugaagucucucggcgggggaagacggggcacaggggcgcaaggagaaacccuuggcgagaaguggaaacgccagcugaaccagcugagcaaguccgaauuuaauacauauaaaagaucuggcaucauggagguugaccggagcgaagccaaggaggggcucaaaagaggagagaccacgaagcacgcugucucccgcggcacagccaagcugcggugguucguggaaagaaaccuugugaaaccggaggggaaggucaucgaucugggauguggccgcgggggauggucuuacuauugcgcuggccucaaaaagguuaccgaagugaaaggcuacaccaaagggggacccggccacgaggaaccuauucccauggccacauacggguggaaucuggugaaacugcauagcggaaaggacgucuuuuucaucccucccgagaagugugauacccuccuuugcgacauuggcgaguccagcccuaacccgacaaucgaagaggggcggacgcugagagugcugaaaaugguugaacccuggcuccgcggaaaucaguuuuguauuaagauccugaacccuuauaugcccucuguggucgagacccuugagcaaaugcagcggaaacacggcggcaugcuggugagaaauccucucucccgcaacagcacacaugaaauguacuggguuucuugcgggaccggaaauauuguguccgcggucaacaugacaagccggaugcugcugaacagauucaccauggcccaccgcaagcccacguaugagcgggauguggaccucggcgcugggaccagacacguggccgucgaaccggagguugcuaaucuggauaucaucggacagcgcauugaaaacaucaaacaugagcacaagucuacauggcauuacgacgaggauaauccuuauaagaccugggccuaccacggcuccuaugaagugaaacccagcggguccgcuagcucuauggugaacggagucgugaaacuucugacaaaacccugggacguuauuccuauggugacccagaucgccaugacagauaccacgcccuuuggccaacagagagucuucaaggagaaaguggacacacggaccccuaaggcgaagcgcggcaccgcccagauuauggaaguuacagcuaaauggcucuggggguuucugagcagaaauaagaaaccgcggaucuguacgagagaggaguucacccggaaggugcgcuccaacgccgcuaucggagccgucuuuguggacgagaaucaauggaacucugccaaagaggcgguugaagaugagagauucugggaccuugugcaucgggaacgcgagcugcacaagcagggcaagugcgcuacaugcgucuacaauaugauggggaaaagagaaaagaaacucggagaguuuggcaaggccaaagggagccgggccauuugguacauguggcugggcgcucgcuuccuggaguucgaagcccucggauuuaugaacgaggaucacugguucuccagagaaaauucucugagcggcguggagggggagggacuucauaagcugggcuauauccuccgggacauuuccaaaauccccgggggaaacauguacgcugaugacaccgccggcugggauacacgcauuaccgaagacgaucugcagaaugaggcgaagaucacagacaucauggaaccugagcacgcccuucuggcuaagucuauuuuuaaacucaccuaucagaacaaggucgugagaguucaacggcccgccaaaaaugggacggugauggaugucaucagccgcagagaccagcggggcuccggacaggugggcaccuacgggcugaacacauucaccaacauggaagcucagcugauucgccaaauggagagcgagggaaucuuuucuccuuccgaacucgagacacccaaucuggccggcagagugcuugauuggcuggaaaagcaugggguugagcggcucaaaagaauggcgauuagcggagacgacuguguggucaagccgaucgaugaccgcuucgccaccgcucugacggcccuuaacgauaugggcaaggugcggaaagacaucccucagugggaacccucuaagggguggaaugauuggcagcagguuccuuuuugcucccaccacuuccaucaacugauuaugaaagacggcagagagaucgugguccccugucgcaaccaggaugagcucgugggacgggcuagagucagccagggcgccggguggucccugcgcgaaacagcuugccugggaaagucuuaugcccagauguggcaacucauguacuuucaccggagagaccugcgccuugcggccaaugcuauuuguagcgccgugccuguugauugggugcccaccucccggacaaccuggagcauccaugcccaccaucaguggaugacgaccgaggacaugcugucugucuggaacagaguguggauugaagagaauccguggauggaagauaaaacacacaucuccagcuggggcgacguuccuuaucucgggaagcgcgaggaccaguggugcggaucucugauuggccuuaccgcucgggccacaugggcgaccaacauccaaguggcuaucaaucaggucagacggcugauugggaacgagaauuaccucgauuacaugacaagcaugaagagauucaaaaacgaauccgaccccgagggcgcccugugguga

SEQ ID NO: 19260 - RNA, 9879 nt, Artificial Sequence
  derived and/or modified CDS sequence (opt5) from DENV-1__EU249490__SS-prME
agcgugaccaugcugcucaugcugaugcccaccgcccuugcuuuccaccugacgacccggggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcagaacauucgauaccgaauaccagaaaacgaagaacaacgacugggacuacgucgugacaaccgauaucagcgagaugggcgccaauuuucgggcugacagaguuauugauccccgccggugccuuaaaccugugauccugaaggacgggcccgaaagagucauucuggccggcccgaugccugugacaguugcgucugcugcccaacgccggggaagaaucggccgcaaccacaauaaggagggggaucaguauaucuacaugggacagccccucaacaaugacgaggaucaugcccacuggaccgaagcuaaaaugcugcuugacaacauuaauacgcccgagggcaucauuccugcccuguucgaacccgagcgggaaaaguccgcggccaucgauggggaguauagacuccgcggagaggcuagaaaaaccuuuguggaacugaugcggcgcggcgaccugccugucuggcucagcuacaagguggccuccgagggguuccaguauucugauagacgguggugcuuugacggcgaacgcaacaaucaaguccuugaggaaaacauggauguggagauuuggacaaaagagggagaaagaaagaaacugcggccgagauggcuggacgcucgcaccuacagcgacccccucgcccugcgggaguucaaggaauuugcugccggcagacgcuccguuucuggggaucuuauccuggagaucggaaagcucccucagcaccugacacagcgggcgcagaaugcccuggacaaccucgugaugcuucauaauagcgaacaaggcgggagagcuuaucggcacgccauggaggagcugcccgauaccauugaaacacugaugcuccuggcucuuaucgccgugcugaccggaggcgucacgcuguucuuucuguccggccgcgggcugggaaaaacaagcauuggccuccuuuguguuauggccucuuccgcucugcuguggauggcgagcguggagccucauuggaucgccgcuucuauuauccucgaguucuuucugauggugcuucugauccccgagccggacagacagcggaccccucaggauaaccagcucgccuacgucgugauugggcugcuguucaugauccucaccguugccgcuaaugagaugggacuucuggaaacaaccaagaaagaccugggcauugggcacguggccgucgagaaccaccaucacgcggccaugcucgauguggaccugcaucccgcuuccgccuggacacuuuacgcugucgccacgaccaucauuacaccuaugaugcgccacaccaucgaaaacacaaccgcgaauauuagccugacggccaucgcuaaccaagccgcuauccucaugggacuggauaagggcuggcccauuucuaaaauggacaucggcgugccucugcucgcccuugggugcuauagccagguuaauccccugacccugacagcugccgugcucaugcuggucgcgcauuacgccauuaucggaccgggccuucaggcuaaggccaccagagaggcucaaaagcggacagccgccgggauuaugaaaaacccuaccguggauggaaucguugcgaucgaccuggaucccguggucuaugacgcuaaguuugaaaaacagcucggccagauuaugcugcugauccucuguacgucccagauucuucugaugcgcacaaccugggcccugugcgagucuaucacacucgcuaccgggccccugaccacacuuugggagggaagcccuggcaaguucuggaauacgaccauugccguguccauggccaacaucuucagaggcagcuaccuggcuggggccggacucgcguuuucccugaugaaaucucugggcgggggacggcgcggcacaggggcccaaggagaaacccucggcgagaaguggaagagacagcuuaaucagcugagcaaauccgaguucaacacauauaagcggucuggcaucauggagguggacagaagcgaagcuaaagaggggcugaagcgcggagagaccacgaaacacgccguuucccggggcacagcuaagcucagaugguuugucgaacgcaaucuggugaagccggaggggaaagugauugaucuuggauguggcagagggggauggucuuacuauugcgccggccugaagaaagucaccgaaguuaagggcuacaccaaagggggacccggccacgaggaaccuauccccauggcgacauacggguggaaccucgugaagcugcauagcggaaaagacguguucuuuauuccucccgagaagugugauacccugcucugcgacaucggcgaguccagcccuaauccgacaauugaagaggggagaacgcuucgcguccugaagaugguggaacccuggcugcggggaaaccaguucuguaucaaaauucucaauccuuauaugcccucuguuguggagacccuggagcaaaugcagagaaagcacggcggcaugcuuguccgcaacccucugucccggaauagcacacaugaaauguacugggugucuugcgggaccggaaacaucguuuccgccgugaauaugacaagcagaaugcuccugaaccgcuuuaccauggcucaccggaaacccacguaugagagagaugucgaccugggcgccgggacccgccacguggcuguggaaccggaggucgccaaccucgauaucauuggacagagaaucgaaaauauuaagcaugagcacaaaucuacauggcauuacgacgaggauaacccuuauaagaccugggcuuaccacggcuccuaugaaguuaagcccagcggguccgccagcucuauggugaauggaguggucaaacugcuuacaaagcccugggacgugaucccuaugguuacccagauugcgaugacagauaccacgcccuucggccaacagcggguguuuaaagagaaggucgacacacgcaccccuaaagccaagagaggcaccgcucagaucauggaagugacagccaaguggcuguggggguuccucagccggaacaaaaagccgagaaucuguacgcgggaggaauuuacccgcaaaguuagauccaaugcugccauuggagccguguucgucgacgagaaccaauggaacucugcgaaggaggcuguggaagaugagcgguuuugggaccugguucaucgcgaaagagagcuucacaaacagggcaagugcgccacaugcguguacaacaugauggggaagcgggagaaaaagcugggagaguucggcaaagccaaggggagccgcgcuaucugguacauguggcucggcgccagauuccuggaguuugaagcucugggauucaugaaugaggaucacugguuuucccgggaaaacucucucagcggcgucgagggggagggacugcauaaacuuggcuauauucugcgcgacaucuccaagauucccgggggaaauauguacgccgaugacaccgcgggcugggauacaagaaucaccgaagacgaucuccagaacgaggccaaaaucacagacauuauggaaccugagcacgcucugcuugccaagucuaucuucaagcugaccuaucagaauaaagugguccgggugcaacgccccgcuaagaacgggacgguuauggaugugauuagcagacgggaccagcgcggcuccggacaggucggcaccuacgggcucaauacauuuaccaacauggaagcccagcugaucagacaaauggagagcgagggaauuuucucuccuuccgaacuggagacacccaaccucgcgggccgggugcuggauuggcuugaaaaacaugggguggagagacugaagcgcauggccaucagcggagacgacuguguugugaaaccgaucgaugaccgguuugcuaccgcccucacggcucugaaugauaugggcaaggucagaaaggacauuccucagugggaacccucuaaaggguggaacgauuggcaacaggugccuuucugcucccaccacuuucaucaacuuaucaugaaggacggccgcgagauuguugugcccugucggaaucaggaugagcuggucggcagagcccgcgugagccagggagcuggguggucccuccgggaaacagccugccugggaaaaucuuaugcgcagauguggcaacugauguacuuccacagacgcgaccuccggcuggccgcuaacgccaucuguagcgccgucccuguggauuggguucccaccuccagaacaaccuggagcauucaugcucaccaucaguggaugacgaccgaggacaugcuuucuguguggaaucgcgucuggaucgaagagaacccguggauggaagauaagacacacauuuccagcuggggcgacgugccuuaucuggggaaacgggaggaccaguggugcggaucucucaucggccugaccgccagagcgacaugggcuaccaauauccaaguugccauuaaccaggugcggagacuuaucgggaaugagaacuaccuggauuacaugacaagcaugaagcgcuuuaagaaugaauccgaccccgagggcgcccucugguga

SEQ ID NO: 19261 - RNA, 9879 nt, Artificial Sequence
  derived and/or modified CDS sequence (opt5) from DENV-1__EU249491__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggcuaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaagcucacagugguugugggagaugucgccggcauucuggggcagggcaagaagaugauccggccgcaacccauggaguacaaauauucuuggaaaagcuggggcaaggccaagauuaucggggcugacgcgcagaauaccaccuucaucauugauggaccuaacacacccgaauguccugacgaucagagagccuggaauaucugggagguggaggacuacggcuuuggcauuuucaccacgaacaucuggcugaaacuucgcgauuccuauacacaggugugcgaccaccggcucaugagcgcugccauuaaagauucuaaggccguccacgcugacaugggguacuggaucgaauccgagaaaaaugaaaccuggaagcuggccagagcgagcuuuaucgagguuaagacauguauuuggcccaaaucucauacccugugguccaacggagugcucgaaagcgagaugaucauuccgaagaucuauggcgggccuauuucucaacacaauuaccgccccggauacuucacacagaccgcuggcccuuggcaucuggggaaacuugagcuggauuucgaccucugcgaaggaacgaccguggucguggaugagcacugcggcaaccggggccccagccugagaacaaccacaguuaccgggaagaucauccacgaaugguguugccgguccuguacgcugccuccccuucgcuuuagaggagaggacggcugcugguaugggauggagauucggccggugaaagaaaaggaggaaaaucucgucaagagcauggugucugccggauccggcgagguugacagcuucucccuggggcugcucuguaucucuauuaugaucgaagaggugaugagaagccgcuggucccggaaaaugcugaugacaggaacccuugccgucuuuuuccugcucauuaugggccagcugacauggaacgaucugaucagacuuugcauuauggugggcgcuaaugccucugaccgcauggggaugggaaccaccuaccuggcgcucauggcuacauuuaagaugagaccuauguucgccguuggccugcucuuucggcgccugacgagcagagaggugcuucugcucaccaucgggcugucccuggucgccucuguggaacuucccaacagccuggaggaacucggagauggccuggcuauggggaucaugauucucaaacugcuuacagacuuccaaucccaucagcugugggccacccuccugagccugacauuuaucaagaccacguucucucuucacuaugcuuggaaaacaauggccauggugcuguccauugucagccucuuuccccugugucucucuaccaccucccagaagacaaccuggcugccuguucuucugggaagccugggcugcaagccgcucacaauguuccugaucgcggagaauaaaauuuggggccggaagucuuggccccuuaacgaagggaucauggccgugggaaucguguccauucugcucagcucccugcucaaaaacgaugucccucuggcuggcccccuuaucgccgggggaaugcugauugcuuguuacgugaucagcggcucuagcgccgaccugucccucgagaaggccgcugagguuucuugggaagaggaagcggagcauagcggggccucccacaauauucugguggaaguccaggaugacggaacgaugaaaaucaaggaugaggagcgcgacgauacccuuacaauccugcucaaagcuacccugcucgccgugucuggcguuuauccucugagcauucccgccacacuuuuugugugguacuucuggcaaaagaagaaacagagauccggcguccugugggacaccccuucucccccggaaguggagcgggcuguccuggaugacgggaucuaucgcauuaugcagagaggacuccugggccggagccagguggggguuggaguguuccaagaaaacgucuuucauacgauguggcacgugacccgcggcgccguucuuauguaccaggggaagagacuggagccuuccugggcgagcgugaaaaaggaccucaucucuuacggaggcggcuggcggcugagaggguccuggaauacaggagaggaaguccaggugauugcuguggagcccggcaaaaacccuaagaauguucagaccgcccccgggacauucaagaccccggaaggagaggucggcgccaucgcucucgauuuuaaaccugggacaagcggaucucccauugugaaccgcgaaggcaagaucgugggccuguaugggaauggagucgugacgaccuccggcacauacguuagcgccaucgcgcaagcuaaagccucccaggaggggccucuucccgagauugaagacgagguguuccggaagagaaaccugaccaucauggaucugcaccccggaucuggcaaaacccgccgguaucucccugccauugucagagaagcuaucaagcgcaagcugcggacacuuauucuggccccgacgagagugguugcuagcgagauggccgaagcgcucaaagggaugcccauccgcuaccagaccacagccgugaaguccgagcauaccggcaaagagaucgucgaccugaugugccacgcuacauuuaccaugcggcugcucagcccugugagaguucccaauuauaacaugauuaucauggaugaagcccauuucacggacccuucuuccauugcugcccggggauacaucagcacacgcgugggcaugggggaggccgcugcgauuuuuaugaccgccacacccccuggaucugucgaggcuuucccgcaaagcaaugccgugauccaggaugaggaaagagacauccccgagcgguccuggaacucuggcuaugaguggauuacagauuuuccugggaagaccgugugguucguccccagcaucaaauccggaaaugacauugccaacugucuucgcaagaauggcaagagaguuauccagcugucucggaaaacauuugauaccgaauaccagaagacgaaaaacaacgacugggacuacguggugacaaccgauauuagcgagaugggggcuaauuucagagccgaccgcgucaucgauccucggagaugccugaagcccgugauucucaaagacggcccggaacgcguuauccuggcgggaccuaugcccgugacagucgcuuccgccgcccaacggagaggccgcaucgggcggaaccacaauaaggagggagaucaguauauuuacaugggccagccccuuaacaaugacgaggaucaugcucacuggaccgaagccaagaugcugcucgacaacaucaauacgccugaggggauuauccccgcgcuguucgaaccugagagagaaaagagcgccgcuguggauggagaguaucgccugagaggcgaggcccggaagaccuuuguugagcucaugcgcagaggggaccuuccgguguggcugucuuacaaagucgcuuccgagggcuuccaguauagcgaucggcgcuggugcuuugacggagaaagaaacaaucaagugcuggaggaaaacauggaugucgagauuuggacaaaggagggcgaacggaaaaagcucagaccccgcuggcuggacgcccggaccuacuccgacccucuugcucugagagaguucaaagaauuugccgcggggcgccggucugugagcggagaucucauccuggagaucggcaagcugccccagcaccucacacagagagcccagaaugcucuugacaaccugguuaugcugcauaauuccgaacaagggggacgggccuaucgccacgcuauggaggagcucccugauaccauugaaacacugaugcuucuggcccucaucgccgugcugaccggcggcgugacgcuguucuuucucucugggagaggacuuggcaagacaagcauugggcugcugugugucauggcuuccagcguucuccuguggauggcgucuguggagccccauuggaucgccgcuuccauuauccuugaguucuuucugauggugcuccugaucccggagccugaccggcagcgcacaccccaggauaaccagcuggccuacgucgugauuggacuccuuuucaugauccugaccguugccgcuaaugagaugggccugcucgaaacaaccaaaaaggaccuggggauuggacacguggccgucgagaaccaccaucacgcggccaugcuugauguggaccugcauccugcuagcgccuggacacucuacgcugucgccacgaccaucauuacacccaugaugagacacaccaucgaaaacacaaccgcgaauauuucucugacggccaucgcuaaccaagccgcuauccugaugggccucgauaaaggcuggccuauuuccaagauggacaucggggugccccuucuggcccugggaugcuauagccagguuaauccgcucacccugacagcugccgugcuuaugcuggucgcgcauuacgccauuaucggcccugggcuccaggcuaaagccacccgggaggcucaaaagcgcacagccgccggaauuaugaagaaccccaccguggauggcaucguugcgaucgaccuggaucccguggucuaugacgcuaaauuugaaaagcagcuggggcagauuaugcuccuuauccuguguacgucucagauucugcucaugagaacaaccugggcccugugcgagagcaucacacuugcuaccggaccucugaccacacucugggagggcuccccgggcaaauucuggaauacgaccauugccgugucuauggccaacaucuuucgggggagcuaccuggcuggagccggccuggcguucucccucaugaaaagccuugggggaggccgcagagggacaggagcccaaggcgaaacccugggcgagaaauggaagcggcagcugaaucagcucuccaagucugaguucaacacauauaaaagaagcgggaucauggagguggaccgcuccgaagcuaaggagggacugaaacggggcgagaccacgaagcacgccguuucuagagggacagcuaaacuucgcugguuugucgaacggaaucuggugaagcccgagggaaaggugauugaucucggcugugggagaggaggcuggagcuacuauugcgccggccugaaaaaggucaccgaaguuaaaggguacaccaagggaggcccugggcacgaggaacccaucccuauggcgacauacggauggaaccuggugaaacuccauuccggcaaggacguguucuuuauucccccugagaaaugugauacccuucugugcgacaucggggagucuagcccgaaucccacaauugaagagggacgcacgcugcggguccucaagaugguggaaccuuggcugagaggcaaccaguucuguaucaagauucuuaaucccuauaugccuuccguuguggagacccuggagcaaaugcagcgcaaacacggcgggaugcucguccggaacccccugagcagaaauucuacacaugaaauguacuggguguccugcggaaccggcaacaucguuagcgccgugaauaugacaucucgcaugcugcucaaccgguuuaccauggcucacagaaagccgacguaugagcgcgaugucgaccuggggaccggaacaagacacguggccguggaaccugaggucgcuaaccuugauaucauuggccagcggaucgaaaauauuaaacaugagcacaaguccaccuggcauuacgacgaggauaaccccuauaaaacaugggccuaccacgggagcuaugaaguuaagcccucuggauccgcuagcuccauggugaauggcguggucaagcugcucaccaaaccuugggacgugauccccaugguuacacagauugccaugaccgauacgacaccuuucggccaacagcgcguguuuaaggagaaagucgacaccagaaccccgaaggcgaaacgggggacagcccagaucauggaagugacggcuagauggcuguggggauuccuuagccggaacaagaagccccgcaucuguaccagagaggaauuuacacggaaaguucgcucuaaugccgcuauuggcgccguguucgucgacgagaaccaauggaauagcgccaaggaggcgguggaagaugagagauuuugggaccugguucaucgggaacgcgagcuccacaaacaggggaagugcgcuaccugcguguacaacaugaugggaaaaagagaaaagaagcugggcgaguucgggaaagccaagggcucccgggccaucugguacauguggcugggagcucgcuuucucgaguucgaagcccugggcuucaugaaugaggaucacugguuuucuagagaaaacagccuuuccggggucgagggagagggccugcauaaacucggguauauucugcgggacaucucuaagauuccuggaggcaauauguacgcugaugacacagccgggugggauacccgcaucacagaagacgaucuucagaacgaggcgaaaaucaccgacauuauggaacccgagcacgcccugcucgcuaaggccaucuucaaacugacguaucagaauaagguggucagagugcaacggccugcuaagaacggcaccguuauggaugugauuagccgcagagaccagcggggauccggccaggucgggacauacggacugaauaccuuuacaaacauggaagcccagcucaucagacaaauggagucugagggcauuuucagccccuccgaacuggagaccccgaaccuugcggaacgcgcccuggauuggcucgagaaauaugggguggaacggcugaagagaauggcuaucagcggagacgacugugugguuaaaccuaucgaugaccgcuuugccacggcucuuacagcccugaaugauaugggcaaggugcggaaagacauuccccagugggagccuucuaagggguggaacgauuggcagcagguccccuucugcucccaucacuuucaccaacucaucaugaaggacggcagagagauugugguuccuugucgcaaucaggaugaacuggugggacgggcuagagucagccagggcgccggguggucucugcgcgagaccgcgugccucggaaaauccuacgcccagauguggcaacugauguauuuccaucggagagaccuucgccuggcugccaacgccaucuguagcgcugugcccgucgauugggugccgacaucccggaccacguggucuauucacgcccaucaccaguggaugaccacagaagacaugcucagcguuuggaauagaguguggaucgaggaaaacccuuggauggaggauaagacccauauuuccagcugggaggacguccccuaccugggcaaacgggaagaccaguggugcgggucucuuaucggacugacagcgagagcuaccugggccacaaauauccaaguggccauuaaccagguucgccggcucaucggcaaugagaacuaccuggauuauaugaccuccaugaagagauuuaaaaaugaaagcgaccccgagggggcucugugguga

SEQ ID NO: 19262 - RNA, 9879 nt, Artificial Sequence
  derived and/or modified CDS sequence (opt5) from DENV-1__EU249492__SS-prME
agcgugacaaugcugcugaugcugaugcccacagcccuugcuuuccaccugacgacccggggaggggagccucauaugaucgucuccaagcaggaacgggggaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagaugugcgaccaccggcuuaugucugccgcuauuaaagauuccaaggccguucacgccgacaugggcuacuggaucgaaagcgagaaaaaugaaacauggaagcucgcuagagccucuuucaucgaggugaagaccuguauuuggcccaaaucccauacacuguggagcaacggggugcuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggucgugguugaugagcacugcggaaaccggggccccucccucagaaccacaaccgugacaggcaagaucauccacgaaugguguugccggagcuguacccugccuccccugcgcuucaaaggggaggacggaugcugguauggcauggagauuagaccggucaaggaaaaggaggaaaaucuugugaaaucuaugguuuccgcugggagcggagagguggacuccuuuucucucggccugcuguguaucagcauuaugaucgaagaggucaugcgguccagauggucucgcaagaugcucaugacggggacacuggccguguucuuucuucugauuaugggacagcucaccuggaacgaucugauccggcugugcauuaugguuggcgccaaugcuagcgacagaaugggcauggggacaaccuaccuugcccugauggcgaccuucaaaaugcgcccuauguuugcugugggacuccuguucagacggcucacaucccgcgagguccugcuucugacgaucggccucucucugguggccagcguggaacugcccaacucccuugaggaacugggggauggacucgccaugggcaucaugauucugaagcuccugaccgacuuucaaagccaucagcuuugggcuacacugcucucuaugaccuucaucagaacaaccuuuucccugcacuaugccuggaaaacgauggcuaugguccugagcauuguuucucuuuucccccugugucucuccacaaccagccagaagaccacauggcugccugugcuccuggggucucuuggaugcaagccgcugaccauguuucugaucgccgagaauaaaauuuggggccggaaguccuggccccucaacgaaggcaucauggcgguggggaucgucagcauucugcuuuccagccugcucaaaaacgaugugccucuggccggaccccucaucgcuggcgggaugcugauugccuguuacguuaucucuggaagcuccgcugaccuuucucuggagaaggccgccgaggugagcugggaagaggaagcugagcauuccggcgcgucucacaauauucuggucgaagugcaggaugacgggacaaugaaaaucaaggaugaggagcgcgacgauacgcucaccauccugcuuaaagccacacugcucgcuguuagcggaguguauccucuguccauucccgccacccucuucgucugguacuucuggcaaaagaagaaacagagaucuggcgugcugugggacacaccuuccccucccgaaguccagcgggccgugcuugaugacggcaucuaucgcauuaugcagagagggcugcugggacggucccaaguuggcgugggggucuuucaggagaacguguuccauaccauguggcacguuacgcgcggagcugugcucauguaccagggcaagagacuggaacccagcugggccucugucaaaaaggaccuuaucuccuacgggggaggcuggcggcugcagggcagcuggaauaccggggaggaggugcaagugauugcgguugaacccggcaagaacccuaagaauguccagacagcucccggcaccuuuaagacaucugagggggaagugggagccaucgcccucgauuucaaaccgggcaccuccgggagcccuauugugaacagagagggaaagaucgucggccuguauggcaauggggugguuacaacguccggaaccuacgugucugcuaucgcccaggcgaaagcuagccaagaaggcccccucccugagauugaggacgaagucuuucgcaagcggaaccugacaaucauggaucuucaccccggguccggaaaaaccagacgcuaucugcccgccauugugcgggaggccaucaagagaaagcugcgcacccucauucuggcuccuacacggguuguggccagcgaaauggcugaggcccuuaaaggcaugccgaucagauaccagacgaccgcggucaagucugaacauacagggaaagagaucguggaccugaugugccacgccaccuucacaaugcgccuccugucccccguucgggugccuaauuauaacaugauuaucauggaugaggcucauuuuaccgaccccagcucuauugccgcuagaggcuacaucagcacgcgggucggaaugggcgaagccgccgcuauuuucaugacagcgaccccucccggguccguggaggccuuuccucagucuaaugcugugauccaggaugaagaaagagacaucccggaaagaagcuggaacuccggauaugaguggauuaccgauuuccccggcaagacagucugguuuguuccuucuaucaaaagcgggaaugacauugccaacugucugcggaagaauggaaagcgcgugauccaacucuccagaaaaaccuucgauacagaguaccagaagaccaaaaacaacgacugggacuacguggucacgacagauauuagcgaaaugggcgccaauuuccgggcugacagagugaucgauccccgccggugccuuaagccuguuauucugaaagacgggcccgagagagugauccuggccggcccgaugccugucaccguggcgucugcugcccagcgccggggaagaaucggccgcaaccacaauaaggaaggggaucaguauauuuacaugggacaaccccucaacaaugacgaggaucaugcccacuggacagaggcuaagaugcugcuugacaacaucaauacccccgaaggcauuaucccugcccuguuugagcccgaacgggagaaauccgcggccauugauggggaauauagacuccgcggagaggcuagaaagacguucguugagcugaugcggcgcggcgaccugccuguguggcucagcuacaaagucgccuccgaaggguuucaguauucugauagacgguggugcuucgacggcgagcgcaacaaucaggugcuugaagagaacauggaugucgaaaucuggaccaaggagggagagcgcaagaagcugcggccgagauggcuggacgcucgcacauacagcgacccccucgcccugcgggaauuuaaagaguucgcugccggcagacgcuccgugucuggggaucuuauccuggaaauuggaaagcucccucagcaccugacccaacgggcgcagaaugcccuggacaaccucguuaugcuucauaauagcgagcagggcgggagagcuuaucggcacgccauggaggaacugcccgauacaaucgagacccugaugcuccuggcucuuauugccgugcugacaggaggcgugacccucuuuuuccuguccggccgcgggcugggaaagacgagcaucggccuccuuugugucauggccucuuccguucugcuguggauggcuagcguggaaccucauuggauugcggccucuaucauccucgaguuuuuccugauggugcuucugauucccgaaccggacagacagcggacaccucaagauaaccagcucgcuuacgucgugaucgggcugcuguuuaugauucucaccguugccgccaaugagaugggacuucuggagaccaccaaaaaggaccugggcaucgggcacguggcugucgaaaaccaccaucacgccgcgaugcucgauguggaccugcaucccgccuccgcuuggacccuuuacgccgucgcuacaacgauuaucaccccuaugaugcgccacacaauugagaacaccacagccaauaucagccugaccgcgaucgccaaccaggcugccauucucaugggacuggauaaaggcuggcccaucucuaagauggacauuggcgugccucugcucgcucuugggugcuauagccaaguuaauccccugacgcugaccgccgcugugcucaugcuggucgcccauuacgcgaucauuggaccgggccuucaggccaaagcuacaagagaagcccagaagcggaccgcugccgggaucaugaagaacccuacaguggauggaaucguugccauugaccuggaucccguggucuaugacgcgaaauucgagaagcagcucggccaaaucaugcugcugauucucuguaccucccagauccuucugaugcgcacgacaugggcucugugcgaaucuauuacccucgccacagggccccugaccacccuuugggagggaagcccuggcaaauuuuggaauacaacgaucgcuguguccauggccaacaucuucagaggcagcuaccuggccggggcuggacucgccuucucccugaugaagucucugggcgggagccggcgcggaaccggcgcgcagggggagacacucggagaaaaauggaagagacagcuuaaucaacuguccaagucugaguuuaacaccuauaaacggagcggcauuauggaaguggacagauccgaggccaaggaaggccugaaacgcggggagacaaccaagcacgcuguuucucggggaacggccaaacucagaugguucgucgagcgcaaucuggugaagccggaaggcaaggugaucgaucuuggguguggacggggcggguggagcuacuauugcgcuggacugaaaaaggucacagagguuaaaggcuacaccaagggcgggcccggacacgaggagccuauucccauggccaccuacggcuggaaccucgugaaacugcauuccgggaaggacguguuuuucaucccucccgaaaaaugugauacacugcucugcgacauuggagagagcucuccuaauccgaccaucgaggaaggcagaacacuucgcguccugaagaugguggagcccuggcugcgggggaaccaguuuuguauuaagauccucaauccuuauaugcccuccguuguggaaacgcuggagcagaugcagagaaaacacggaggcaugcuuguccgcaacccucugagcagaaauucuacccaugagauguacuggguguccugcggcacagggaacaucguuagcgcggugaauaugaccucuagaaugcuccugaaccgcuucacaauggcccaccggaagcccaccuaugaaagagaugucgaccugggagcuggcacgcgccacguggccguggagccggaagucgcuaaccucgauauuaucgggcaaagaauugagaauaucaaacaugaacacaaguccaccuggcauuacgacgaggauaacccuuauaaaacaugggccuaccacggaagcuaugagguuaagcccuccggcagcgcuucuagcauggugaaugggguggucaagcugcuuaccaaacccugggacgugauuccuaugguuacacagaucgccaugaccgauacaacccccuuuggacagcaacggguguucaaggaaaaagucgacacgcgcacaccuaaggcgaaaagaggcaccgcccagaucauggaggugaccgcuaaguggcuguggggcuuucucucccggaacaagaaaccgagaauuuguacacgggaagaguucacgcgcaagguuagaucuaaugccgcuaucggggccguguuugucgacgaaaaccaguggaauagcgccaaagaggcgguggaggaugaacgguucugggaccugguucaucgcgagagagaacuucacaagcagggaaaaugcgcuaccugcguguacaacaugaugggcaagcgggagaagaaacugggggaauuuggaaaggccaaaggcucccgcgccauuugguacauguggcucggggcuagauuccuggaguucgaggcccugggcuuuaugaaugaagaucacugguucucucgggagaacagccucuccggagucgaaggcgaggggcugcauaaacuuggauauauccugcgcgacauuucuaaaauccccggcgggaauauguacgcugaugacacagccggaugggauaccagaaucacagaggacgaucuccaaaacgaagcgaagauuaccgacaucauggagccugaacacgcccugcuugcuaaaagcauuuuuaagcugacauaucagaauaaggugguccgggugcagcgccccgccaaaaacggcaccguuauggaugugaucuccagacgggaccagcgcgggagcggccaagucggaacguacggccucaauaccuucacaaacauggaggcucagcugauuagacagauggaaucugaggggaucuuuuccccuagcgagcuggauacccccaaccucgccggacgggugcuggacuggcuugaaaagcauggcguggagagacugaaacgcauggcgaucucuggggacgauuguguugugaagccgauugacgaucgguucgccacagcucucaccgcccugaaugacaugggaaaagucagaaaggauaucccucagugggaacccuccaagggcuggaacgacuggcaacaggugccuuuuugcagccaccacuuccaucagcuuauuaugaaagaugggcgcgagaucguugugcccugucggaaucaggacgaacuggucggcagagcucgcgugucccaaggagccggcuggucucuccgggagacggcuugccugggaaagagcuaugcccagauguggcagcugauguacuuucacagacgcgaucuccggcuggcggccaacgcuauuuguuccgccgucccuguggacuggguucccacaagcagaaccacauggucuauccaugcccaccaucaauggaugaccacggaggauaugcuuuccguguggaaucgcgucuggauugaagagaacccguggauggaagacaaaacccacaucagcucuuggggagacgugccuuaucugggcaagcgggaggaucaguggugcgggagccucaucggacugacagcuagagccaccugggcgacaaauauucagguugcuaucaaccaggugcggagacuucugggcaaugaaaacuaccucgacuacaugaccuccaugaaacgcuucaagaaugagucugggcccgagggcgcccugugguga

SEQ ID NO: 19263 - RNA, 9879 nt, Artificial Sequence
  derived and/or modified CDS sequence (opt5) from DENV-1__EU249493__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacaccgccggcugggauacacgcaucaccgaagacgaucuccagaacgaggcgaagaucacagacauuauggaaccugagcacgcccugcuugcuaagucuaucuucaaacugaccuaucagaauaaggucgugagaguucaacggcccgccaaaaacgggacggugauggaugucauuagccgcagagaccagcggggcuccggacaggugggcaccuacgggcucaauacauuuaccaacauggaagcucagcugauccgccaaauggagagcgagggaauuuucucuccuuccgaacuggagacacccaaccucgccggcagagugcuggauuggcuugaaaagcaugggguugagcggcugaaaagaauggcgaucagcggagacgacuguguggucaagccgaucgaugaccgcuuugccaccgcucucacggcccugaaugauaugggcaaggugcggaaagacauuccucagugggaacccucuaagggguggaacgauuggcagcagguuccuuucugcucccaccacuuucaucaacuuaucaugaaagacggcagagagauugugguccccugucgcaaucaggaugagcuggugggacgggcuagagucagccagggcgccggguggucccuccgcgacacagcuugccugggaaagucuuaugcccagauguggcaacugauguacuuccaccggagagaucuccgccuggcggccaacgcuaucuguagcgccgugccuguugacugggugcccaccucccggacaaccuggagcauucaugcccaccaucaguggaugacgaccgaagauaugcuuucugucuggaauagaguguggaucgaggaaaacccguggauggaggacaaaacacacauuuccagcuggggcgacguuccuuaucuggggaagcgcgaagaucaguggugcggaucucucaucggccugaccgcucgggccacaugggcgaccaauauccaaguggcuauuaaccaggucagacggcuuaucgggaaugagaacuaccuggacuacaugacaagcaugaagagauuuaaaaaugaguccgaucccgaaggcgcccucugguga

SEQ ID NO: 19264 - RNA, 9879 nt, Artificial Sequence
  derived and/or modified CDS sequence (opt5) from DENV-1__EU249494__SS-prME
agcgugaccaugcugcucaugcugaugcccaccgcccuugcuuuccaccugacgacccggggcggggaaccucauaugauugucaccaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggcuauggugcaggccgauuccggaugcgucauuaacuggaaaggccgcgaacugaagugugggagcggaaucuucgugaccaaugagguucacacauggaccgaacaauauaaguuucaggcggacuccccuaaacggcugucugccgcuauuggcaaggccugggaggagggggugugcggcaucagaagcgcuacgcgccucgaaaacaucauguggaaacagauuuccaacgagcugaaucauauccuucuggaaaacgacaugaaguucacagucgugguuggagauguggucggcauucucgcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggagguggaggacuauggauucggcauuuuuaccacgaacaucuggcugaagcugcgcgauuccuacacacaggucugcgaccaccggcuuaugagcgccgcuauuaaagauucuaaggccguucaugccgacaugggcuauuggaucgaauccgagaaaaaugaaaccuggaagcucgcuagagccagcuucaucgaggugaagacauguauuuggcccaaaucucacacccugugguccaacggggugcuggaaagcgagaugaucauuccgaagaucuacggaggcccuauuucucaacauaauuaucgccccggguacuucacacagaccgcgggaccuuggcaccucggcaaacuggagcuugauuuugaccugugcgaagggacgaccgucgugguugaugagcacugcggaaaccggggccccagccucagaacaaccacagugaccggcaagaucauccaugaaugguguugccgguccuguacgcugccuccccugcgcuucaaaggggaggacggaugcugguacggcauggagauuagaccggucaaggaaaaggaggaaaaucuugugaaaagcaugguuucugcuggguccggagagguggacagcuuuucccucggccugcuguguaucucuauuaugaucgaagaggucaugcggagcagauggucccgcaagaugcucaugacagggacccuggccguguuccuucugcucauuaugggacagcugacauggaacgaucugauccggcuuugcauuaugguuggcgccaaugcuucugacagaaugggcauggggaccaccuaucuggcccucauggcgacauuuaaaaugcgcccuauguucgcugugggacugcucuuuagacggcugacgagccgcgagguccuucugcucaccaucggccugucccugguggccucuguggaacuucccaacagccuggaggaacucggggauggacuggccaugggcaucaugauucucaagcugcuuacagacuuccaaucccaccagcugugggcuacccuccugagccugacauuuaucaaaaccacgcuuucucugcauuacgccuggaagacaauggcuaugguccucuccauuguuagccuguucccccucugucugucuaccaccucccagaagacaaccuggcuuccugugcugcuggggagccucggaugcaaaccgcugacaauguuucuuaucgccgagaauaagauuuggggcagaaaaucuuggccccugaacgaaggcaucauggcggugggggucguguccauccuccugagcucccuccugaagaacgauguuccucuugccggaccccugauugcuggcgggaugcugaucgccuguuaugugauuagcggaucuagcgcugaccucucccuggagaaagccgccgaggucucuugggaagaggaagcugagcacagcggcgcgucccauaauauccuuguggaaguucaggaugacgggacgaugaagauuaaagaugaggagcgggacgauacccugacaauccuccugaaggccacccuccuggcugugucuggagucuacccucuuagcauccccgccacacuguucgugugguauuuuuggcaaaagaaaaagcagcgcuccggcguccugugggacaccccuucucccccggaaguggagagagccguucucgaugacggcauuuaccggaucaugcagcgcgggcugcuuggaagaagccaggugggcgucgggguguuccaagaaaacguuuuccacacgauguggcacgugacccggggagcuguccugauguaucagggcaaacgccucgagccuuccugggccagcgugaagaaagaccugauuucuuacgggggaggcuggagacuccagggcuccuggaauacaggggaggaagugcagguuaucgcggucgagcccggaaagaacccuaagaaugugcaaaccgcucccggcacauuuaaaaccccggaaggggaggugggagccauugcccuggauuucaagccuggcacaagcgggucucccaucgucaaccgggaaggaaaaauugugggccuuuacggcaaugggguugugacgaccuccggaacauaugucagcgcuaucgcccaggcgaaggcuucccaggagggcccucugcccgagaucgaagacgagguguuuagaaaacgcaaccugaccauuauggaucuccaucccgggucuggaaagacccggagauaccugccugccaucguucgcgaagccauuaagcggaaacuuagaacacugauccucgcuccgacgcgcguggucgccagcgagauggcugaagcccugaagggcaugcccauucgguaucaaaccacagcggugaaauccgagcacaccgggaaggagaucguugaccugaugugccaugccacauucaccaugagacuccuuagcccugugcgcguccccaauuacaacaugaucauuauggaugaagcucacuuuacggacccuucuuccaucgccgcucggggcuauauuagcacaagagugggaaugggcgaggccgccgcuaucuucaugaccgcgacacccccugggucuguggaagccuuuccgcagagcaaugcugucauucaggaugaggaacgggacauccccgagcgcuccuggaacucuggauacgaguggaucacagauuucccuggcaaaaccguuugguuugugcccagcauuaaguccgggaaugacaucgccaacugucugagaaagaauggaaaacgggugauucagcugucucgcaagacauucgauaccgaauaucagaagacgaagaacaacgacugggacuacgucgugacaaccgauaucagcgagaugggcgccaauuuuagagcugaccggguuauugauccuagacgcugccucaaacccgugauccugaaggacgggccggaacgggucauucuugccggcccuaugcccgugacaguugcguccgcugcccagagacgcggacggaucggcagaaaccauaauaaggagggggaucaguacaucuauaugggacagccccugaacaaugacgaggaucacgcccacuggaccgaagcuaaaaugcuccuggacaacauuaauacgccugagggcaucauucccgcccuguucgaaccugagcgcgaaaagagcgcggccaucgauggggaguaccggcucagaggagaggcucgcaaaaccuucguggaacuuaugagacggggcgaccugccggucuggcugucuuauaagguggccuccgagggguuucaauacagcgaucgcagauggugcuucgacggcgaacggaacaaucagguccucgaggaaaacauggauguggagauuuggacaaaagagggagaacgcaagaaacugagaccccgguggcuugacgcuagaaccuauuccgacccucuggcccuccgcgaguuuaaggaguucgcugccggccggagaucuguuagcggggaucugauccuggagaucggaaagcucccccagcaucuuacacagcgcgcgcaaaaugcccuggacaaccuggugaugcuccacaauuccgaacagggcgggcgggcuuacagacaugccauggaggagcugccugauaccauugaaacacuuaugcugcucgcucugaucgccgugcugaccggaggcgucacgcucuuuuuccuuucuggccgggggcugggaaaaacaagcauuggccugcucuguguuauggccuccagcgugcugcuuuggauggcuucuguggagccccacuggaucgcggccuccauuauccuggaauuuuuccucaugguccugcugaucccggagccugaccgccagagaacaccccaggauaaccaacucgcuuaugugguuauugggcuucuguuuaugauccugaccguggccgccaaugagaugggacuccuggaaacaaccaagaaagaccuuggcauugggcacgucgcuguggagaaccaucaccaugccacaaugcuggaugucgaccuccacccugcgagcgccuggacgcuguacgcuguggccaccacaaucauuacccccaugaugcggcauacaaucgaaaacaccacggcuaauauuucucugaccgccaucgcgaaccaggccgcuauccucaugggacuugauaagggcuggccuauuuccaaaauggacaucggcguuccccugcuggcccucgggugcuacagccaggugaauccgcugacacuuaccgcugccguccugaugcucguggcucacuaugccauuaucggaccuggccugcaagcgaaggccacacgcgaggcucagaagagaaccgccgcugggauuaugaaaaaccccacgguugauggaaucguggccaucgaccuggaucccgucguguacgacgccaaguucgaaaaacagcucggccagauuaugcuucugauccuguguacaucucaaauucuccugaugcggaccacaugggcgcuuugcgagagcaucacccuggcuaccgggccucucacaacgcugugggagggauccccgggcaaguuuuggaauaccacaauugccgugucuauggcuaacaucuuccgcggcagcuaucuggccggggccggacucgcuuuuucccuuaugaaaagccugggcgggggaagacggggcaccggggcccagggagaaacacugggcgagaaguggaagcgccagcucaaucagcuguccaaaucugaguucaacaucuacaagagaagcggcauuauggagguugaccgguccgaagcgaaagaggggcuuaagagaggagagaccacgcgccacgccgucucucggggcacagcuaaacugagaugguucguggaacgcaaucucgugaagcccgaggggaaggucaucgaucugggauguggcagagggggauggagcuauuacugcgccggccugaaaaagguuaccgaagugaaaggcuauaccaaagggggaccuggccaugaggaacccauuccuauggcuacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagaugguugaaccuuggcuucggggaaaccaauuuuguaucaagauucugaaucccuacaugccuuccguggucgagacacucgagcagaugcagagaaaacauggcggcaugcuggugcgcaacccccugagcagaaauucuacccacgaaauguauuggguuuccugcgggacaggaaacaucgugagcgccgucaauaugaccucuagaaugcuccugaaccgcuucacgauggcgcaccggaagccgaccuacgagagagauguggaccuuggcgccgggacacgccauguggcugucgaaccugagguugccaaccuggauaucauuggacagagaaucgaaaauauuaaacacgagcauaaguccaccuggcacuaugacgaggauaaccccuacaaaacaugggcuuaucauggcagcuacgaagugaagcccucuggguccgccagcuccauggugaauggagucgugaagcuccugaccaaaccuugggacguuauccccauggugacacaaauugcuaugaccgauacgacaccuuuuggccagcagcgggucuucaaggagaaaguggacacccgcaccccgaaggccaaaagaggcacagcgcaaaucauggaaguuacggcccgguggcuuuggggguuucugagcagaaacaagaagccccggaucuguacccgcgaggaguucacaagaaaagugcggucuaaugcugccauuggagcugucuuuguggacgagaaccaguggaauagcgccaaggaggccguugaagaugagcgcuucugggaccucgugcagaaagaaagagagcugcacaagcagggcaaaugcgcgaccugcgucuauaacaugauggggaagcgggaaaagaaacugggagaguuuggcaaggcuaaagggucccgcgccaucugguacauguggcucggcgccagauuccuggaguuugaagcucuuggauucaugaaugaggaucacugguucucucgggaaaacagccuguccggcguggagggggagggacuccauaagcugggcuacauucuucgcgacaucucuaaaauuccugggggaaauauguaugccgaugacacagcuggcugggauaccagaaucacagaagacgaucugcaaaacgaggccaagaucaccgacauuauggaacccgagcacgcgcuccuggccacgagcaucuuuaaacugaccuaccagaauaaggucgugcggguucagcgcccugcuaagaacgggacagugauggaugucauuuccagacgggaccagcgcggcucuggacaagugggcaccuaugggcucaauacauucaccaacauggaagcccagcugaucagacagauggagagcgagggaaucuuuucccccagcgaacuugagaucccgaaccuggcugaacgggugcucgauuggcuggagaaauacggcguugaaagacuuaagcgcauggccaucucuggggacgacuguguggucaaaccuauugaugaccgguucgcgacggcccugacagcucucaaugauaugggaaaggugagaaaagacguuccccagugggagccuuccaagggcuggaacgauuggcaacaggugcccuuuugcagccaucacuuccaccagcugaucaugaaggacgggcgcgagauugucgugccuugucggaaucaggaugaacuggucggcagagcccgcgugucucaaggagcuggcuggucccuccgggagaccgccugccuggggaaaagcuaugcucagauguggcagcuuauguacuuucauagacgcgaccugcggcucgccgcgaacgccaucuguuccgcuguucccguggauugggucccgacaucuagaaccacguggagcauucacgcccaucaccaauggaugaccacagaagacaugcuguccguguggaaucgcguuuggaucgaggaaaacccuuggauggaggauaagacccaugugagcucuuggggagacguccccuaucuuggcaaacgggaggaccaguggugcgggucccugauuggacucacagccagagcuaccugggccagcaauauccagguggcgaucaaccaggugcggagacugauuggcaaugaaaacuaccuggauuguaugacaucuaugaagcgcuucaaaaaugagggggaccccgaaggcgcucucugguga

SEQ ID NO: 19265 - RNA, 9879 nt, Artificial Sequence
  derived and/or modified CDS sequence (opt5) from DENV-1__EU249495__SS-prME
uccgugaccaugcugcucaugcugaugcccaccgcccuugcuuuccaccugacgaccagaggcggggaaccucauaugaucgucaccaagcaggaacggggaaaaucccuccuguuuaagaccacagccggcguuaauaugugcacccuuauugccauggaccugggggaacucugugaagauaccaugaccuacaaaugcccgcgcaucacggaggcugaacccgacgauguggacuguuggugcaaugccaccgauacaugggugaccuauggaacauguucucaaaccggcgagcaccggcgggacaagcgcagcguugcccuggcuccucauguggggcugggacucgagacgagaacagaaaccuggauguccucugagggcgccuggaaacagauucagcggguugaaacaugggcucugcgccaccccggcuucaccgugaucgcccuuuuucuggcgcaugccauugggaccagcaucacacagaagggaaucauuuucauccuccugaugcuugucacgccuuccauggcuaugagaugcgugggcauugggucucgggauuuuguugagggacugagcggcgccaccuggguggacgucgugcucgagcacggguccugugugacaaccauggcuaaggauaaacccacacuggacaucgaacugcucaagaccgaggucacgaacccugccguucugcgcaaacuuugcauugaagcgaagaucagcaauacaaccaccgauucuagauguccgacacaaggagaggccacccugauggaagaacaagacgcuaacuucgugugccggcgcacauuuguggauagaggcuggggcaauggguguggacucuucggcaaagggucccugauuacgugcgccaaguuuaagugcgucaccaaacuugagggaaagaucgugcaguacgaaaaccugaaauauagcguuaucgugacaguccacaccggcgaccagcaucaaguggggaaugagucuacagaacacggaaccacggcuaccauuacaccccaggccccuaccuccgagauccagcucacagacuacggcgcccugacccuggauuguagcccccggacgggccucgacuucaacgaaaugguucugcuuacaaugaaggagaaaucuuggcuggugcauaagcagugguuucucgaucugccucuucccuggaccuccggggcuagcacaucccaagagaccuggaaucgccaggaccugcucgucaccuucaaaacagcgcacgccaagaagcaggaaguggucgugcugggaucucaagagggcgcuaugcacacggcccugaccggggccacagaaauucagaccagcggaacaaccacgaucuuugcuggccaucucaaaugcagacugaagauggauaaacuuacacugaaggggauguccuauguuauguguaccggcagcuucaaacucgagaaggaaguggccgagacccagcacggaacaguccuggugcagauuaaguacgagggcaccgacgcgccgugcaaaaucccuuucucuacacaagaugaaaaggggguuauccagaacggacggcugauuacggcuaaucccaucgugaccgacaaagagaagccugucaacauugaagccgagccgcccuuuggcgaguccuauaucgugauuggggugggagaaaaagcccuuaagcucagcugguucaagaaaggcucuagcaucgggaagauguuugaggcuacagccagaggcgcucgccggauggccauccugggagauaccgcgugggacuucggcuccauugggggaguuuuuacaucugucggcaaacuggugcaucagaucuucgggaccgccuacggagugcucuuuagcggcgucuccuggacgaugaagauugggaucggcgugcugcuuaccuggcugggacucaauagcagaucuacaucccugagcaugaccuguauugcuguuggccuggugacacuuuaccucggggucauggugcaggccgauucuggaugcguuaucaacuggaaaggccgcgaacugaaguguggguccggaauuuucgugaccaaugagguccacacauggaccgaacaauauaaguuucaggcugacagcccuaaacggcuguccgccgcgaucggcaaggccugggaggagggggugugcggcaucagaucugcuacgcgccucgaaaacauuauguggaaacagaucagcaacgagcugaaucauauucuucuggaaaacgacaugaaguucacaguuguggucggagauguggugggcauccucgcccaggggaaaaagaugauucggccgcaacccauggagcacaaauacuccuggaagucuuggggaaaggcuaaaaucaucggcgccgacguccagaauaccaccuuuauuaucgaugggccuaacacacccgaauguccugacgaucagagagccuggaauauuugggagguugaggacuauggauucggcaucuuuaccacgaacauuuggcugaagcugcgcgauagcuacacacaggcuugcgaccaccggcuuauguccgcggccaucaaagauagcaaggcugugcaugccgacaugggcuauuggaucgaaucugagaaaaaugaaaccuggaagcucgccagagcuuccuucauugaggugaagacauguaucuggcccaaaagccacacccuguggucuaacgggguccuggaauccgagauggugauuccgaagaucuacggaggcccuauuagccaacauaauuaucgccccggguacuucacacagaccgccggaccuuggcaccucggcaaacuggagcuugauuuugaccugugcgaagggacgaccguuguggucgaugagcacugcggaaaccggggccccucucucagaacaaccacagugaccggcaagaucauccaugaaugguguugccggagcuguacgcugccuccccugcgcuucaaaggggaggacggaugcugguacggcauggagauuagaccgguuaaggaaaaggaggaaaaucuugugaaauccauggucagcgcggggucuggagagguggacuccuuuagccucggccugcuguguaucuccauuaugaucgaagagguuaugcggucuagauggagccgcaagaugcucaugacagggacccuggcuguguuccuucugcucauuaugggacagcugacauggaacgaucugauccggcuuugcauuauggucggcgccaaugccuccgacagaaugggcauggggaccaccuaucuggcucucauggccacauuuaaaaugcgcccuauguucgcggugggacugcucuuuagacggcugacgucucgcgaggugcuucugcucaccaucggccugagccuggucgcuuccguugaacuucccaacucucuggaggaacucggggauggacuggccaugggcaucaugauucucaagcugcuuacagacuuccaaagccaccagcugugggccacccuccugucccugacauuuaucaaaaccacgcuuagccugcauuacgcuuggaagacaauggccauggugcucucuauugugucccuguucccccucugucugagcaccaccucucagaagacaaccuggcuuccuguccugcuggggucccucggaugcaaaccgcugacaauguuucuuaucgcugagaauaagauuuggggcagaaaaagcuggccccugaacgaaggcaucauggccguggggguugugucuauccuccuguccagccuccugaagaacgaugucccucuugcgggaccccugauugccggcgggaugcugaucgcuuguuaugugauuuccggaagcucugccgaccucagccuggagaaagcugccgagguuuccugggaagaggaagccgagcacucuggcgcuagccauaauauccuuguggaaguccaggaugacgggacgaugaagauuaaagaugaggagcgggacgauacccugacaauccuccugaaggcgacccuccuggccguguccggagucuacccucuuucuauccccgcuacacuguucgugugguauuuuuggcaaaagaaaaagcagcgcagcggcguucugugggacaccccuagcccucccgaaguggagagagccguccucgaugacggcauuuaccggaucaugcagcgcgggcugcuuggaagaucucaggugggcguugggguguuccaagaaaacgucuuccacacgauguggcacgugacccggggagccgugcugauguaucagggcaaacgccucgagcccagcugggcuuccguuaagaaagaccugauuagcuacgggggaggcuggagacuccagggcucuuggaauacaggggaggaaguccaggugaucgccguggagcccggaaagaacccuaagaauguccaaaccgcgcccggcacauuuaaaaccccggaaggggaggugggagcuauugcccuggauuucaagccuggcacauccgggagccccaucguuaaccgggaaggaaaaauugugggccuuuacggcaauggggucgugacgaccucuggaacauauguuuccgccaucgcucaggccaaggcgagccaggagggcccucugcccgagaucgaagacgagguguuuagaaaacgcaaccugaccauuauggaucuccaucccggguccggaaagacccggagauaccugccugcuaucguccgcgaagccauuaagcggaaacuuagaacacugauccucgccccgacgcgcgugguugcuucugagauggccgaagcucugaagggcaugcccauucgguaucaaaccacagccgugaaaagcgagcacaccgggaaggagaucgucgaccugaugugccaugcgacauucaccaugagacuccuuuccccugugcgcgugcccaauuacaacaugaucauuauggaugaagcccacuuuacggacccuagcucuaucgcugcccggggcuauauuuccacaagagucggaaugggcgaggcugccgccaucuucaugaccgcuacacccccugggagcguugaagcguuuccgcagucuaaugccgugauucaggaugaggaacgggacauccccgagcgcagcuggaacuccggauacgaguggaucacagauuucccuggcaaaaccgugugguuuguccccucuauuaagagcgggaaugacaucgcuaacugucugagaaagaauggaaaacgggugauucagcugucccgcaagacauucgauaccgaauaucagaagacgaagaacaacgacugggacuacguugugacaaccgauaucucugagaugggcgccaauuuuagagccgaccgggucauugauccuagacgcugccucaaacccgugauccugaaggacgggccggaacggguuauucuugcuggcccuaugcccgugacagucgccagcgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaaguccgccgcgaucgauggggaguaccggcucagaggagaggcccgcaaaaccuucguggaacuuaugagacggggcgaccugccggucuggcugagcuauaagguggcuucugagggguuucaauacuccgaucgcagauggugcuucgacggcgaacggaacaaucagguucucgaggaaaacauggauguggagauuuggacaaaagagggagaacgcaagaaacugagaccccgguggcuugacgccagaaccuauagcgacccucuggcucuccgcgaguuuaaggaguucgccgcuggccggagauccgugucuggggaucugauccuggagaucggaaagcucccccagcaucuuacacagcgcgcccaaaaugcgcuggacaaccuggucaugcuccacaauagcgaacagggcgggcgggccuacagacaugcuauggaggagcugccugauaccauugaaacacuuaugcugcucgcccugaucgcuguucugaccggaggcgugacgcucuuuuuccuuuccggccgggggcugggaaaaacaucuauuggccugcucugugugauggccagcuccguccugcuuuggauggccagcguggagccccacuggaucgcugcgucuauuauccuggaauuuuuccucaugguucugcugaucccggagccugaccgccagagaacaccccaggauaaccaacucgccuauguggucauugggcuucuguuuaugauccugaccguggcugccaaugagaugggacuccuggaaacaaccaagaaagaccuuggcauugggcacgucgccguggagaaccaucaccaugcuacaaugcuggauguugaccuccacccugccuccgcguggacgcuguacgccguggcuaccacaaucauuacccccaugaugcggcauacaaucgaaaacaccacggccaauauuagccugaccgcuaucgccaaccaggcggccauccucaugggacuugauaagggcuggccuauuucuaaaauggacaucggcgucccccugcuggcucucgggugcuacucccaggugaauccgcugacacuuaccgccgcuguucugaugcucguggcccacuaugcuauuaucggaccuggccugcaagccaaggcgacacgcgaggcccagaagagaaccgcugccgggauuaugaaaaaccccacggucgauggaaucguggcuaucgaccuggaucccgugguuuacgacgccaaguucgaaaaacagcucggccagauuaugcuucugauccuguguacaagccaaauucuccugaugcggaccacaugggcccuuugcgagucuaucacccuggcgaccgggccucucacaacgcugugggagggaagcccgggcaaguuuuggaauaccacaauugcugucuccauggccaacaucuuccgcggcucuuaucuggcuggggccggacucgccuuuagccuuaugaaaucccugggcgggggaagacggggcaccggggcucagggagaaacacugggcgagaaguggaagcgccagcucaaucagcugagcaaauccgaguucaacaucuacaagagaucuggcauuauggagguggaccggagcgaagccaaagaggggcuuaagagaggagagaccacgcgccacgcggugucccggggcacagccaaacugagaugguucgucgaacgcaaucucguuaagcccgaggggaaggugaucgaucugggauguggcagagggggauggucuuauuacugcgcuggccugaaaaaggugaccgaagucaaaggcuauaccaaagggggaccuggccaugaggaacccauuccuauggccacauacggguggaaccucgugaaacuucacagcggaaaggacgucuuuuucacacccccugagaaaugugauacacugcugugcgacaucggcgaguccucuccgaaucccacgauugaagaggggagaacccuccgcgugcugaagauggucgaaccuuggcuucggggaaaccaauuuuguaucaagauucugaaucccuacaugccuagcgugguugagacacucgagcagaugcagagaaaacauggcggcaugcuggugcgcaacccccugucccggaauagcacccacgaaauguauugggucucuugcgggacaggaaacaucguguccgcugugaauaugaccagcagaaugcuccugaaccgcuucacgauggcccaccggaagccgaccuacgagagagaugucgaccuuggcgcggggacacgccauguugccguggaaccugagguggcuaaccuggauaucauuggacagagaaucgaaaauauuaaacacgagcauaagucuaccuggcacuaugacgaggauaaccccuacaaaacaugggccuaucauggcuccuacgaagucaagcccagcgggucugcuuccagcauggugaauggaguugugaagcuccugaccaaaccuugggacgucauccccauggugacacaaauugccaugaccgauacgacaccuuuuggccagcagcggguuuucaaggagaaaguggacacccgcaccccgaaggcuaaaagaggcacagcccaaaucauggaagucacggcgcgguggcuuuggggguuucuguccagaaacaagaagccccggaucuguacccgcgaggaguucacaagaaaagugcggagcaaugccgcuauuggagccguuuuuguggacgagaaccaguggaacucugcuaaggaggccgucgaagaugagcgcuucugggaccucgugcagaaagaaagagagcugcacaagcagggcaaaugcgcgaccugcgucuauaacaugauggggaagcgggaaaagaaacugggagaguuuggcaaggcgaaagggagccgcgcuaucugguacauguggcucggcgccagauuccuggaguuugaagcccuuggauucaugaaugaggaucacugguucucccgggaaaacucucugagcggcguggagggggagggacuccauaagcugggcuacauucuucgcgacaucuccaaaauuccugggggaaauauguaugcugaugacacagccggcugggauaccagaaucacagaagacgaucugcaaaacgaggcuaagaucaccgacauuauggaacccgagcacgcccuccuggcgacgucuaucuuuaaacugaccuaccagaauaagguugugcggguccagcgcccugccaagaacgggacagugauggaugugauuagcagacgggaccagcgcggcuccggacaaguuggcaccuaugggcucaauacauucaccaacauggaagcucagcugaucagacagauggagucugagggaauuuuucuucccagcgaacuggagacgccgaaccucgccgaacgggugcuggauuggcuugagaaacauggcgucgaaagacugaagcgcauggcuaucuccggggacgacugugugguuaaaccuaucgaugaccgguucgccacagcgcucaccgcccugaaugauaugggaaaggugagaaaagacauuccccagugggagccuagcaagggcuggaacgauuggcaacagguccccuuuugcucucaccacuuccaucagcugaucaugaaggacgggcgcgagauuguggucccuugucggaaucaggaugaacucgugggcagagcucgcguuucccaaggagccggcuggagccugcgggagacagcuugccuugggaaaucuuacgcccagauguggcagcugauguauuuucacagacgcgaccuccggcuggcugccaacgcgaucuguuccgccgugcccgucgauugggugccgaccagcagaacgaccugguccauucaugcucaccaucaauggaugacaaccgaagacaugcuuucuguuuggaaucgcguguggaucgaggaaaacccuuggauggaggauaagacacacgucagcuccuggggagacgugcccuaccugggcaaacgggaggaccaguggugcgggagccucauuggacugaccgccagagccacaugggcuucuaauauccagguggccaucaaccagguucggagacugauuggcaaugaaaacuaucucgauuacaugaccuccaugaagcgcuucaaaaaugagggggaccccgaaggcgcgcugugguga

SEQ ID NO: 19266 - RNA, 9879 nt, Artificial Sequence
  derived and/or modified CDS sequence (opt5) from DENV-1__EU482794__SS-prME
agcgugaccaugcugcucaugcugaugcccaccgcccuugcuuuccaccugacgaccagaggcggggagccucauaugaucgugacaaagcaggaacggggaaaaucccuccuguuuaagaccucugccggcguuaauaugugcacccuuauugccauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgcuagccuguucccccucugucugucuaccaccucccagaagacaaccuggcuuccugugcugcuggggagccucggaugcaaaccgcugacaauguuucuuauuacggagaccaagaucuggggcagaaaaucuuggccccugaaugaaggcauuauggccgucggggugguuuccauccuccugagcucccuccugaagaacgaugugccucuugcgggaccccugaucgccggcgggaugcugauugcuuguuaugucaucagcggaucuagcgccgaccucucccuggagaaagcugccgaggugucuugggaagaggaagccgagcacagcggcgcuucccauaacauucuuguugugguccaggaugacgggacaaugaagaucaaagaugaggaacgggacgauacccugacaauucuccugaaggcgacccuccuggccgugucuggagucuacccucuuagcauccccgcuacgcuguucgugugguauuuuuggcaaaagaaaaagcagcgcuccggcguucugugggacaccccuucucccccggagguggaaagagccguccucgaugacggcaucuaccggauuaugcagcgcgggcugcuuggaagaagccaggugggcguugggguguuccaagagaaugucuuccacacaauguggcacgugacccggggagccgugcugauguaucagggcaaacgccucgaaccuuccugggcuagcguuaagaaagaccugaucucuuacgggggaggcuggagacuccagggcuccuggaacacaggggaggagguccaggugauugccguggaacccggaaagaauccuaagaacguccaaaccgcgcccggcacauuuaaaacgccggagggggaagugggagcuaucgcccuggauuucaagccuggcaccagcgggucucccauuguuaaucgggagggaaaaaucgugggccuuuacggcaacggggucgugacaaccuccggaaccuauguuagcgccauugcucaggccaaggcgucccaggaaggcccucugcccgagaucgaggacgaaguguuuagaaaacgcaaucugacaaucauggaucuccaucccgggucuggaaagacgcggagauaccugccugcuauuguccgcgaggccaucaagcggaaacuuagaacccugauucucgccccgacacgcgugguugcuagcgaaauggccgaggcucugaagggcaugcccauccgguaucaaaccacagccgugaaauccgaacacaccgggaaggagauugucgaccugaugugccaugcgacguucacaaugagacuccuuagcccugugcgcgugcccaacuacaauaugaucaucauggaugaggcccacuuuaccgacccuucuuccauugcugcccggggcuauaucagcaccagagucggaaugggcgaagcugccgccauuuucaugacagcuacacccccugggucuguugaggcguuuccgcagagcaacgccgugauccaggaugaggaacgggacauucccgaacgcuccuggaacucuggauacgaguggaucacagauuucccuggcaaaaccgugugguuuguccccagcaucaaguccgggaacgacauugcuaauugucugagaaagaacggaaaacgggugauccagcugucucgcaagacguucgauacagaguaucagaagaccaagaauaacgacugggacuacguugugacaaccgauauuagcgaaaugggcgccaacuuuagagccgaccgggucaucgauccuagacgcugccucaaacccgugauucugaaggacgggccggagcggguuauccuugcuggcccuaugcccgugacggucgccuccgcggcucagagacgcggacggauuggcagaaauuacaacaaggaaggggaucaguauaucuacaugggacagccccugaauaacgacgaggaucaugcccacuggaccgaggccaaaaugcuccuggacaauaucaacacaccugaaggcauuauccccgcucuguucgagccugaacgcgaaaagagcgccgcgauugauggggaauaucggcucagaggagaggcccgcaaaaccuucguggagcuuaugagacggggcgaccugccggucuggcugucuuacaagguggcuuccgaaggguuucaauauagcgaucgcagauggugcuucgacggcgagcggaauaaccagguucucgaagagaauauggauguggaaaucuggacaaaagagggagagcgcaagaaacugagaccccgguggcuugacgccagaaccuacuccgacccucuggcucuccgcgaauuuaaggaguucgccgcuggccggagaucugugagcggggaucugauucuggaaaucggaaagcucccccagcaccuuacacagcgcgcccaaaacgcgcuggacaaucuggucaugcuccauaacuccgagcagggcgggcgggccuauagacacgcuauggaggaacugccugauaccaucgagacgcuuaugcugcucgcccugauugcuguucugacaggaggcgugacccucuuuuuccuuucuggccgggggcugggaaaaaccagcaucggccugcucugugugauggccuccagcguccugcuuuggauggccucuguggaaccccauuggauugcugcguccaucauucuggaguuuuuccucaugguucugcugaucccggaaccugaccgccagagaacaccccaggauaaucaacucgccuacguggucaucgggcuucuguuuaugauucugaccguggcugccaacgagaugggacuccuggagacaacgaagaaagaccuuggcaucgggcacgucgccguggaaaaucaccaucacgcuaccaugcuggauguugaccuccauccugccagcgcguggacacuguacgccguggcuaccacaauuaucacccccaugaugcggcacacgauugagaacaccacagccaacaucucucugaccgcuauugccaaucaggcggccauccucaugggacuugauaagggcuggccuaucuccaaaauggacauuggcgucccccugcuggcucucgggugcuauagccaggugaacccgcugacacuuaccgccgcuguucugaugcucguggcccauuacgcuaucauuggaccuggccugcaagccaaggcgacgcgcgaagcccagaagagaacagcugccgggaucaugaaaaaucccaccgucgauggaauuguggcuaucgaccuggaucccgugguuuaugacgccaaguucgagaaacagcucggccagaucaugcuucugauucuguguacaucucaaauccuccugaugcggaccaccugggcccuuugcgaaagcauuacacuggcgacggggccucucaccacacugugggagggauccccgggcaaguuuuggaacaccacaaucgcugucucuauggccaauauuuuccgcggcagcuaccuggcuggggccggacucgccuuuucccuuaugaaaagccugggcgggggaagacggggcaccggggcucagggagagacgcugggcgaaaaguggaagcgccagcucaaccagcuguccaaaucugaguucaauaucuauaagagaagcggcaucauggaaguggaccgguccgaggccaaagaagggcuuaagagaggagagacaacccgccacgcggugucucggggcaccgccaaacugagaugguucgucgagcgcaaccucguuaagcccgaagggaaggugauugaucugggauguggcagagggggauggagcuacuauugcgcuggccugaaaaaggugacagaggucaaaggcuacaccaaagggggaccuggccacgaggagcccaucccuauggccacauacggguggaaucucgugaaacuucauuccggaaaggacgucuuuuucacgcccccugaaaaaugugauacccugcugugcgacauuggcgagucuagcccgaaccccacaaucgaggaagggagaacccuccgcgugcugaagauggucgagccuuggcuucggggaaaucaauuuuguauuaagauccugaaccccuauaugccuuccgugguugaaacacucgagcagaugcagagaaaacacggcggcaugcuggugcgcaauccccugagccggaacucuacccaugagauguacugggucuccugcgggacgggaaauauugugagcgcugugaacaugaccucuagaaugcuccugaaucgcuucacaauggcccaccggaagccgaccuaugaaagagaugucgaccuuggcgcggggacacgccacguugccguggagccugaaguggcuaaccuggauaucaucggacagagaauugagaacaucaaacaugaacacaaguccaccuggcauuacgacgaggauaaucccuauaaaacaugggccuaccacggcagcuaugaggucaagcccucuggguccgcuagcuccauggugaacggaguugugaagcuccugaccaaaccuugggacgucauucccauggugacgcaaaucgccaugacagauaccaccccuuuuggccagcagcggguuuucaaggaaaaaguggacacacgcacgccgaaggcuaaaagaggcaccgcccaaauuauggaggucacagcgcgguggcuuuggggguuucugagcagaaauaagaagccccggaucuguacccgcgaagaguucacaagaaaagugcggucuaacgccgcuaucggagccguuuuuguggacgaaaaucaguggaacagcgcuaaggaggccgucgaggaugaacgcuucugggaccucgugcagaaagagagagaacugcauaagcagggcaaaugcgcgaccugcgucuacaauaugauggggaagcgggagaagaaacugggagaauuuggcaaggcgaaagggucccgcgcuauuugguacauguggcucggcgccagauuccuggaguuugaggcccuuggauucaugaacgaagaucacugguucucucgggagaauagccuguccggcguggaaggggagggacuccacaagcugggcuauauccuucgcgacauuucuaaaaucccugggggaaacauguacgcugaugacacagccggcugggauaccagaauuacggaggacgaucugcaaaaugaagcuaagaucaccgacaucauggagcccgaacaugcccuccuggcgacaagcauuuuuaaacugaccuaucagaacaagguugugcggguccagcgcccugccaagaaugggacagugauggaugugaucuccagacgggaccagcgcggcucuggacaaguuggcaccuacgggcucaacacguucacaaauauggaggcucagcugauuagacagauggaaagcgagggaaucuuucuucccuccgagcuggaaaccccgaaccucgccgagcgggugcuggauuggcuugaaaaauauggcgucgagagacugaagcgcauggcuauuagcggggacgacugugugguuaaaccuaucgaugaccgguucgccacagcgcucaccgcccugaacgauaugggaaaggugagaaaagacaucccccagugggaaccuucuaagggcuggaaugauuggcaacagguccccuuuugcucccaccauuuccaccagcugauuaugaaggacgggcgcgagaucguggucccuugucggaaccaggaugagcucgugggcagagcucgcguuagccaaggagccggcuggucucugcgggaaacggcuugccuugggaaauccuacgcccagauguggcagcugauguauuuucacagacgcgaccuccggcuggcugccaaugcgauuuguagcgccgugcccgucgauugggugccgaccuccagaacaaccuggucuauccaugcucaccaucaauggaugacaaccgaggacaugcuuagcguuuggaaccgcguguggauugaagagaauccuuggauggaagauaagacacacgucuccagcuggggagacgugcccuaccugggcaaacgggaggaccaguggugcgggucucucaucggacugaccgccagagccacgugggcuuccaacauucagguggccaucaaucagguucggagacugaucggcaacgagaauuaccucgauuauaugacaagcaugaagcgcuucaaaaacgaaggggaccccgagggcgcgcugugguga

SEQ ID NO: 19267 - RNA, 9879 nt, Artificial Sequence
  derived and/or modified CDS sequence (opt5) from DENV-1__EU482795__SS-prME
uccgugaccaugcugcucaugcugaugcccaccgcucuugcuuuccaccugacgacccggggcggggaaccucauaugauugucuccaagcaggaacggggaaaaucucuccuguuuaagacauccgccggcguuaacaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucucuggccaucugaagugcagacucaaaauggauaagcugacgcuuaaagggauguccuaugugauguguacaggcagcuucaagcuggagaaggaagucgcugagacccagcacggaaccgugcucguucagaucaaauacgagggcacagacgccccgugcaagauuccuuuuucuacccaggaugaaaaaggggugacacaaaacggacggcugaucacggcgaaucccaucgucaccgacaaggagaaaccugugaacauugaagcugagccgcccuucggcgagagcuauaucgugauuggggccggagaaaaggcccugaaacuuuccugguuuaaaaagggcucuagcaucgggaaaauguucgaggcuacagccagaggcgcucgccggauggccauucucggagauaccgcgugggacuuuggcuccaucgggggaguuuucacaagcgucggcaagcuggugcaucagaucuuugggaccgccuacggagugcuguucucuggcgucuccuggacgaugaaaauugggaucggcgugcuccugaccuggcuuggacugaauagcagaucuacaucccucagcaugaccuguauugcuguuggccuggugacacuguaccuuggggucauggugcaggccgauuccggaugcguuaucaacuggaagggccgcgaacucaagugugggucuggaauuuuugugaccaaugagguccacacauggaccgaacaguauaaauuccaagcugacagcccuaagcggcuguccgccgcgaucggcaaagccugggaggagggggugugcggcauuagaucugcuacgcgccuggaaaacaucauguggaagcagaucagcaacgagcucaaucauauucugcuugaaaacgacaugaaauuuacaguuguggucggagauguggccggcauccuggcucaggggaagaaaaugauucggccgcagcccauggaguacaaguauuccuggaaaagcuggggaaaggccaagaucauuggcgccgacgugcaaaauaccaccuucaucaucgaugggccuaacacacccgaauguccugacgaucagagagcuuggaauauuugggaggucgaggacuacggauuuggcaucuucaccacgaacauuuggcucaaacugcgcgauucuuauacacagguuugcgaccaccggcugauguccgcggccaucaaggauagcaaagcugugcacgccgacaugggcuacuggauugaaucugagaagaaugaaaccuggaaacuugccagagcuuccuucaucgaggugaaaacauguaucuggcccaagagccauacccucuggucuaacgggguccuggaaagcgagaugauuaucccgaaaauuuauggaggcccuaucucccagcacaauuaccgccccggguacuuuacacaaaccgccggaccuuggcaucugggcaagcucgagcuggauuucgaccuuugcgaagggacgaccgugguuguggaugagcacugcggaaaccggggccccagccugagaacaaccacagucaccggcaaaauuauccacgaaugguguugccggucuuguacgcucccuccccugcgcuuuaagggggaggacggaugcugguauggcauggagaucagaccggugaaggaaaaagaggaaaaucugguuaaguccauggugagcgcgggguccggagaggucgacucuuucagccuuggccuccuguguauuuccaucaugauugaagaggugaugcggucuagauggagccgcaaaaugcugaugacagggacccucgcugucuuuuuccugcuuaucaugggacagcugacauggaacgaucucauucggcugugcaucauggugggcgccaaugccuccgacagaaugggcauggggaccaccuaccuggcucuuauggccacauuuaagaugcgcccuauguucgcggucggacugcucuuuagacggcugacgucucgcgaggugcuccugcuuaccauuggccugagccucguggcuuccgucgaacugcccaacagccuggaggaacuuggggauggacuggccaugggcaucaugauccucaaacugcucacagacuuccagucucaucaacugugggccacccuucugucccucacauuuauuaagaccacguucagccugcacuaugcuuggaagacaauggccaugguucugucuaucgugucccuucugccccucugucugagcaccaccucucagaaaacaaccuggcucccugugcugcuugggucccugggaugcaagccgcugacaauguuucucauugcugagaauaaaaucuggggcagaaagagcuggccccugaacgaaggcauuauggccgucgggaucguguccauccuucugagcucucuccugaaaaacgauguuccucucgcgggaccccugauugccggcgggaugcuuaucgcuuguuacgugauuagcggauccucugccgaccugagccuggagaaggcugccgaggucuccugggaagaggaagccgagcauucuggcgcuagccacaauauccucguggaaguucaggaugacgggacgaugaaaauuaaggaugaggagcgggacgauacccugacaauccuucugaaggcgacccuccuggccguguccggagucuauccucucucuauccccgcuacacuguucgugugguacuucuggcagaaaaagaaacaacgcagcggcguccuuugggacaccccuagcccucccgaaguggagagagccguucuggaugacggcauuuaucggaucaugcagcgcgggcugcucggaagaagccaggugggcgucgggguguuucaggaaaacguuuuccauacgauguggcacgugacccggggagccguccugauguaccaaggcaagcgccuugagcccucuugggcuuccgugaaaaaggaccugauuagcuacgggggaggcuggagacuccagggcucuuggaauacaggggaggaagugcagguuaucgccgucgagcccggaaagaacccuaaaaaugugcagaccgcgcccggcacauuuaagaccuccgaaggggaggugggagcuauugcccuggauuucaaaccgggcacaagcggguccccuaucgucaaccgggaaggaaagauugugggccucuauggcaaugggguugugacgaccucuggaacauacgucagcgccaucgcucaagccaaagcgucccaggagggcccccugccugagaucgaagacgagguguuuagaaagcgcaaccuuaccauuauggaucugcaccccgggagcggaaagacccggagauaucugcccgcuaucguucgcgaagccauuaaacggaagcucagaacacugauccuugccccuacgcgcguggucgcuucugagauggccgaagcucugaaaggcaugccgauucgguaccagaccacagccgugaaguccgagcauaccgggaaagagaucguugaccucaugugccacgcgacauucaccaugagacugcugagccccgugcgcgucccuaauuauaacaugaucauuauggaugaagcccauuuuacggaccccucuagcaucgcugcccggggcuacauuuccacaagagugggaaugggcgaggcugccgccaucuucaugaccgcuaccccucccgggucuguggaagcguuuccucaaagcaaugccgucauucaggaugaggaacgggacaucccggagcgcuccuggaacucuggauaugaguggaucacagauuuccccggcaagaccguuugguuugugccuagcauuaaguccgggaaugacaucgcuaacugucuccgcaagaauggaaagcgggugauucagcuuagccgcagaacauucgauaccgaauaccagaaaacgaagaacaacgacugggacuacgucgugacaaccgauaucucugagaugggcgccaauuuccgggccgacagaguuauugauccccgccggugccugaaaccugugauccugaaggacgggcccgaaagagucauucucgcuggcccgaugccugugacaguugccuccgcggcucaacgccggggaagaaucggccgcaaccacaauaaggagggggaucaguauaucuacaugggacagccccugaacaaugacgaggaucaugcccacuggaccgaagccaaaaugcuucuggacaacauuaauacgcccgagggcaucauuccugcucucuuugaacccgagcgggaaaagagcgccgcgaucgauggggaguauagacugcgcggagaggccagaaaaaccuucguggaacugaugcggcgcggcgaccucccugucuggcuuuccuacaagguggcuucugagggguuucaguauagcgauagacgguggugcuucgacggcgaacgcaacaaucaaguccuggaggaaaacauggauguggagauuuggacaaaagagggagaaagaaagaaacugcggccgagauggcucgacgcccgcaccuacuccgacccccuggcccuucgggaguuuaaggaguucgccgcuggcagacgcucuguuagcggggaucugauccucgagaucggaaagcugccucagcaccugacacagcgggcccagaaugcgcucgacaaccuugugaugcugcauaauuccgaacaaggcgggagagccuaucggcacgcuauggaggagcugcccgauaccauugaaacacucaugcugcuugcccugaucgcugugcucaccggaggcgucacgcuguuuuuccugagcggccgcgggcucggaaaaacaucuauuggccuucuguguguuauggccuccagcgcccugcucuggauggcuucuguggagccucauuggaucgcggccuccauuauccuggaauuuuuccuuauggugcugcucauccccgagccggacagacagcggaccccucaggauaaccagcuggcuuacgucgugauugggcugcucuuuaugauccuuaccguugccgccaaugagaugggacugcuggaaacaaccaagaaagaccucggcauugggcacguggcugucgagaaccaccaucacgccgcgaugcuggauguggaccuucaucccgccagcgcuuggacacuguacgccgucgcuacgaccaucauuacaccuaugaugcgccacaccaucgaaaacacaaccgccaauauuucucucacggcgaucgccaaccaagcugccauccugaugggacuggauaagggcuggcccauuagcaaaauggacaucggcgugccucuccuugcucuggggugcuauucccagguuaauccccugacccucacagccgcugugcugaugcuugucgcccauuacgcgauuaucggaccgggccugcaggccaaggcuaccagagaggcccaaaagcggacagcugccgggauuaugaaaaacccuaccguggauggaaucguugccaucgaccucgaucccguggucuaugacgcgaaguucgaaaaacagcugggccagauuaugcugcucauccuuuguacgucucagauucugcugaugcgcacaaccugggcucucugcgagagcaucacacuggccaccgggccccuuaccacacugugggagggauccccuggcaaguuuuggaauacgaccauugcugugagcauggccaacaucuucagaggcuccuaccucgccggggcuggacuggccuucucucugaugaaaagccucggcgggggacggcgcggcacaggggcgcaaggagaaacccuuggcgagaaguggaagagacagcugaaucagcuguccaaaucugaauuuaacacauauaagcggagcggcaucauggagguggacagauccgaagccaaagaggggcucaagcgcggagagaccacgaaacacgcuguuucucggggcacagccaagcugagaugguucgucgaacgcaaucuugugaagccggaggggaaagugauugaucugggauguggcagagggggauggagcuacuauugcgcuggccucaagaaagucaccgaaguuaagggcuacaccaaagggggacccggccacgaggaaccuauccccauggccacauacggguggaaccuggugaagcugcauuccggaaaagacguguuuuucauuccucccgagaagugugauacccuccuuugcgacaucggcgagagcucuccuaauccgacaauugaagaggggagaacgcugcgcguccugaagaugguggaacccuggcuccggggaaaccaguuuuguaucaaaauucugaauccuuauaugcccuccguuguggagacccuugagcaaaugcagagaaagcacggcggcaugcugguccgcaacccucucagcagaaauucuacacaugaaauguacuggguguccugcgggaccggaaacaucguuagcgcggugaauaugacaucuagaaugcugcugaaccgcuucaccauggcccaccggaaacccacguaugagagagaugucgaccucggcgcugggacccgccacguggccguggaaccggaggucgcuaaccuggauaucauuggacagagaaucgaaaauauuaagcaugagcacaaauccacauggcauuacgacgaggauaacccuuauaagaccugggccuaccacggcagcuaugaaguuaagcccuccgggagcgcuucuagcauggugaauggaguggucaaacuucugacaaagcccugggacgugaucccuaugguuacccagauugccaugacagauaccacgcccuuuggccaacagcggguguucaaagagaaggucgacacacgcaccccuaaagcgaagagaggcaccgcccagaucauggaagugacagcuaaguggcucuggggguuucugucccggaacaaaaagccgagaaucuguacgcgggaggaguucacccgcaaaguuagaucuaaugccgcuauuggagccguguuugucgacgagaaccaauggaauagcgccaaggaggcgguggaagaugagcgguucugggaccuuguucaucgcgaaagagagcugcacaaacagggcaagugcgcuacaugcguguacaacaugauggggaagcgggagaagaagcucggagaguuuggcaaagccaaggggucccgcgccaucugguacauguggcugggcgcuagauuccuggaguucgaagcccucggauuuaugaaugaggaucacugguucucucgggaaaacagccuguccggcgucgagggggagggacuucauaaacugggcuauauucuccgcgacaucucuaagauucccgggggaaauauguacgcugaugacaccgccggcugggauacaagaaucaccgaagacgaucugcagaacgaggcgaaaaucacagacauuauggaaccugagcacgcccuucuggcuaagagcaucuuuaagcucaccuaucagaauaaagugguccgggugcaacgccccgccaagaacgggacgguuauggaugugauuuccagacgggaccagcgcggcagcggacaggucggcaccuacgggcugaauacauucaccaacauggaagcucagcugaucagacaaauggagucugagggaaucuuuuccccuagcgaacucgagacacccaaccuggccggccgggugcuugauuggcuggaaaaacaugggguggagagacucaagcgcauggcgaucucuggagacgacuguguugugaaaccgaucgaugaccgguucgccaccgcucugacggcccuuaaugauaugggcaaggucagaaaggacauuccucagugggaacccuccaaaggguggaacgauuggcaacaggugccuuuuugcagccaccacuuccaucaacugaucaugaaggacggccgcgagauuguugugcccugucggaaucaggaugagcucgucggacgggcucgcgugucccagggcgccggguggucucugcgggaaacagcuugccugggaaaaagcuaugcccagauguggcaacucauguacuuucacagacgcgaccugcggcuugcggccaacgcuaucuguuccgccgucccuguggauuggguucccaccagcagaacaaccuggucuauucaugcccaccaucaguggaugacgaccgaggacaugcuguccguguggaaucgcgucuggaucgaagagaacccguggauggaagauaagacacacauuagcucuuggggcgacgugccuuaucucgggaaacgggaggaccaguggugcggaagccugaucggccuuaccgcuagagccacaugggcgaccaauauccaaguugcuauuaaccaggugcggagacugaucgggaaugagaacuaccucgauuacaugacauccaugaagcgcuucaagaaugaaucugaccccgagggcgcccugugguga

SEQ ID NO: 19268 - RNA, 9879 nt, Artificial Sequence
  derived and/or modified CDS sequence (opt5) from DENV-1__EU482796__SS-prME
agcgugaccaugcugcucaugcugaugcccaccgcccuugcuuuccaccugacgacccggggcggggagccucauaugaucgucaccaagcaggaacggggaaagucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagaugcgcgauuccuacacacaggucugcgaccaccggcugaugagcgcggccaucaaagauucuaaggcuguucaugccgacaugggcuauuggaucgaauccgagaaaaaugaaaccuggaaacuugccagagcuagcuucauugaggugaagacauguaucuggcccaaaucucacacccucugguccaacggggugcuggaaagcgagaugauuaucccgaagauuuacggaggcccuaucucucaacauaauuaucgccccggguacuucacacagaccgccggaccuuggcaccugggcaaacucgagcuggauuuugaccuuugcgaagggacgaccgucgugguugaugagcacugcggaaaccggggccccagccugagaacaaccacagugaccggcaagaucauucaugaaugguguugccgguccuguacgcucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugacagggacccucgcuguguuccugcuucugaucaugggacagcucacauggaacgaucugauucggcugugcaucaugguuggcgccaaugccucugacagaaugggcauggggaccaccuaucuugcucugauggccacauuuaaaaugcgcccuauguucgcggugggacuccuguuuagacggcucacgagccgcgagguccugcuucugaccaucggccucucccugguggcuucuguggaacugcccaacagccuugaggaacugggggauggacucgccaugggcauuaugauccugaagcuccugacagacuuccaaucccaccagcuuugggccacccugcucagccugacauuuauuaaaaccacgcugucucuucauuacgcuuggaagacaauggccaugguccuguccaucguuagccucauuccccugugucucucuaccaccucccagaagacaaccuggcugccugugcuucuggggagccugggaugcaaaccgcucacaauguuccugaucgcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacgauguggcacgugacccggggagccguccuuauguaucagggcaaacgccuggagccuuccugggcuagcgugaagaaagaccucauuucuuacgggggaggcuggagacugcagggcuccuggaauacaggggaggaagugcagguuaucgccgucgagcccggaaagaacccuaagaaugugcaaaccgcgcccggcacauucaaaaccccggaaggggaggugggagcuauugcccucgauuuuaagccuggcacaagcgggucucccaucgucaaccgggaaggaaaaaucgugggccuguacggcaaugggguugugacgaccuccggaacauaugucagcgccauugcucaggccaaggcgucccaggagggcccucuucccgagaucgaagacgagguguucagaaaacgcaaccugaccauuauggaucugcaucccgggucuggaaagacccggagauaccucccugcuaucguucgcgaagccauuaagcggaaacugagaacacuuauccuggccccgacgcgcguggucgcuagcgagauggccgaagcucucaagggcaugcccauccgguaucaaaccacagccgugaaauccgagcacaccgggaaggagauuguugaccugaugugccaugcgacauuuaccaugagacugcucagcccugugcgcguccccaauuacaacaugaucauuauggaugaagcccacuucacggacccuucuuccaucgcugcccggggcuauauuagcacaagagugggaaugggcgaggcugccgccaucuuuaugaccgcuacacccccugggucuguggaagcguucccgcagagcaaugccgucauccaggaugaggaacgggacauucccgagcgcuccuggaacucuggauacgaguggaucacagauuuuccuggcaaaaccguuugguucgugcccagcauuaaguccgggaaugacaucgcuaacugucuuagaaagaauggaaaacgggugauucagcugucucgcaagacauuugauaccgaauaucagaagacgaagaacaacgacugggacuacgucgugacaaccgauaucagcgagaugggcgccaauuucagagccgaccggguuauugauccuagacgcugccugaaacccgugauccucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguuugaaccugagcgcgaaaagagcgccgcgaucgauggggaguaccggcugagaggagaggcccgcaaaaccuucguggaacucaugagacggggcgaccuuccggucuggcugucuuauaagguggcuuccgagggguuccaauacagcgaucgcagauggugcuuugacggcgaacggaacaaucagguccuggaggaaaacauggauguggagaucuggacaaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacgcuguucuuucucucuggccgggggcuuggaaaaacaagcauuggccugcuguguguuauggccuccagcgugcuccuguggauggccucuguggagccccacuggaucgcugcguccaucauucuugaguucuuucugaugguccuccugaucccggagccugaccgccagagaacaccccaggauaaccaacuggccuaugugguuauugggcuccuuuucaugauccugaccguggcugccaaugagaugggacugcucgaaacaaccaagaaagaccugggcauugggcacgucgccguggagaaccaucaccaugcuacaaugcuugaugucgaccugcacccugccagcgcguggacgcucuacgccguggcuaccacaaucauuacccccaugaugcggcauacaaucgaaaacaccacggccaauaucucucugaccgcuauugccaaccaggcggccauccugaugggacucgauaagggcuggccuauuuccaaaauggacaucggcguuccccuucuggcucuggggugcuacagccaggugaauccgcucacacugaccgccgcuguccuuaugcugguggcccacuaugcuauuaucggaccuggccuccaagccaaggcgacacgcgaggcccagaagagaaccgcugccgggaucaugaaaaaccccacgguugauggaauuguggcuaucgaccuggaucccgucguguacgacgccaaguuugaaaaacagcugggccagauuaugcuccuuauccuguguacaucucaaauucugcucaugcggaccacaugggcccugugcgagagcaucacccuugcgaccgggccucugacaacgcucugggagggauccccgggcaaguucuggaauaccacaaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacaucuacaagagaagcggcauuauggagguugaccgguccgaagccaaagaggggcugaagagaggagagaccacgcgccacgcggucucucggggcacagccaaacuuagaugguucguggaacgcaaucuggugaagcccgaggggaaggucaucgaucucggauguggcagagggggauggagcuauuacugcgcuggccugaaaaagguuaccgaagugaaaggcuauaccaaagggggaccuggccaugaggaacccauuccuauggccacauacggguggaaccuggugaaacuccacuccggaaaggacgucuucuuuacacccccugagaaaugugauacacuucugugcgacaucggcgagucuagcccgaaucccacgauugaagaggggagaacccugcgcgugcucaagaugguugaaccuuggcugcggggaaaccaauucuguaucaagauccuuaaucccuacaugccuuccguggucgagacacuggagcagaugcagagaaaacauggcggcaugcucgugcgcaacccccugagcagaaauucuacccacgaaauguauuggguuuccugcgggacaggaaacauugugagcgcugucaauaugaccucuagaaugcugcucaaccgcuuuacgauggcccaccggaagccgaccuacgagaaagauguggaccugggcgcggggacaagacauguggccgucgaaccugagguugcuaaccuugauaucauuggacagcgcaucgaaaauauuaagcacgagcauaaauccaccuggcacuaugacgaggauaaccccuacaagacaugggccuaucauggcagcuacgaagugaagcccucuggguccgcuagcuccauggugaauggagucgugaaacugcucaccaagccuugggacguuauccccauggugacacaaaucgccaugaccgauacgacaccuuucggccagcagagagucuuuaaagagaagguggacacccggaccccgaaagcuaagcgcggcacaguucaaauuauggaagugacggccagauggcuguggggguuccuuagccggaacaagaaacccagaaucuguacccgggaggaauuuacacgcaaggucagaucuaaugcggccauuggagcuguguucguugacgagaaccaguggaauagcgccaaagaggcuguggaagaugagcgguuuugggaccuggucaagaaagaacgcgagcuccacaagcagggcaagugcgcgaccugcguguauaacaugauggggaaaagagaaaagaaacugggagaguucggcaaggccaaagggucccgggcgaucugguacauguggcugggcgcucgcuuucucgaguucgaagcccugggauuuaugaaugaggaucacugguucucuagagaaaacagccuuuccggcgucgagggggagggacugcauaagcucggcuacauucugcgggacaucucuaaaaucccugggggaaauauguaugccgaugacacagcuggcugggauacccgcauuacagaagacgaucuucagaacgaggccaagaucaccgacauuauggaacccgagcacgcucugcucgccacgagcaucuucaagcugaccuaccaaaauaaagugguuagagugcagcggccugcgaagaacgggacagucauggaugugauuucccgcagagaccagcggggcucuggacaggugggcaccuaugggcugaauacauuuaccaacauggaagcccaacucauccgccagauggagagcgagggaaucuuccugcccuccgaacuugagacgccgaaccuggcugaaagaguucucgauuggcuggagaaauacggcguggaacggcuuaagagaauggccauuagcggggacgacugugucgugaaaccuaucgaugaccgcuuugcuacagcccugaccgcgcucaaugauaugggaaagguucggaaggacauuccccagugggagccuucuaaaggcuggaacgauuggcagcaagugcccuucugcucccaucacuuucaccagcugaucaugaaggacgggagagagauugucgugccuugucgcaaucaggaugaacuggucggccgggccagagugagccagggagcuggcuggucucuccgcgagacagccugccuggggaaauccuaugcucaaauguggcagcuuauguacuuccaucggagagaccugcgccucgccgcuaacgccaucuguagcgcgguucccguggauugggucccgaccucccggacgaccuggucuauucacgcccaucaccaguggaugacaaccgaagacaugcugagcguguggaauagaguuuggaucgaggaaaacccuuggauggaggauaagacacauguguccagcuggggagacguccccuaucuuggcaaacgcgaggaccaauggugcgggucucugaucggacucaccgcucgggccacaugggccuccaauauucagguggcuaucaaccaggugagacggcugauuggcaaugaaaacuaccuggauuacaugaccagcaugaagagauuuaagaaugagggggaccccgaaggcgcccucugguga

SEQ ID NO: 19269 - RNA, 9879 nt, Artificial Sequence
  derived and/or modified CDS sequence (opt5) from DENV-1__EU482797__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacaccgccggcugggauacacgcaucaccgaagacgaucuccagaacgaggcgaagaucacagacauuauggaaccugagcacgcccugcuugcuaagucuaucuucaaacugaccuaucagaauaaggucgugagaguucaacggcccgccaaaaacgggacggugauggaugucauuagccgcagagaccagcggggcuccggacaggugggcaccuacgggcucaauacauuuaccaacauggaagcucagcugauccgccaaauggagagcgagggaauuuucucuccuuccgaacuggagacacccaaccucgccggcagagugcuggauuggcuugaaaagcaugggguugagcggcugaaaagaauggcgaucagcggagacgacuguguggucaagccgaucgaugaccgcuuugccaccgcucucacggcccugaaugauaugggcaaggugcggaaagacguuccucagugggaacccucuaagggguggaacgauuggcaacaggugccuuucugcucccaccacuuucaucaacuuauuaugaaagacggcagagagaucgucgugcccugucgcaaucaggaugagcuggucggacgggcuagagugagccagggcgccggguggucccuccgcgaaacagcuugccugggaaagucuuaugcccagauguggcaacugauguacuuccaccggagagaccuccgccuggcggccaacgcuauuuguagcgccguuccuguggauuggguccccaccucccggacaaccuggagcauccaugcccaccaucaguggaugacgaccgaggacaugcuuucuguguggaauagaguuuggauugaagagaacccguggauggaagauaaaacacacaucuccagcuggggcgacgugccuuaucuggggaagcgcgaggaccaguggugcggaucucucauuggccugaccgcucgggccacaugggcgaccaauauccaagucgcuaucaaccaggugagacggcuuauugggaaugagaacuaccuggauuacaugacaagcaugaagagauuuaaaaaugaauccgaccccgagggcgcccucugguga

SEQ ID NO: 19270 - RNA, 9879 nt, Artificial Sequence
  derived and/or modified CDS sequence (opt5) from DENV-1__EU482799__SS-prME
agcgugaccaugcugcucaugcugaugcccacagcucuugcuuuccaccugacgaccagaggcggggaaccucauaugaucguguccaagcaggaacgggggaaaucucuccuguuuaagacaagcgccggcguuaacaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaagacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggcucuuucaaacucgagaaggaaguggccgagacccagcacggaacaguucuggugcagauuaaguacgagggcaccgacgcuccgugcaaaaucccuuucuccacacaagaugaaaagggggucacgcagaacggacggcugaucaccgccaaucccauugugacagacaaagagaagccugugaacaucgaagcggagccgcccuuuggcgagagcuauauuaucauuggggcuggagagaagacccuuaagcucucuugguucaagaaaggcagcuccaucgggaagauguuugaggccacagccagaggcgcucgccggauggccauccugggagauaccgcuugggacuucggcucuauugggggaguuuuuacgagcgucggcaaacuggugcaucagaucuucgggaccgccuacggagugcucuuuuccggcgucagcuggacaaugaagauugggaucggcgugcugcuuaccuggcugggacucaauucuagauccacaagccugucuaugaccuguauugcgguuggccuggugacacuuuaccucggggucauggugcaggccgauuccggaugcguuaucaacuggaaaggccgcgaacugaagugugggagcggaauuuucgugaccaaugagauccacacguggacagaacaauauaaguuucaggcugacuccccuaaacggcugucugccgcuaucggcaaggccugggaggagggggucugcggcauuagaagcgcgacccgccucgaaaacaucauguggaaacagauuuccaacgagcugaaucauauccuucuggaaaacgacaugaaguucaccgugguugugggagaugucgccggcauucucgcucaggggaaaaagaugauccggccgcaacccauggaguacaaauauucuuggaaaagcuggggaaaggccaagaucauuggcgcugacgugcagaauacaaccuuuaucauugaugggccuaacacgcccgaauguccugacgaucagagagccuggaauaucugggagguggaggacuacggauucggcauuuuuacaaccaacaucuggcugaagcugcgcgauuccuauacacaggucugcgaccaccggcuuaugagcgccgcuaucaaagauucuaaggcgguucacgccgacaugggcuacuggauugaauccgagaaaaaugaaaccuggaagcucgcuagagccagcuucaucgaggugaagacauguauuuggcccaaaucucauacccugugguccaacggggugcuggaaagcgagaugaucauuccgaagaucuauggaggcccuaucucucaacacaauuaccgccccggguacuucacgcagaccgccggaccuuggcaucucggcaaacuggagcuugauuuugaccugugcgaagggacaaccgucgugguugaugagcacugcggaaaccggggccccagccucagaacaaccacggugacaggcaagauuauccacgaaugguguugccgguccuguacccugccuccccugcgcuucagaggggaggacggaugcugguauggcauggagauucggccggucaaagaaaaggaggaaaaucuugucaagagcaugguuucugcuggguccggagagguggacagcuuuucccucggccugcuguguaucucuauuaugaucgaagaggucaugagaagccgcuggucccggaaaaugcucaugacagggacccuggccguguucuuucuucugauuaugggacagcucaccuggaacgaucugaucagacugugcaucaugguuggcgcgaaugcuucugaccgcaugggcauggggacaacguaccuugcccugauggccaccuucaagaugagaccuauguuugcugugggacuccuguuccggcgccucacaagcagagagguccugcuucugaccauuggccucucccugguggccucuguggaacugcccaacagccuugaggaacugggggauggacucgcgaugggcaucaugauucugaaacuccugacagacuuucaaucccaucagcuuugggcuacccugcucagccugacguucaucaagacaaccuuuucucugcacuaugccuggaaaaccauggccaugguccuuuccauuguuagccuguucccccucugucugucuacaaccucccagaagacaacguggcucccugugcugcuugggagccugggaugcaagccgcugaccauguuucucaucgcugagaauaaaaucuggggccggcgcucuuggccccugaacgaaggcauuauggccguggggaucgucuccauucuucugagcucccuccugaagaacgaugugccucucgcuggaccccugaucgccggcgggaugcuuauugcguguuacguuaucagcggaucuagcgccgaccugucccuggagaaagcugccgaggugucuugggaagaggaagcugagcauagcggcgccucccacaauauccucgucgaagugcaggaugacgggacaaugaagauuaaagaugaggagagagacgauacccugacaauccuucugaaggccacccuccuggcuguuucuggaguguauccucucagcauucccgcgacgcuguucgucugguacuucuggcagaaaaagaagcagcgguccggcgugcuuugggacaccccuucucccccggaagucgagcgcgccgugcuggaugacggcaucuauagaauuaugcagcgggggcugcucggacgcagccagguuggcgugggggucuuucaagaaaacguguuccauacaauguggcacguuaccagaggagcugugcugauguaccagggcaaacggcuugagccuuccugggccagcgucaagaaagaccugaucucuuacgggggaggcuggagacuccagggcuccuggaauacaggggaggaaguccaggugauugccguugagcccggaaagaacccuaaaaauguccaaaccgcucccggcacauuuaagacgccggaaggggaggugggagccaucgcgcuggauuucaagccuggcaccagcgggucucccaucgugaaccgcgaaggaaaaauugucggccucuauggcaauggggugguuacaaccuccggaaccuacgugagcgcuaucgcccaggccaaggcuucccaggagggcccucugcccgagauugaagacgaggucuuucggaaaagaaaccuuacaaucauggaucugcaccccgggucuggaaagacgcgccgguaucugccugccauugugagagaagcgaucaaacgcaagcuccggacccugauccuugcuccgacaagaguuguggccagcgagauggccgaagcucugaagggcaugcccauucgcuaccaaaccacagccgucaaauccgagcauaccgggaaggagaucguggaccucaugugccacgcuacguucacaaugcggcugcugagcccuguuagagugcccaauuauaacaugauuaucauggaugaagcccauuuuaccgacccuucuuccauugcggcccggggcuacaucagcacccgcgucggaaugggcgaggcugccgcuaucuucaugacagccacacccccugggucuguggaagccuuuccgcagagcaaugcugugauucaggaugaggaaagagacauccccgagcgguccuggaacucuggauaugaguggauuaccgauuucccuggcaaaaccgucugguuuguucccagcaucaaguccgggaaugacauugcgaacugucuccgcaaaaauggaaagagagugauccagcuuucucggaagacguucgauacagaauaccagaaaaccaagaacaacgacugggacuacguggucacaaccgauauuagcgagaugggcgccaauuucagagcugaccgcgugaucgauccucggagaugccugaaacccguuauccugaaggacgggccggaacgcgugauucucgccggcccuaugcccgucacgguggccuccgcugcccagcggagaggacgcaucggccggaaccacaauaaagagggggaucaguauauuuacaugggacagccccugaacaaugacgaggaucaugcgcacuggaccgaagcuaagaugcuucuggacaacaucaauacaccugagggcauuauccccgcccucuuugaaccugagagagaaaagagcgccgcuaucgauggggaguaucgccugagaggagaggcccggaaaaccuucguugaacugaugcgcagaggcgaccucccgguguggcuuucuuacaaggucgcguccgagggguuucaauauagcgaucggcgcuggugcuucgacggcgaaagaaacaaucaggugcuggaggaaaacauggaugucgagauuuggacaaaagagggagaacggaagaaacugagaccccgcuggcucgacgcccggaccuacuccgacccucuggcucuuagagaguuuaaggaguucgccgcuggccgccggucugugagcggggaucugauccucgagauuggaaaacugccccagcaccugacacagagagcccaaaaugcucucgacaaccuuguuaugcugcauaauuccgaacagggcgggcgggccuaucgccacgcgauggaggagcugccugauaccaucgaaacgcucaugcugcuugcccugauugcugugcucacaggaggcgugacccuguuuuuccugucuggcagagggcucggaaagaccagcaucggccuucugugugucauggccuccagcguucugcucuggauggcuucuguggagccccauuggaucgccgccuccauuauccuggaauuuuuccuuauggugcugcucauuccggagccugaccggcagcgcacaccccaggauaaccaacuggcuuacgucgugaucgggcugcucuuuaugauucuuaccguugcggccaaugagaugggacugcuggaaacaacgaagaaagaccucggcaucgggcacguggcugucgagaaccaccaucacgccgccaugcuggauguggaccuucauccugcuagcgccuggacccuguacgcggucgccacaaccauuaucacacccaugaugagacacaccaucgaaaacacgaccgcuaauauuucucucacagccaucgcuaaccaggccgcgauucugaugggacuggauaagggcuggccuaucuccaaaauggacauuggcgugccccuccuugcccuggggugcuauagccagguuaauccgcugacccucacagcugccgugcugaugcuugucgcucauuacgccaucaucggaccuggccugcaagcuaaggccacccgggaggcgcagaaacgcacggccgcugggauuaugaagaaccccacaguggauggaaucguugccauugaccucgaucccguggucuaugacgcuaaguucgaaaaacagcugggccagaucaugcugcucauucuuuguaccucucaaauccugcugaugagaacaaccugggcccucugcgagagcaucacccuggccacagggccucuuacgacccugugggagggauccccgggcaaguuuuggaauacaaccauugcggugucuauggcuaacaucuuccggggcagcuaccucgccggggcuggacuggccuucucccugaugaaaagccucggcgggggacgcagaggcacaggggcccagggagaaacccuuggcgagaaguggaaacggcagcugaaucagcuguccaagucugaauuuaacacguauaagagaagcggcauuauggagguggaccgcuccgaagcuaaagaggggcucaagcggggagagacaaccaaacacgccguuucuagaggcaccgcgaagcugcgcugguucgucgaacggaaucuugugaaacccgaggggaaggugaucgaucugggauguggcagagggggauggagcuacuauugcgccggccucaagaaagucacagaaguuaagggcuacaccaaagggggaccuggccacgaggaacccauuccuauggcuacauacggguggaaccuggugaagcugcauuccggaaaagacguguuuuucauucccccugagaagugugauacgcuccuuugcgacauuggcgagucuagcccgaaucccaccaucgaagaggggcgcacacugcggguccugaaaaugguggaaccuuggcucagaggaaaccaauuuuguaucaagauucugaaucccuauaugccuuccguuguggagacccuugagcagaugcagcgcaagcacggcggcaugcugguccggaacccccucagcagaaauucuacacaugaaauguacuggguguccugcgggaccggaaacaucguuagcgccgugaauaugacgucucgcaugcugcugaaccgguucaccauggcucacagaaaaccgacauaugagcgcgaugucgaccucggcgccgggaccagacacguggcgguggaaccugaggucgccaaccuggauauuaucggacagcggauugaaaauaucaagcaugagcacaaauccacauggcauuacgacgaggauaaccccuauaagaccugggcuuaccacggcagcuaugaaguuaaacccucuggguccgccagcuccauggugaauggaguggucaaacuucugacaaagccuugggacgugauccccaugguuacccaaauugcuaugacggauacaaccccuuuuggccagcagcgcguguucaaagagaaggucgacaccagaacaccgaaagccaagcggggcacggcucaaaucauggaagugaccgccaaauggcucuggggguuucugagcagaaacaagaagccccggauuuguacacgcgaggaguucaccagaaaaguucggucuaaugcggccaucggagcuguguuugucgacgagaaccaguggaauagcgccaaggaggcuguggaagaugagcgcuucugggaccuuguucauagagaacgggagcugcacaaacagggcaagugcgccacaugcguguacaacaugauggggaaacgcgaaaagaagcucggagaguuuggcaaagccaagggguccagagcgauuugguacauguggcugggcgcucgguuccuggaguucgaagcccucggauuuaugaaugaggaucacugguucucucgcgaaaacagccuguccggcgucgagggggagggacuucauaaacugggcuauauccucagagacaucucuaagauuccugggggaaauauguacgccgaugacaccgcuggcugggauacacggaucaccgaagacgaucugcagaacgaggcccgcauuacggacaucauggaacccgagcacgcccuucuggccaaaagcauuuuuaagcucaccuaucaaaauaaaguggucagagugcagcggccugcgaagaacgggacaguuauggaugugaucucccgcagagaccagcggggcucuggacaggucggcaccuacgggcugaauacauucaccaacauggaagcccaacugaucagacagauggagagcgagggaaucuuuucccccagcgaacucgagacgccgaaccuggcugaacgcgugcuugauuggcuggagaaguauggcguggaacggcucaaaagaauggccaucucuggggacgacuguguugugaagccuauugaugaccgcuucgcuacagcccugaccgcgcuuaaugauaugggaaaaguccggaaggacaucccccagugggagccuuccaaaggcuggaacgauuggcagcaagugcccuuuugcagccaucacuuccaccagcugauuaugaaggacgggagagagaucguugugccuugucgcaaucaggaugaacucgucggccgggccagagugucucagggagcuggcuggucccugcgcgagacagccugccugggaaagagcuacgcucaaauguggcagcucauguauuuucaucggagagaccugcgccuugccgcuaacgccauuuguuccgcgguccccguggauuggaucccgaccucucggacgaccuggagcauccacgcccaucaccaguggaugacaaccgaagacaugcuguccguuuggaauagaguguggauugaggaaaacccuuggauggaggauaaaacacauaucagcucuuggggagacguccccuaccucggcaagcgggaggaccaauggugcgggucccugauuggacuuaccgcuagagccacaugggccaccaauauccagguggcuauuaaccagguucgccggcugaucggcaaugaaaacuaccucgauuauaugacgagcaugaaaagauucaagaaugagucugaccccgaaggggcccugugguga

SEQ ID NO: 19271 - RNA, 9879 nt, Artificial Sequence
  derived and/or modified CDS sequence (opt5) from DENV-1__EU482800__SS-prME
agcgugaccaugcugcugaugcugaugcccacagcccuugcuuuccaccugacgaccagaggcggggagccucauaugaucgucuccaagcaagaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggccagcacagacgggacaagcgcucugucgcccucgcuccucauguggggcugggacuggagacaagaaccgagacguggaugagcuccgaaggcgccuggaaacagauucagcggguugagacaugggcucuccgccaccccggcuuuaccgugaucgcccuguuccuugcgcaugccauugggacaucuaucacccaaaagggaaucauuuuuauccugcucaugcuggucaccccuagcauggcuaugagaugcgugggcauugggucccgggauuucguugaaggacuuagcggcgccacauggguggacgucgugcuggagcacgggucuugugugacgaccauggcuaaggauaaacccacacucgacaucgagcugcugaagaccgaagucacaaacccugccguucuccgcaaacugugcauugaggcgaagaucuccaauaccacgauugauagcagauguccgacacagggagaagccacccuuguggaggaacaggacgcuaacuuugugugccggcgcaccuucgucgauagaggcuggggcaauggguguggacuguuuggcaaagggucucucaucacaugcgccaaguucaagugcgugaccaaacuggagggaaagacaguucaguacgagaaccuuaaauauuccgugaucgucacggugcacaccggcgaccaacaucagguugggaaugaaagcacagagcacggaaccacagcuaccauuacgccccaggccccuucuaccgaaauccagcugacagacuacggcgcccucacccuggauuguagcccccggacaggccuggacuuuaacgagauggugcuccugaccaugaaggagaaguccuggcuuguccauaagcaaugguuccuggaucucccucugcccuggacguccggggcuucuacaagccaggagaccuggaaucgcaaagaccuucuggugacauuuaagaccgcgcacgccaagaaacaggaggucgugguucucggaucccaagaaggcgcuaugcacaccgcccugacaggggccacggagauucagaccagcggaacaaccacaaucuucgcuggccaucugaagugcagacucaaaauggauaagcugacccuuaaagggaugucuuaugugauguguacgggcuccuucaagcuggaaaaggaggucgccgaaacacagcacggaaccgugcucguucagauuaaauacgagggcaccgacgcgccgugcaagaucccuuuuagcacacaagaugagaaaggggugacccagaacggacggcugaucacagcuaaucccauugucacggacaaggaaaaaccugugaacaucgaggccgaaccgcccuucggcgagucuuauauugugaucggggccggagagaaggcucugaaacuuagcugguuuaaaaagggcuccucuauugggaaaauguucgaagccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgagcucaaguguggguccggaaucuuugugacaaaugaaguccacaccuggacagagcaauauaaauuccaggccgacucuccuaagcggcugagcgcggccauuggcaaggcuugggaagagggggugugcggcaucagauccguuacccgccuggagaacaucauguggaagcagauuucuaacgaacucaaucauauccugcuugagaacgacaugaaauuuacgguggucgugggagauguggccggcauucuggcucaggggaagaaaaugauccggccgcaacccauggaauacaaguauagcuggaaguccuggggaaaagccaagauuaucggcgccgacguccagaauacaaccuucaucauugaugggccuaacacccccgaguguccugacgaucagagagcuuggaauaucugggaaguugaggacuacggauuuggcauuuucacaaccaacaucuggcucaaacugcgcgauagcuauacacaggugugcgaccaccggcugaugucugcggccauuaaggauuccaaagcugugcacgccgacaugggcuacuggaucgagagcgaaaagaaugagacguggaaacuugccagagcuucuuucaucgaagucaaaaccuguauuuggcccaagucccauacacucuggagcaacggggugcuggagucugaaaugaucauuccgaaaaucuauggaggcccuauuagccaacacaauuaccgccccggguacuuuacccagacagccggaccuuggcaucugggcaagcucgagcuggauuucgaccuuugcgaggggaccacgguuguggucgaugaacacugcggaaaccggggccccucccugagaaccacaaccgugacaggcaaaaucauccacgagugguguugccggagcuguacccucccuccccugcgcuuuaagggggaagacggaugcugguauggcauggagauuagaccgguuaaggagaaagaagagaaucuggugaagucuauggucuccgcggggagcggagaaguggacuccuucucucuuggccuccuguguaucagcauuaugaucgaggaaguuaugcgguccagauggucucgcaaaaugcugaugacggggacacucgcuguguuuuuccugcuuauuaugggacagcugaccuggaacgaucucauccggcugugcauuauggucggcgccaaugccagcgacagaaugggcauggggacaaccuaccuggcucuuauggccaccuuuaagaugcgcccuauguucgcggugggacugcucuuuagacggcugacaucccgcgaggugcuccugcuuacgaucggccugucucucgucgcuagcguugagcugcccaacucccuggaggaacuuggggauggacuggccaugggcaucaugauucucaaacugcucaccgacuuccaaagccaucagcugugggccacacuucugucucucaccuuuaucaagacaaccuucucccugcacuaugcuuggaagacgauggccauggugcugagcauugugucucuuuuuccccugugucucuccacaaccagccagaaaaccacauggcugccuguccuccuggggucucuuggaugcaagccgcugaccauguuccugaucgcugaaaauaaaauuuggggcagaaaguccuggccccucaacgagggcaucauggccguggggaucguuagcauucugcuuuccagccugcucaaaaacgaugugccucuggcgggaccccucaucgccggcgggaugcugauugcuuguuacgucaucucuggaagcuccgccgaccuuucucuggaaaaggcugccgaggugagcugggaggaagaggccgaacauuccggcgcuucucacaauauucugguugaggugcaggaugacgggacaaugaaaaucaaggaugaagaacgggacgauacgcucaccauccugcuuaaggcgacacugcucgccgucagcggaguguauccucuguccauucccgcuacccucuucgucugguacuuuuggcagaagaagaaacagcgcucuggcgugcugugggacacaccuagcccucccgagguugaaagagccgugcuugaugacggcaucuaucggauuaugcagcgcgggcugcugggaagaucccaggucggcguggggguuuuccaagagaacguguuucauaccauguggcacgucacgcggggagccgugcucauguaccagggcaagcgccuggaacccagcugggcuucugugaaaaaggaccuuaucuccuacgggggaggcuggagacugcagggcagcuggaauaccggggaggagguucaggucauugccguggaacccggaaagaacccuaaaaaugugcaaacagcgcccggcaccuucaagacaucugagggggaagucggagcuaucgcccucgauuuuaaaccgggcaccuccgggagcccuauugugaaccgggagggaaagaucguuggccuguauggcaaugggguggucacaacguccggaaccuacgugucugccaucgcucaggccaaagcgagccaggaaggcccccucccugagauugaggacgaaguuuucagaaagcgcaaccugacaaucauggaucuucaccccggguccggaaagacccggagauaucugcccgcuauugugcgcgaggccaucaaacggaagcugagaacccucauucuggccccuacacgcgucguggcuagcgaaauggccgaggcucuuaaaggcaugccgauccgguaccaaacgaccgccguuaagucugaacauacagggaaagagaucguggaccugaugugccacgcgaccuuuacaaugagacuccugucccccguccgcgugccuaauuauaacaugauuaucauggaugaggcccauuucaccgaccccagcucuauugcugcccggggcuacaucagcacgagagugggaaugggcgaagcugccgccauuuuuaugacagcuaccccucccggguccgucgaggcguucccucagucuaaugccguuauccaggaugaagaacgggacaucccggaacgcagcuggaacuccggauaugaguggauuaccgauuuucccggcaagacagugugguucgugccuucuaucaagagcgggaaugacauugcuaacugucugcgcaagaauggaaagcgggucauccagcucucccgcaaaaccuucgauacagaguaccaaaagaccaaaaacaacgacugggacuacgugguuacgacagauauuagcgaaaugggcgccaauuuuagagccgaccgggugaucgaucccagacgcugccuuaagccugucauucugaaggacgggcccgagcgggugauccuggcuggcccgaugccuguuaccguggccucugcggcucagagacgcggacggaucggcagaaaccacaauaaagaaggggaucaguauauuuacaugggacagccccucaacaaugacgaggaucaugcccacuggacagaggccaagaugcugcuugacaacaucaauacccccgaaggcauuaucccugcucuguucgagcccgaacgcgagaaauccgccgcgauugauggggaauaucggcucagaggagaggcccgcaagacguuugucgagcugaugagacggggcgaccugccuguguggcucagcuacaaagucgcuuccgaaggguuccaauauucugaucgcagauggugcuuugacggcgagcggaacaaucaggugcuugaagagaacauggauguugaaaucuggaccaaggagggagagcgcaaaaagcugagaccgcgguggcuggacgccagaacauacagcgacccccucgcucugcgcgaguucaaggaguuugccgcuggccggagauccgugucuggggaucuuauccuggaaauuggaaaacucccucagcaccugacccagcgcgcccaaaaugcgcuggacaaccucgugaugcuucauaauagcgagcagggcgggcgggccuauagacacgcuauggaagaacugcccgauacaaucgagacccugaugcuccuggcccuuauugcuguccugacaggaggcguuacccucuucuuucuguccggccgggggcugggaaagacgagcaucggccuccuuugugugauggccucuuccgugcugcuguggauggccagcgucgaaccucauuggauugcugcgucuaucauccucgaguucuuucugauggugcuucugauucccgaaccggaccgccagagaacaccucaggauaaccaacucgccuacguugugaucgggcugcuguucaugauucucaccgucgcugccaaugagaugggacuucuggagaccaccaaaaaggaccugggcaucgggcacguggccgucgaaaaccaccaucacgcugccaugcucgauguggaccugcaucccgcguccgccuggacccuuuacgcuguugccacaacgauuaucaccccuaugaugcggcacacaauugagaacaccacagcuaauaucagccugaccgccaucgcgaaccaggccgcuauucucaugggacuggauaaaggcuggcccaucucuaagauggacauuggcgugccucugcucgcccuugggugcuauagccaggucaauccccugacgcugaccgcugccgugcucaugcugguugcucauuacgccaucauuggaccgggccuucaagcgaaggccacacgcgaagcucagaaaagaaccgccgcugggaucaugaagaacccuacaguggauggaaucgucgccauugaccuggaucccgugguguaugacgccaaauuugagaagcagcucggccagaucaugcugcugauucucuguaccucccaaauccuucugaugcggacgacaugggcgcugugcgaaucuauuacccucgcuacagggccccugaccacccuuugggagggaagcccuggcaaauucuggaauacaacgaucgccguuuccauggcuaacaucuuccgcggcagcuaccuggccggggccggacucgcuuuuucccugaugaagucucugggcgggggaagacggggcaccggggcccagggagagacacucggcgaaaaguggaaacgccagcuuaaucagcugagcaaguccgaguucaacaccuauaaaagaucuggcauuauggaagucgaccggagcgaggcgaaggaagggcugaaaagaggagagacaaccaagcacgccgugucccgcggcacggcuaagcuccggugguuuguggagagaaaucuggucaaaccggaagggaagguuaucgaucuuggauguggccgcgggggauggucuuacuauugcgccggccugaaaaaggugacagaggugaaaggcuacaccaaagggggacccggccacgaggaaccuauucccauggcuaccuacggguggaaccucgucaaacugcauagcggaaaggacguguucuuuaucccucccgaaaagugugauacacugcucugcgacauuggcgaguccagcccuaauccgaccaucgaggaagggcggacacuuagaguucugaaaaugguggagcccuggcugcgcggaaaccaauucuguauuaagauccucaauccuuauaugcccucugucguggaaacgcuggagcagaugcagcggaaacacggcggcaugcuuguuagaaacccucugucccgcaauagcacccaugagauguacugggugucuugcgggacaggaaacaucgucuccgccgugaauaugaccagccggaugcuccugaacagauuuacaauggugcaccgcaagcccaccuaugaacgggaugucgaccugggcgcggggacgagacacguugccguggagccggaaguggcuaaccucgauauuaucggacagcgcauugagaauaucaaacaugaacacaagucuaccuggcauuacgacgaggauaacccuuauaagacaugggccuaccacggcuccuaugaggucaaacccagcggguccgcuagcucuauggugaauggaguugugaagcugcuuaccaaacccugggacgucauuccuauggugacacaaaucgccaugaccgauacaacccccuucggccagcagagaguuuuuaaggaaaaaguggacacgcggacaccuaaggcuaagcgcggcaccgcccaaaucauggaggucaccgcgaaauggcuguggggguuccucagcagaaacaagaaaccgcggauuuguacaagagaagaguuuacgcggaaggugcgcuccaaugccgcuaucggagccguuuucguggacgaaaaccaguggaacucugcuaaagaggccgucgaggaugaaagauuuugggaccuggugcaucgggagcgcgaacuucacaagcagggcaagugcgccacaugcgucuacaacaugauggggaaaagagagaagaaacugggagaguucggcaaggcgaaagggagccgggcuauuugguacauguggcucggcgcccgcuuccuggaguuugaggcccugggauucaugaaugaagaucacugguuuuccagagagaacucucucagcggcguggaaggggagggacugcauaaacuuggcuauauccugcgggacauuuccaaaauccccgggggaaauauguacgcugaugacacagccggcugggauacccgcaucacagaggacgaucuccagaacgaagcuaagauuaccgacaucauggagccugaacacgcccugcuugcgaagucuauuuucaaacugacauaucaaaauaagguugugagaguccagcggcccgccaaaaacgggaccgugauggaugugaucagccgcagagaccagcggggcuccggacagguuggcacguacgggcucaauaccuuuacaaacauggaggcucaacugauucgccagauggaaagcgagggaaucuucucuccuuccgagcuggaaacccccaaccucgccggcagaguguuugauuggcuggagaagcauggggucgaacggcuuaaaagaauggcuaucagcggagacgacugugugguuaagccgauugaugaccgcuucgccacagcgcugaccgcccucaaugauaugggcaaggugcggaaagacaucccucagugggagcccucuaagggguggaacgauuggcagcaagucccuuuuugcucccaccacuuccaucagcugauuaugaaagacggcagagaaaucgugguccccugucgcaaucaggaugagcuugugggacgggcuagaguuagccagggcgccggguggucccugcgcgagacggcuugccucggaaagucuuaugcccaaauguggcagcugauguacuuucaccggagagaccugcgccucgcugccaacgcgauuuguagcgccgugccugucgauugggugcccacaucccggaccacauggagcauccaugcucaccaucaguggaugaccacggaagacaugcugucuguuuggaauagaguguggauugaggaaaacccguggauggaggauaaaacccacaucuccagcuggggcgacgucccuuaucuugggaagcgcgaagaccaauggugcggaucucugaucggccucacagcccgggccaccugggcuacaaauauucagguggccaucaaccaggugagacggcugauugggaaugagaacuaccuugauuacaugaccagcaugaagagauucaaaaaugaguccgaccccgaaggcgcgcugugguga

SEQ ID NO: 19272 - RNA, 9879 nt, Artificial Sequence
  derived and/or modified CDS sequence (opt5) from DENV-1__EU482801__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugugggagaggaggcuggagcuacuauugcgccggccucaagaaaguuaccgaggugaagggguacacaaaaggaggcccugggcacgaggagcccauuccuauggcuaccuacggauggaaccuggugaagcugcauuccggcaaagacgucuuuuucauucccccugaaaagugugauacacuccuuugcgacauuggggagucuagcccgaaucccacgaucgaggaaggacgcacccugcgggugcugaaaaugguugagccuuggcucagaggcaaccaauuuuguauuaagauccugaaucccuauaugccuuccguggucgaaacacuugagcagaugcagcgcaagcacggcgggaugcuggugcggaacccccucagcagaaauucuacccaugagauguacuggguuuccugcggaacaggcaacaucgugagcgccgucaauaugaccucucgcaugcugcugaaccgguucacgauggcgcacagaaaaccgaccuaugaacgcgauguggaccucggggccggaacaagacacguggcugucgagccugaaguugccaaccuggauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuuguacccgcgaagaguucacaagaaaagugcggucuaaugcugccaucggcgcugucuuuguggacgaaaaccaguggaauagcgccaaggaggccguugaggaugaacgcuucugggaccuugugcauagagagcgggaacugcacaaacaggggaagugcgcgaccugcgucuacaacaugaugggaaaacgcgagaagaagcucggcgaauuugggaaagcuaagggcuccagagccauuugguacauguggcugggagcccgguuccuggaguucgaggcucucggcuuuaugaaugaagaucacugguucucucgcgagaacagccuguccgggguggaaggagagggccuucauaaacugggguauauccucagagacauuucuaauaucccuggaggcaacauguacgccgaugacacagcugggugggauacccggaucacagaggacgaucugcagaaugaagcccgcauuaccgacaucauggagcccgaacacgcgcuucuggccaagagcauuuuuaaacucacguaucaaaacaaggucgugagaguucagcggccugcuaaaaauggcaccgugauggaugucaucucccgcagagaccagcggggaucuggccagguggggacauacggacugaacaccuucacaaacauggaggcccaacugauuagacagauggaaagcgagggcaucuuuucccccagcgagcucgaaaccccgaaucuggcugagcgcgugcuugauuggcuggaaaaguaugggguugagcggcucaagagaauggccaucucuggagacgacuguguggucaaaccuauugaugaccgcuucgcgacggcccugacagcucuuaacgauaugggcaaggugcggaaagacaucccccagugggaaccuuccaagggguggaaugauuggcagcaaguucccuuuugcagccaucacuuccaccagcugauuaugaaagacggcagagagaucguggucccuugucgcaaccaggaugagcucgugggacgggccagagucucucagggcgcuggguggucccugcgcgaaaccgccugccugggaaagagcuacgcucaaauguggcagcucauguauuuucaucggagagaccugcgccuugccgcgaaugccauuuguuccgcugugcccguugauuggaucccgacaucucggaccacguggagcauucacgcccaucaccaguggaugaccacagaggacaugcuguccguguggaacagagucuggaucgaagagaauccuuggauggaagauaagacccauaucagcucuuggggcgacgugcccuaccucgggaaacgggaggaccaauggugcggaucccugauuggccuuacagccagagcuaccugggccacaaacauccagguugcgauuaaucaggugcgccggcugaucgggaacgagaauuaccucgauuauaugaccagcaugaagagauucaaaaacgaaucugaccccgagggcgcucugugguga

SEQ ID NO: 19273 - RNA, 9879 nt, Artificial Sequence
  derived and/or modified CDS sequence (opt5) from DENV-1__EU482802__SS-prME
agcgugaccaugcugcugaugcugaugcccaccgcccuugcuuuccaccugacgacccggggcggggaaccucauaugauugucuccaagcaggaacggggaaaaucucuccuguuuaagacaagcgccggcguuaacaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuucugccccucugucuguccaccaccagccagaaaacaaccuggcucccugugcugcuugggucucugggaugcaagccgcugacaauguuucucauugccgagaauaaaaucuggggcagaaaguccuggccccugaacgaaggcauuauggcggucgggaucgugagcauccuucuguccagccuccugaaaaacgauguuccucucgccggaccccugauugcuggcgggaugcuuaucgccuguuacgugauuucuggaagcuccgcugaccugucucuggagaaggccgccgaggucagcugggaagaggaagcugagcauuccggcgcgucucacaauauccucguggaaguucaggaugacgggacgaugaaaauuaaggaugaggagcgggacgauacccugacaauccuucugaaggccacccuccuggcugugagcggagucuauccucucuccauccccgccacacuguucgugugguacuucuggcagaaaaagaaacaacgcucuggcguccuuugggacaccccuuccccucccgaaguggagagagccguucuggaugacggcauuuaucggaucaugcagcgcgggcugcucggaagaucccaggugggcgucgggguguuucaggaaaacguuuuccauacgauguggcacgugacccggggagcuguccugauguaccaaggcaagcgccuugagcccagcugggccucugugaaaaaggaccugauuuccuacgggggaggcuggagacuccagggcagcuggaauacaggggaggaagugcagguuaucgcggucgagcccggaaagaacccuaaaaaugugcagaccgcucccggcacauuuaagaccucugaaggggaggugggagccauugcccuggauuucaaaccgggcacauccgggagcccuaucgucaaccgggaaggaaagauugugggccucuauggcaaugggguugugacgaccuccggaacauacgucucugcuaucgcccaagcgaaagcuagccaggagggcccccugccugagaucgaagacgagguguuuagaaagcgcaaccuuaccauuauggaucugcaccccggguccggaaagacccggagauaucugcccgccaucguucgcgaagccauuaaacggaagcucagaacacugauccuugcuccuacgcgcguggucgccagcgagauggcugaagcccugaaaggcaugccgauucgguaccagaccacagcggugaagucugagcauaccgggaaagagaucguugaccucaugugccacgccacauucaccaugagacugcugucccccgugcgcgucccuaauuauaacaugaucauuauggaugaagcucauuuuacggaccccagcucuaucgccgcucggggcuacauuagcacaagagugggaaugggcgaggccgccgcuaucuucaugaccgcgaccccucccggguccguggaagccuuuccucaaucuaaugcugucauucaggaugaggaacgggacaucccggagcgcagcuggaacuccggauaugaguggaucacagauuuccccggcaagaccguuugguuugugccuucuauuaagagcgggaaugacaucgccaacugucuccgcaagaauggaaagcgggugauucagcuuucccgcagaacauucgauaccgaauaccagaaaacgaagaacaacgacugggacuacgucgugacaaccgauaucagcgagaugggcgccaauuuccgggcugacagaguuauugauccccgccggugccugaaaccugugauccugaaggacgggcccgaaagagucauucucgccggcccgaugccugugacaguugcgucugcugcccaacgccggggaagaaucggccgcaaccacaauaaggagggggaucaguauaucuacaugggacagccccugaacaaugacgaggaucaugcccacuggaccgaagcuaaaaugcuucuggacaacauuaauacgcccgagggcaucauuccugcccucuuugaacccgagcgggaaaaguccgcggccaucgauggggaguauagacugcgcggagaggcuagaaaaaccuucguggaacugaugcggcgcggcgaccucccugucuggcuuagcuacaagguggccuccgagggguuucaguauucugauagacgguggugcuucgacggcgaacgcaacaaucaaguccuggaggaaaacauggauguggagauuuggacaaaagagggagaaagaaagaaacugcggccgagauggcucgacgcucgcaccuacagcgacccccuggcccuucgggaguuuaaggaguucgcugccggcagacgcuccguuucuggggaucugauccucgagaucggaaagcugccucagcaccugacacagcgggcgcagaaugcccucgacaaccuugugaugcugcauaauagcgaacaaggcgggagagcuuaucggcacgccauggaggagcugcccgauaccauugaaacacucaugcugcuugcucugaucgccgugcucaccggaggcgucacgcuguuuuuccuguccggccgcgggcucggaaaaacaagcauuggccuucuguguguuauggccucuuccgcucugcucuggauggcgagcguggagccucauuggaucgccgcuucuauuauccuggaauuuuuccuuauggugcugcucauccccgagccggacagacagcggaccccucaggauaaccagcuggccuacgucgugauugggcugcucuuuaugauccuuaccguugccgcuaaugagaugggacugcuggaaacaaccaagaaagaccucggcauugggcacguggccgucgagaaccaccaucacgcggccaugcuggauguggaccuucaucccgcuuccgccuggacacuguacgcugucgccacgaccaucauuacaccuaugaugcgccacaccaucgaaaacacaaccgcgaauauuagccucacggccaucgcuaaccaagccgcuauccugaugggacuggauaagggcuggcccauuucuaaaauggacaucggcgugccucuccuugcccuggggugcuauagccagguuaauccccugacccucacagcugccgugcugaugcuugucgcgcauuacgccauuaucggaccgggccugcaggcuaaggccaccagagaggcucaaaagcggacagccgccgggauuaugaaaaacccuaccguggauggaaucguugcgaucgaccucgaucccguggucuaugacgcuaaguucgaaaaacagcugggccagauuaugcugcucauccuuuguacgucccagauucugcugaugcgcacaaccugggcccucugcgagucuaucacacuggcuaccgggccccuuaccacacugugggagggaagcccuggcaaguuuuggaauacgaccauugccguguccauggccaacaucuucagaggcagcuaccucgcuggggccggacuggcguucucccugaugaaaucucucggcgggggacggcgcggcacaggggcccaaggagaaacccuuggcgagaaguggaagagacagcugaaucagcugagcaaauccgaauuuaacacauauaagcggucuggcaucauggagguggacagaagcgaagcuaaagaggggcucaagcgcggagagaccacgaaacacgccguuucccggggcacagcuaagcugagaugguucgucgaacgcaaucuugugaagccggaggggaaagugauugaucugggauguggcagagggggauggucuuacuauugcgccggccucaagaaagucaccgaaguuaagggcuacaccaaagggggacccggccacgaggaaccuauccccauggcgacauacggguggaaccuggugaagcugcauagcggaaaagacguguuuuucauuccucccgagaagugugauacccuccuuugcgacaucggcgaguccagcccuaauccgacaauugaagaggggagaacgcugcgcguccugaagaugguggaacccuggcuccggggaaaccaguuuuguaucaaaauucugaauccuuauaugcccucuguuguggagacccuugagcaaaugcagagaaagcacggcggcaugcugguccgcaacccucucucccggaauagcacacaugaaauguacugggugucuugcgggaccggaaacaucguuuccgccgugaauaugacaagcagaaugcugcugaaccgcuucaccauggcucaccggaaacccacguaugagagagaugucgaccucggcgccgggacccgccacguggcuguggaaccggaggucgccaaccuggauaucauuggacagagaaucgaaaauauuaagcaugagcacaaaucuacauggcauuacgacgaggauaacccuuauaagaccugggcuuaccacggcuccuaugaaguuaagcccagcggguccgccagcucuauggugaauggaguggucaaacuucugacaaagcccugggacgugaucccuaugguuacccagauugcgaugacagauaccacgcccuuuggccaacagcggguguucaaagagaaggucgacacacgcaccccuaaaagcaagagaggcaccgcccagaucauggaagugacagcuaaguggcucuggggguuucugucccggaacaaaaagccgagaaucuguacgcgggaggaguucacccgcaaaguuagaucuaaugccgcuauuggagccguguuugucgacgagaaccaauggaauagcgccaaggaggcgguggaagaugagcgguucugggaccuuguucaucgcgaaagagagcugcacaaacagggcaagugcgcuacaugcguguacaacaugauggggaagcgggagaaaaagcucggagaguuuggcaaagccaaggggucccgcgccaucugguacauguggcugggcgcuagauuccuggaguucgaagcccucggauuuaugaaugaggaucacugguucucucgggaaaacagccuguccggcgucgagggggagggacuucauaaacugggcuauauucuccgcgacaucucuaagauucccgggggaaauauguacgcugaugacaccgccggcugggauacaagaaucaccgaagacgaucugcagaacgaggcgaaaaucacagacauuauggaaccugagcacgcccuucuggcuaagagcaucuuuaagcucaccuaucagaauaaagugguccgggugcaacgccccgccaagaacgggacgguuauggaugugauuuccagacgggaccagcgcggcagcggacaggucggcaccuacgggcugaauacauucaccaacauggaagcucagcugaucagacaaauggagucugagggaaucuuuuccccuagcgaacucgagacacccaaccuggccggccgggugcuugauuggcuggaaaaacaugggguggagagacucaagcgcauggcgaucucuggagacgacuguguugugaaaccgaucgaugaccgguucgccaccgcucugacggcccuuaaugauaugggcaaggucagaaaggacauuccucagugggaacccuccaaaggguggaacgauuggcaacaggugccuuuuugcagccaccacuuccaucaacugaucaugaaggacggccgcgagauuguugugcccugucggaaucaggaugagcucgucggcagagcucgcgugucccagggagccggguggucucugcgggaaacagcuugccugggaaaaagcuaugcccagauguggcaacucauguacuuucacagacgcgaccugcggcuugcggccaacgcuaucuguuccgccgucccuguggauuggguucccaccagcagaacaaccuggucuauucaugcccaccaucaguggaugacgaccgaggacaugcuguccguguggaaucgcgucuggaucgaagagaacccguggauggaagauaagacacacauuagcucuuggggcgacgugccuuaucucgggaaacgggaggaccaguggugcggaagccugaucggccuuaccgcuagagccacaugggcgaccaauauccaaguugcuauuaaccaggugcggagacugaucgggaaugagaacuaccucgauuacaugacauccaugaagcgcuucaagaaugaaucugaccccgagggcgcccugugguga

SEQ ID NO: 19274 - RNA, 9879 nt, Artificial Sequence
  derived and/or modified CDS sequence (opt5) from DENV-1__EU482804__SS-prME
agcgugacaaugcugcugaugcugaugcccacagcccuugcuuuccaccugacgacaagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagguugugcaguacgaaaaccuuaaauauuccgucaucgugacgguucacaccggcgaccagcaucaaguggggaaugagagcacagaacacggaaccacagcuaccaucacgccccaggccccuucuaccgagauucagcugacagacuacggcgcccucacccuggauuguagcccccggacaggccuggacuuuaacgaaaugguccuccugaccaugaaggagaaaagcuggcuugugcauaagcagugguuccuggaucucccucugcccuggacguccggggcuucuacaagccaagagaccuggaaucgcaaagaccuucuggucacauuuaagaccgcgcacgccaagaaacaggaagugguugugcucggaucccaggagggcgcuaugcacaccgcccugacaggggccacggaaauccaaaccagcggaacaaccacaauuuucgcuggccaucugaagugcagacucaaaauggauaagcugacccuuaaagggaugucuuaugucauguguacgggcuccuucaagcuggagaaggaaguggccgagacacagcacggaaccguucucgugcagaucaaauacgagggcaccgacgcgccgugcaagauuccuuuuagcacacaggaugaaaaaggggucacccaaaacggacggcugaucacagcuaaucccaucgugacggacaaggagaaaccugugaacauugaagccgagccgcccuucggcgagucuuauaucguuauuggggccggagaaaaggcucugaaacuuagcugguuuaaaaagggcuccucuaucgggaaaauguucgaggccaccgcuagaggcgcccgccggauggcgauucucggagauacagccugggacuuuggcagcaucgggggagucuucaccuccgugggcaagcuggugcaucagaucuuugggacagcuuacggaguccuguucagcggcgugucuuggaccaugaaaauugggaucggcguucuccugacguggcuuggacucaauuccagaagcaccucucucuccaugacauguauugccgugggccuggucacccuguaccuuggggugaugguucaggcugauagcggaugcgugaucaacuggaagggccgcgaacucaaguguggguccggaauuuuugucacaaaugaggugcacaccuggacagaacaguauaaauuccaagccgacucuccuaagcggcugagcgcggccaucggcaaggcuugggaggaggggguuugcggcauuagauccaccacgcgccuggaaaacaucauguggaagcagaucucuaacgagcucaaucauauucugcuugaaaacgacaugaaauuuacaguggucgugggagauguggccggcauccuggcucaggggaagaaaaugauucggccgcagcccauggaguacaaguauagcuggaaguccuggggaaaagccaagaucauuggcgccgacguccaaaauaccaccuucaucaucgaugggccuaacacacccgaauguccugacgaucagagagcuuggaauauuugggagguugaggacuacggauuuggcaucuucaccacgaacauuuggcucaaacugcgcgauagcuauacacaggugugcgaccaccggcugaugucugcggccaucaaggauuccaaagcugugcacgccgacaugggcuacuggauugaaagcgagaagaaugaaaccuggaaacuugccagagcuucuuucaucgaggucaaaacauguaucuggcccaagucccauacccucuggagcaacggggugcuggaaucugagaugauuaucccgaaaauuuauggaggcccuaucagccagcacaauuaccgccccggguacuuuacacaaaccgccggaccuuggcaucugggcaagcucgagcuggauuucgaccuuugcgaagggacgaccguuguggucgaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccgguuaaggaaaaagaggaaaaucuggugaagucuauggucuccgcggggagcggagagguggacuccuucucucuuggccuccuguguauuagcaucaugauugaagagguuaugcgguccagauggucucgcaaaaugcugaugacagggacccucgcuguguuuuuccugcuuaucacaggacagcugaccuggaacgaucucauucggcugugcaucauggucggcgccaaugccagcgacagaaugggcauggggaccacauaccuggcucuuauggccacguuuaagaugcgcccuauguucgcggugggacugcucuuuagacggcugaccucccgcgaggugcuccugcuuacaauuggccugucucucgucgcuagcguugaacugcccaacucccuggaggaacuuggggauggacuggccaugggcaucaugauccucaaacugcucaccgacuuccagagccaucaacugugggccacacuucugucucucaccuuuauuaagacgacauucucccugcacuaugcuuggaagaccauggccauggugcugagcaucgugucucuuuuuccccugugucucuccaccacaagccagaaaaccacauggcugccuguccuccuggggucucuuggaugcaagccgcugacgauguuccugauugcugagaauaaaaucuggggcagaaaguccuggccccucaacgaaggcauuauggccguggggaucguuagcauccugcuuuccagccugcucaaaaacgaugugccucuggcgggaccccucauugccggcgggaugcugaucgcuuguuacgucauuucuggaagcuccgccgaccuuucucuggagaaggcugccgaggugagcugggaagaggaagccgagcauuccggcgcuucucacaauauccugguugaagugcaggaugacgggaccaugaaaauuaaggaugaggagcgggacgauacacucaccauccugcuuaaggcgacacugcucgccgucagcggaguguauccucuguccauccccgcuacccucuucgucugguacuuuuggcagaaaaagaaacaacgcucuggcgugcugugggacacgccuuccccucccgaaguugagagagccgugcuugaugacggcauuuaucggaucaugcagcgcgggcugcugggaagaucccaggucggcguggggguuuuccaggaaaacguguuucauaccauguggcacgucacacggggagccgugcucauguaccaaggcaagcgccuggagcccagcugggcuucugugaaaaaggaccuuauuuccuacgggggaggcuggagacugcagggcagcuggaauaccggggaggaaguucaggucaucgccguggagcccggaaagaacccuaaaaaugugcagacagcgcccggcaccuucaagacaucugaaggggaggucggagcuauugcccucgauuuuaaaccgggcacguccgggagcccuaucgugaaccgggaaggaaagauuguuggccuguauggcaaugggguggucaccacauccggaaccuacgugucugccaucgcucaagccaaagcgagccaggagggcccccucccugagaucgaagacgagguuuucagaaagcgcaaccugaccauuauggaucuucaccccggguccggaaagacacggagauaucugcccgcuaucgugcgcgaagccauuaaacggaagcugagaacgcucauccuggccccuacccgcgucguggcuagcgagauggccgaagcucuuaaaggcaugccgauucgguaccagacaaccgccguuaagucugagcauacagggaaagagaucguggaccugaugugccacgcgaccuuuacgaugagacuccugucccccguccgcgugccuaauuauaacaugaucauuauggaugaagcccauuucacagaccccagcucuaucgcugcccggggcuacauuagcaccagagugggaaugggcgaggcugccgccaucuuuaugaccgcuacaccucccggguccgucgaagcguucccucaaucuaaugccguuauucaggaugaggaacgggacaucccggagcgcagcuggaacuccggauaugaguggaucaccgauuuucccggcaagacagugugguucgugccuucuauuaagagcgggaaugacaucgcuaacugucugcgcaagaauggaaagcgggucauucagcucucccgcaaaaccuucgauacggaauaccagaagaccaagaauaacgacugggacuacgugguuaccacagauaucagcgagaugggcgccaauuuuagagccgaccgggugauugaucccagacgcugccuuaagccugucauccugaaggacgggcccgaacgggugauucuggcuggcccgaugccuguuaccguggccucugcggcucaaagacgcggacggaucggcagaaaccacaauaaagagggggaucaguauaucuacaugggacagccccucaacaaugacgaggaucaugcccacuggacggaagccaagaugcugcuugacaacauuaauacccccgagggcaucauuccugcucuguucgaacccgagcgcgaaaaauccgccgcgaucgauggggaguaucggcucagaggagaggcccgcaagacauuugucgaacugaugagacggggcgaccugccuguguggcucagcuacaaagucgcuuccgagggguuccaguauucugaucgcagauggugcuuugacggcgaacggaacaaucaagugcuugaggaaaacauggauguugagauuuggaccaaggagggagaacgcaaaaagcugagaccgcgguggcuggacgccagaacauacagcgacccccucgcucugcgcgaguucaaggaauuugccgcuggccggagauccgugucuggggaucuuauccuggagaucggaaaacucccucagcaccugacccagcgcgcccagaaugcgcuggacaaccucgugaugcuucauaauagcgaacaaggcgggcgggccuauagacacgcuauggaggagcugcccgauacaauugaaacccugaugcuccuggcccuuaucgcuguccugacgggaggcguuacacucuucuuucuguccggccgggggcugggaaagaccagcauuggccuccuuugugugauggccucuuccgugcugcuguggauggccagcgucgagccucauuggaucgcugcgucuauuauccucgaguucuuucugauggugcuucugauccccgagccggaccgccagagaaccccucaggauaaccagcucgccuacguugugauugggcugcuguucaugauccucacagucgcugccaaugagaugggacuucuggaaaccaccaagaaggaccugggcauugggcacguggccgcugagaaccaccaucacgccgcgaugcucgaugucgaccugcaucccgccuccgcuuggacgcuuuacgccguggcuaccacaaucauuaccccuaugaugcggcacacaaucgaaaacaccacggccaauauuagccugaccgcgaucgccaaccaagcugccauccucaugggacuggauaaaggcuggcccauuucuaagauggacaucggcguuccucugcucgcucuugggugcuauagccaggugaauccccugacacugaccgccgcuguccucaugcugguggcccauuacgcgauuaucggaccgggccuucaggccaaggcuacacgcgaggcccagaaaagaaccgcugccgggauuaugaagaacccuacgguugauggaaucguggccaucgaccuggaucccgucguguaugacgcgaaauuugaaaagcagcucggccagauuaugcugcugauccucuguacaucccagauucuucugaugcggaccacaugggcucugugcgagucuaucacccucgccaccgggccccugacaacgcuuugggagggaagcccuggcaaauucuggaauaccacaauugcuguguccauggccaacaucuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcaucauggagguugaccggagcgaagccaaggaggggcugaaaagaggagagacgacaaagcacgcugucucccgcggcaccgccaagcuccggugguuuguggaaagaaaucuggugaaaccggaggggaaggucauugaucuuggauguggccgcgggggauggucuuacuauugcgcuggccugaaaaagguuaccgaagugaaaggcuacacaaaagggggacccggccacgaggaaccuauccccauggccaccuacggguggaaccucgugaaacugcauagcggaaaggacgucuucuuuauuccucccgagaagugugauacacugcucugcgacaucggcgaguccagcccuaauccgacgauugaagaggggcggacccuuagagugcugaaaaugguugaacccuggcugcgcggaaaccaguucuguaucaagauucucaauccuuauaugcccucuguggucgagacacuggagcaaaugcagcggaaacacggcggcaugcuugugagaaacccucugucccgcaauagcacccaugaaauguacuggguuucuugcgggacaggaaacaucguguccgcggucaauaugaccagccggaugcuccugaacagauuuacgauggcccaccgcaagcccaccuaugagcgggauguggaccugggcgcugggacaagacacguggccgucgaaccggagguugcuaaccucgauaucauuggacagcgcaucgaaaauauuaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuaucccuauggugacacagauugccaugaccgauacgacacccuucggccaacagagagucuuuaaggagaaaguggacacccggaccccuaaggcgaagcgcggcacagcccagaucauggaaguuacggcuaaauggcuguggggguuccucagcagaaacaagaaaccgcggaucuguaccagagaggaauuuacacggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuaccugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacacagccggcugggauacccgcaucacagaagacgaucuccagaacgaggcgaagaucaccgacauuauggaaccugagcacgcccugcuugcuaagucuaucuucaaacugacguaucagaauaaggucgugagaguucaacggcccgccaaaaacgggaccgugauggaugucauuagccgcagagaccagcggggcuccggacaggugggcacauacgggcucaauaccuuuacaaacauggaagcucagcugauccgccaaauggagagcgagggaauuuucucuccuuccgaacuggagacccccaaccucgccggcagagugcuggauuggcuugaaaagcaugggguugagcggcugaaaagaauggcgaucagcggagacgacuguguggucaagccgaucgaugaccgcuuugccacggcucucacagcccugaaugauaugggcaaggugcggaaagacauuccucagugggaacccucuaagggguggaacgauuggcagcagguuccuuucugcucccaccacuuucaucaacuuaucaugaaagacggcagagagauugugguccccugucgcaaucaggaugagcuggugggacgggcuagagucagccagggcgccggguggucccuccgcgaaaccgcuugccugggaaagucuuaugcccagauguggcaacugauguacuuccaccggagagaccuccgccuggcggccaacgcuaucuguagcgccgugccuguugauugggugcccacaucccggaccacguggagcauucaugcccaccaucaguggaugaccacagaggacaugcuuucugucuggaauagaguguggaucgaagagaacccguggauggaagauaaaacccacauuuccagcuggggcgacguuccuuaucuggggaagcgcgaggaccaguggugcggaucucucaucggccugacagcucgggccaccugggcgacaaauauccaaguggcuauuaaccaggucagacggcuuaucgggaaugagaacuaccuggauuacaugaccagcaugaagagauuuaaaaaugaauccgaccccgagggcgcccucugguga

SEQ ID NO: 19275 - RNA, 9879 nt, Artificial Sequence
  derived and/or modified CDS sequence (opt5) from DENV-1__EU482806__SS-prME
agcgugaccaugcugcucaugcugaugcccaccgcccuugcuuuccaccugacgacccggggcggggaaccucauaugauugucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguacccucuuagcauccccgcuacacuguucgucugguauuuuuggcaaaagaaaaagcagcgcuccggcgugcugugggacaccccuucucccccggaaguugagagagccgugcucgaugacggcauuuaccggaucaugcagcgcgggcugcuuggaagaagccaggucggcguggggguuuuccaagaaaacguguuccacacgauguggcacgucacccggggagccgugcugauguaucagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauuuaaaaccccggaaggggaggucggagcuauugcccuggauuucaagccuggcacaagcgggucucccaucgugaaccgggaaggaaaaauuguuggccuuuacggcaaugggguggucacgaccuccggaacauaugugagcgccaucgcucaggccaaggcgucccaggagggcccucugcccgagaucgaagacgagguuuuuagaaaacgcaaccugaccauuauggaucuccaucccgggucuggaaagacccggagauaccugccugcuaucgugcgcgaagccauuaagcggaaacuuagaacacugauccucgccccgacgcgcgucguggcuagcgagauggccgaagcucugaagggcaugcccauucgguaucaaaccacagccguuaaauccgagcacaccgggaaggagaucguggaccugaugugccaugcgacauucaccaugagacuccuuagcccuguccgcgugcccaauuacaacaugaucauuauggaugaagcccacuuuacggacccuucuuccaucgcugcccggggcuauauuagcacaagagugggaaugggcgaggcugccgccaucuucaugaccgcuacacccccugggucugucgaagcguuuccgcagagcaaugccguuauucaggaugaggaacgggacauccccgagcgcuccuggaacucuggauacgaguggaucacagauuucccuggcaaaaccgugugguuugugcccagcauuaaguccgggaaugacaucgcuaacugucugagaaagaauggaaaacgggucauucagcugucucgcaagacauucgauaccgaauaucagaagacgaagaacaacgacugggacuacgugguuacaaccgauaucagcgagaugggcgccaauuuuagagccgaccgggugauugauccuagacgcugccucaaacccgucauccugaaggacgggccggaacgggugauucuugcuggcccuaugcccguuacaguggccuccgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaagagcgccgcgaucgauggggaguaccggcucagaggagaggcccgcaaaaccuucgucgaacuuaugagacggggcgaccugccgguguggcugucuuauaaggucgcuuccgagggguuucaauacagcgaucgcagauggugcuucgacggcgaacggaacaaucaggugcucgaggaaaacauggauguugagauuuggacaaaagagggagaacgcaagaaacugagaccccgguggcuugacgccagaaccuauuccgacccucuggcucuccgcgaguuuaaggaguucgccgcuggccggagaucugugagcggggaucugauccuggagaucggaaagcucccccagcaucuuacacagcgcgcccaaaaugcgcuggacaaccuggugaugcuccacaauuccgaacagggcgggcgggccuacagacaugcuauggaggagcugccugauaccauugaaacacuuaugcugcucgcccugaucgcuguccugaccggaggcguuacgcucuuuuuccuuucuggccgggggcugggaaaaacaagcauuggccugcucugugugauggccuccagcgugcugcuuuggauggccucugucgagccccacuggaucgcugcguccauuauccuggaauuuuuccucauggugcugcugaucccggagccugaccgccagagaacaccccaggauaaccaacucgccuauguugugauugggcuucuguuuaugauccugaccgucgcugccaaugagaugggacuccuggaaacaaccaagaaagaccuuggcauugggcacguggccgucgagaaccaucaccaugcuacaaugcuggauguggaccuccacccugccagcgcguggacgcuguacgccguugcuaccacaaucauuacccccaugaugcggcauacaaucgaaaacaccacggccaauauuucucugaccgcuaucgccaaccaggcggccauccucaugggacuugauaagggcuggccuauuuccaaaauggacaucggcgugccccugcuggcucucgggugcuacagccaggucaauccgcugacacuuaccgccgcugugcugaugcucguugcccacuaugcuauuaucggaccuggccugcaagccaaggcgacacgcgaggcccagaagagaaccgcugccgggauuaugaaaaaccccacgguggauggaaucgucgcuaucgaccuggaucccgugguguacgacgccaaguucgaaaaacagcucggccagauuaugcuucugauccuguguacaucucaaauucuccugaugcggaccacaugggcccuuugcgagagcaucacccuggcgaccgggccucucacaacgcugugggagggauccccgggcaaguuuuggaauaccacaauugcuguuucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcauuauggaggucgaccgguccgaagccaaagaggggcuuaagagaggagagaccacgcgccacgcggugucucggggcacagccaaacugagaugguucguggaacgcaaucucgucaagcccgaggggaagguuaucgaucugggauguggcagagggggauggagcuauuacugcgcuggccugaaaaaggugaccgaagugaaaggcuauaccaaagggggaccuggccaugaggaacccauuccuauggccacauacggguggaaccucgucaaacuucacuccggaaaggacguguuuuucacacccccugagaaaugugauacacugcugugcgacaucggcgagucuagcccgaaucccacgauugaagaggggagaacccuccgcguucugaagaugguggaaccuuggcuucggggaaaccaauuuuguaucaagauucugaaucccuacaugccuuccgucguggagacacucgagcagaugcagagaaaacauggcggcaugcugguucgcaacccccugagcagaaauucuacccacgaaauguauuggguguccugcgggacaggaaacaucgucagcgcugugaauaugaccucuagaaugcuccugaaccgcuucacgauggcccaccggaagccgaccuacgagagagauguggaccuuggcgcggggacacgccaugucgccguugaaccugagguggcuaaccuggauaucauuggacagagaaucgaaaauauuaaacacgagcauaaguccaccuggcacuaugacgaggauaaccccuacaaaacaugggccuaucauggcagcuacgaagugaagcccucuggguccgcuagcuccauggucaauggagugguuaagcuccugaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuuuggggguuucugagcagaaacaagaagccccggaucuguacccgcgaggaguucacaagaaaaguccggucuaaugccgcuauuggagccguguuuguugacgagaaccaguggaauagcgcuaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcgucgagggggagggacuccauaagcugggcuacauucuucgcgacaucucuaaaauuccugggggaaauauguaugcugaugacacagccggcugggauaccagaaucacagaagacgaucugcaaaacgaggcuaagaucaccgacauuauggaacccgagcacgcccuccuggcgacgagcaucuuuaaacugaccuaccagaauaaggugguucgggugcagcgcccugccaagaacgggacagucauggaugugauuuccagacgggaccagcgcggcucuggacaagugggcaccuaugggcucaauacauucaccaacauggaagcucagcugaucagacagauggagagcgagggaaucuuuucccccugugaacuugagaucccgaaccuggccgaacggguucucgauuggcuggagaaauacggcguggaaagacuuaagcgcauggcuaucagcggggacgacugcgucgugaaaccuauugaugaccgguucgccacggcgcugacagcccucaaugauaugggaaagguuagaaaagacgugccccagugggagccuucuaagggcuggaacgauuggcaacagguccccuuuuguucccaucacuuccaccagcugaucaugaaggacgggcgcgagauuguggucccuugccggaaucaggaugaacuggugggcagagcucgcguuagccaaggagccggcuggucucuccgggagaccgcuugucuggggaaauccuaugcccagauguggcagcuuauguacuuucauagacgcgaccugcggcucgcugccaacgcgaucugcagcgccgugcccgucgauugggugccgacauccagaaccacguggucuauucacgcucaucaccaauggaugaccacagaagacaugcugagcguuuggaaucgcguguggaucgaggaaaacccuuggauggaggauaagacccaugucuccagcuggggagacgugcccuaucuuggcaaacgggaggaccaguggugugggucucugauuggacucacagccagagccaccugggcuuccaauauccagguggccaucaaccagguucggagacugauuggcaaugaaaacuaccuggauuacaugacaagcaugaagcgcuucaaaaaugagggggaccccgaaggcgcgcucugguga

SEQ ID NO: 19276 - RNA, 9879 nt, Artificial Sequence
  derived and/or modified CDS sequence (opt5) from DENV-1__EU482807__SS-prME
agcgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaauaugugcacccuuguggcgauggaccugggggaguucugugaagauacaaugaccuacaaaugcccgcgcaucacagaagcugaacccgacgauguggacuguuggugcaaugccaccgauacgugggucaccuauggaacauguucccagaccggcgagcaccggcgggacaagcgcucuguggcccucgcuccucauguugggcugggacuggagacaagaaccgaaacguggaugagcuccgagggcgccuggaaacagauccagcggguggaaacaugggcucuccgccaccccggcuuuaccgucauugcccuguuccuugcgcaugccaucgggacaucuauuacccagaagggaaucaucuuuauucugcucaugcuggugaccccuagcauggcuaugagaugcguuggcaucgggucccgggauuucguggagggacuuagcggcgccacaugggucgacguggugcuggagcacgggucuugugucacgaccauggcuaaggauaaacccacacucgacauugaacugcugaagaccgagguuacaaacccugccgugcuccgcaaacugugcaucgaagcgaagauuuccaauaccacgacagauagcagauguccgacccaaggagaggccacccuuguggaagaacaggacgcuaacuuugucugccggcgcacauucguggauagaggcuggggcaauggguguggacuguuuggcaaagggucucucauuaccugcgccaaguucaagugcguuacaaaacuggagggaaagacggugcaguacgaaaaccuuaaauauuccgucauugugaccguucacacaggcgaccagcaucaaguggggaaugagagcaccgaacacggaacaaccgcuacgaucacaccccaggccccuucuacagagauccagcugaccgacuacggcgcccucacacuggauuguagcccccggaccggccuggacuuuaacgaaaugguccuccugacgaugaaggagaaaagcuggcuugugcauaagcagugguuccuggaucucccucugcccuggacauccggggcuucuaccagccaagagacauggaaucgcaaagaccuucuggucaccuuuaagaccgcgcacgccaagaaacaggaagugguugugcucggaucccaggagggcgcuaugcacacagcccugacgggggccaccgaaauucaaacaagcggaaccacaaccaucuucgcuggccaucugaagugcagacucaaaauggauaagcugacgcuuaaagggaugucuuaugucauguguacaggcuccuucaagcuggagaaggaaguggccgagacccagcacggaaccguucucgugcagauuaaauacgagggcacagacgcgccgugcaagaucccuuuuagcacccaggaugaaaaaggggucacacaaaacggacggcugauuacggcuaaucccaucgugaccgacaaggagaaaccugugaacaucgaagccgagccgcccuucggcgagucuuauauuguuaucggggccggagaaaaggcucugaaacuuagcugguuuaaaaagggcuccucuauugggaaaauguucgaggccacagcuagaggcgcccgccggauggcgauccucggagauaccgccugggacuuuggcagcauugggggagucuucacauccgugggcaagcuggugcaucagaucuuugggaccgcuuacggaguccuguucagcggcgugucuuggacgaugaaaaucgggauuggcguucuccugaccuggcuuggacucaauuccagaagcacaucucucuccaugaccuguaucgccgugggccuggucacacuguaccuuggggugaugguucaggcugauagcggaugcgugauuaacuggaagggccgcgaacucaaguguggguccggaaucuuugucaccaaugaggugcacacauggaccgaacaguauaaauuccaagccgacucuccuaagcggcugagcgcggccauuggcaaggcuugggaggaggggguuugcggcaucagauccgccacgcgccuggaaaacauuauguggaagcagaucucuaacgagcucaaucauauccugcuugaaaacgacaugaaauuuacaguggucgugggagauguggcuggcauucuggcccaggggaagaaaaugauccggccgcagcccauggaguacaaguauagcuggaaguccuggggaaaagccaagauuaucggcgcugacguccaaaauaccaccuucauuaucgaugggccuaacacacccgaauguccugacgaucagagagcguggaauaucugggagguugaggacuacggauuuggcauuuucaccacgaacaucuggcucaaacugcgcgauagcuauacacaggugugcgaccaccggcugaugucugccgcuauuaaggauuccaaagccgugcacgccgacaugggcuacuggaucgaaagcgagaagaaugaaaccuggaaacuugcuagagccucuuucauugaggucaagacauguaucuggcccaagucccauacccucuggagcaacggggugcuggaaucugagaugaucauuccgaaaaucuauggaggcccuauuagccagcacaauuaccgccccggguacuuuacacaaaccgcgggaccuuggcaucugggcaagcucgagcuggauuucgaccuuugcgaagggacgaccguuguggucgaugagcacugcggaaaccggggccccucccugagaacaaccacagugaccggcaaaaucauucacgaaugguguugccggagcuguacgcucccuccccugcgcuuuaagggggaggacggaugcugguauggcauggagaucagaccgguuaaggaaaaagaggaaaaucuggugaagucuauggucuccgcugggagcggagagguggacuccuucucucuuggccuccuguguaucagcauuaugaucgaagagguuaugcgguccagauggucucgcaaaaugcugaugacagggacccucgccguguuuuuccugcuuauuaucggacagcugacauggaacgaucucauucggcugugcaucauggucggcgccaaugcuagcgacagaaugggcauggggaccaccuaccuggcccuuauggcgacauuuaagaugcgcccuauguucgcugugggacugcucuuuagacggcugacgucccgcgaggugcuccugcuuaccauuggccugucucucgucgccagcguugaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuauggugcugagcaucgugucucuuuuuccccugugucucuccaccaccagccagaaaacaaccuggcugccuguccuccuggggucucuuggaugcaagccgcugacaauguuccugauugccgagaauaaaaucuggggcagacgguccuggccccucaacgaaggcauuauggcgguggggaucguuagcauccugcuuuccagccugcucaagaacgaugugccucuggccggaccccucauugcuggcgggaugcugaucgccuguuacgucauuucuggaagcuccgcugaccuuucucuggagaaagccgccgaggugagcugggaagaggaagcugagcauuccggcgcgucucacaauauccugguugaagugcaggaugacgggacgaugaagauuaaagaugaggagcgcgacgauacccucacaauccugcuuaaggccacccugcucgcugucagcggaguguauccucuguccauccccgccacacucuucgucugguacuuuuggcagaagaaaaagcaaagaucuggcgugcugugggacaccccuuccccucccgaaguugagcgggccgugcuugaugacggcauuuaucgcaucaugcagagagggcugcugggacggucccaggucggcguggggguuuuccaggaaaacguguuucauacgauguggcacgucacccgcggagcugugcucauguaccaaggcaaaagacuggagcccagcugggccucugugaagaaagaccuuauuuccuacgggggaggcuggcggcugcagggcagcuggaauacaggggaggaaguucaggucaucgcgguggagcccggaaagaacccuaagaaugugcagaccgcucccggcacauucaaaaccucugaaggggaggucggagccauugcccucgauuuuaagccgggcacauccgggagcccuaucgugaacagagaaggaaaaauuguuggccuguauggcaaugggguggucacgaccuccggaacauacgugucugcuaucgcccaagcgaaggcuagccaggagggcccccucccugagaucgaagacgagguuuuccgcaaacggaaccugaccauuauggaucuucaccccggguccggaaagaccagacgcuaucugcccgccaucgugcgggaagccauuaagagaaaacugcgcacacucauccuggcuccuacgcgggucguggccagcgagauggcugaagcccuuaagggcaugccgauuagauaccagaccacagcgguuaaaucugagcauaccgggaaggagaucguggaccugaugugccacgccacauuuaccaugcgccuccugucccccguccgggugccuaauuauaacaugaucauuauggaugaagcucauuucacggaccccagcucuaucgccgcuagaggcuacauuagcacacgggugggaaugggcgaggccgccgcuaucuuuaugaccgcgaccccucccggguccgucgaagccuucccucaaucuaaugcuguuauucaggaugaggaacgcgacaucccggagagaagcuggaacuccggauaugaguggaucacagauuuucccggcaaaaccgugugguucgugccuucuauuaagagcgggaaugacaucgccaacugucugcggaagaauggaaaacgcgucauucagcucuccagaaagacauucgauaccgaauaccagaaaacgaagaacaacgacugggacuacgugguuacaaccgauaucagcgagaugggcgccaauuuucgggcugacagagugauugauccccgccggugccuuaaaccugucauccugaaggacgggcccgaaagagugauucuggccggcccgaugccuguuacaguggcgucugcugcccaacgccggggaagaaucggccgcaaccacaauaaggagggggaucaguauaucuacaugggacagccccucaacaaugacgaggaucaugcccacuggaccgaagcuaaaaugcugcuugacaacauuaauacgcccgagggcaucauuccugcccuguucgaacccgagcgggaaaaguccgcggccaucgauggggaguauagacuccgcggagaggcuagaaaaaccuuugucgaacugaugcggcgcggcgaccugccuguguggcucagcuacaaggucgccuccgagggguuccaguauucugauagacgguggugcuuugacggcgaacgcaacaaucaagugcuugaggaaaacauggauguugagauuuggacaaaagagggagaaagaaagaaacugcggccgagauggcuggacgcucgcaccuacagcgacccccucgcccugcgggaguucaaggaauuugcugccggcagacgcuccgugucuggggaucuuauccuggagaucggaaagcucccucagcaccugacacagcgggcgcagaaugcccuggacaaccucgugaugcuucauaauagcgaacaaggcgggagagcuuaucggcacgccauggaggagcugcccgauaccauugaaacacugaugcuccuggcucuuaucgccguccugaccggaggcguuacgcuguucuuucuguccggccgcgggcugggaaaaacaagcauuggccuccuuugugugauggccucuuccgugcugcuguggauggcuagcgucgagccucauuggaucgcggccucuauuauccucgaguucuuucugauggugcuucugauccccgagccggacagacagcggaccccucaggauaaccagcucgcuuacguugugauugggcugcuguucaugauccucaccgucgccgccaaugagaugggacuucuggaaacaaccaagaaagaccugggcauugggcacguggcugucgagaaccaccaucacgccgcgaugcucgauguggaccugcaucccgccuccgcuuggacacuuuacgccguugcuacgaccaucauuacaccuaugaugcgccacaccaucgaaaacacaaccgccaauauuagccugacggcgaucgccaaccaagcugccauccucaugggacuggauaagggcuggcccauuucuaaaauggacaucggcgugccucugcucgcucuugggugcuauagccaggucaauccccugacccugacagccgcugugcucaugcugguugcccauuacgcgauuaucggaccgggccuucaggccaaggcuaccagagaggcccaaaagcggacagcugccgggauuaugaaaaacccuaccguggauggaaucgucgccaucgaccuggaucccgugguguaugacgcgaaguuugaaaaacagcucggccagauuaugcugcugauccucuguacgucccagauucuucugaugcgcacaaccugggcucugugcgagucuaucacacucgccaccgggccccugaccacacuuugggagggaagcccuggcaaguucuggaauacgaccauugcuguuuccauggccaacaucuucagaggcagcuaccuggccggggcuggacucgccuuuucccugaugaaaucucugggcgggggacggcgcggcacaggggcgcaaggagaaacccucggcgagaaguggaagagacagcuuaaucagcugagcaaauccgaguucaacacauauaagcggucuggcaucauggaggucgacagaagcgaagccaaagaggggcugaagcgcggagagaccacgaaacacgcugugucccggggcacagccaagcucagaugguuuguggaacgcaaucuggucaagccggaggggaaaguuauugaucuuggauguggcagagggggauggucuuacuauugcgcuggccugaagaaagugaccgaagugaagggcuacaccaaagggggacccggccacgaggaaccuauccccauggccacauacggguggaaccucgucaagcugcauagcggaaaagacguguucuuuauuccucccgagaagugugauacccugcucugcgacaucggcgaguccagcccuaauccgacaauugaagaggggagaacgcuucgcguucugaagaugguggaacccuggcugcggggaaaccaguucuguaucaaaauucucaauccuuauaugcccucugucguggagacccuggagagaaugcaacgcaagcacggcggcaugcuuguucggaacccucuguccagaaauagcacacaugaaauguacugggugucuugcgggaccggaaacaucgucuccgcggugaauaugacaagccgcaugcuccugaaccgguuuaccauggcccacagaaaacccacguaugagcgcgauguggaccugggcgcugggaccagacacgucgccguugaaccggagguggcuaaccucgauaucauuggacagcggaucgaaaauauuaagcaugagcacaaaucuacauggcauuacgacgaggauaacccuuauaagaccugggccuaccacggcuccuaugaagugaagcccagcggguccgcuagcucuauggucaauggagugguuaaacugcuuacaaagcccugggacgugaucccuauggucacccagauugccaugacagauaccacgcccuucggccagcaacgcguguuuaaagagaagguugacacaagaaccccuaaagcgaagcggggcaccgcccagaucauggaagugacagcuaaguggcuguggggguuccucagcagaaacaaaaagccgcggaucuguacgcgcgaggaauuuaccagaaaaguccgguccaaugccgcuauuggagccguguucguugacgagaaccaguggaacucugccaaggaggcgguggaagaugagcgcuuuugggaccugguccauagagaacgggagcuucacaaacaaggcaagugcgcuacaugcguguacaacaugauggggaagcgcgagaaaaagcugggagaguucggcaaagccaaggggagcagagccaucugguacauguggcucggcgcucgguuccuggaguuugaagcccugggauucaugaaugaggaucacugguuuucccgcgaaaacucucucagcggcgucgagggggagggacugcauaaacuuggcuauauucugagagacaucuccaagauucccgggggaaauauguacgcugaugacaccgccggcugggauacacggaucaccgaagacgaucuccagaacgaggcgaaaaucacagacauuauggaaccugagcacgcccugcuugcuaagucuaucuucaagcugaccuaucagaauaaagugguucgcgugcagagacccgccaagaacgggacggucauggaugugauuagccggcgcgaccaaagaggcuccggacaggugggcaccuacgggcucaauacauuuaccaacauggaagcucagcugauccggcagauggagagcgagggaauuuucucuccuuccgaacuggagacacccaaccucgccggcagaguucuggauuggcuugaaaaacaugggguggagcgccugaagcggauggcgaucagcggagacgacugugucgugaaaccgaucgaugacagauuugccaccgcucucacggcccugaaugauaugggcaagguucgcaaggacauuccucaaugggaacccucuaaaggguggaacgauuggcaacaggugccuuucugcucccaccacuuucaucagcuuaucaugaaggacggccgggagauugucgugcccuguagaaaucaagaugagcuggucggacgcgcucgggugagccagggcgccggguggucccucagagaaacagcuugccugggaaaaucuuaugcccagauguggcagcugauguacuuccaccgccgggaccucagacuggcggccaacgcuaucuguagcgccguuccuguggauuggguccccaccucccgcacaaccuggagcauucaugcccaccaucaauggaugacgaccgaggacaugcuuucuguguggaaucggguuuggaucgaagagaacccguggauggaagauaagacacacauuuccagcuggggcgacgugccuuaucuggggaaaagagaggaccaguggugcggaucucucaucggccugaccgcucgggccacaugggcgaccaauauccaggucgcuauuaaccaagugagacgccuuaucgggaaugagaacuaccuggauuacaugacaagcaugaagcgguuuaagaaugaauccgaccccgagggcgcccucugguga

SEQ ID NO: 19277 - RNA, 9879 nt, Artificial Sequence
  derived and/or modified CDS sequence (opt5) from DENV-1__EU482808__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuaccccucccgagaagugugauacacugcucugcgacauuggcgaguccagcccuaauccgacgaucgaagaggggcggacccuuagagugcugaaaaugguugaacccuggcugcgcggaaaccaguucuguauuaagauccucaauccuuauaugcccucuguggucgagacacuggagcaaaugcagcggaaacacggcggcaugcuugugagaaacccucugucccgcaauagcacccaugaaauguacuggguuucuugcgggacaggaaacauuguguccgcggucaauaugaccagccggaugcuccugaacagauuuacgauggcccaccgcaagcccaccuaugagcgggauguggaccugggcgcugggacaagacacguggccgucgaaccggagguugcuaaccucgauaucaucggacagcgcauugaaaauaucaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuauuccuauggugacacagaucgccaugaccgauacgacacccuucggccaacagagagucuuuaaggagaaaguggacacccggaccccuaaggcgaagcgcggcacagcccagauuauggaaguuacggcuaaauggcuguggggguuccucagcagagacaagaaaccgcggaucuguaccagagaggaauuuacacggaaggugcgcuccaacgccgcuaucggagccgucuucguggaugagaaucaauggaacucugccaaagaggcgguugaagacgagagauuuugggaucuggugcaucgggaacgcgagcuucacaagcagggcaagugcgcuaccugcgucuacaauaugauggggaaaagagaaaagaaacugggagaguucggcaaggccaaagggagccgggccauuugguacauguggcucggcgcucgcuuccuggaguuugaagcccugggauucaugaacgaggaccacugguuuuccagagaaaauucucucagcggcguggagggggagggacugcauaaacuuggcuauauccugcgggauauuuccaaaauccccgggggaaacauguacgcugacgauacagccggcugggacacccgcauuacagaagaugaccuccagaaugaggcgaagaucaccgauaucauggaaccugagcacgcccugcuugcuaagucuauuuucaaacugacguaucagaacaaggucgugagaguucaacggcccgccaaaaaugggaccgugauggacgucaucagccgcagagaucagcggggcuccggacaggugggcacauacgggcucaacaccuuuacaaauauggaagcucagcugauucgccaaauggagagcgagggaaucuucucuccuuccgaacuggagacccccaaccucgccggcagagugcuggacuggcuugaaaagcaugggguugagcggcugaaaagaauggcgauuagcggagacgauuguguggucaagccgaucgacgaucgcuuugccacggcucucacagcccugaacgacaugggcaaggugcggaaagauaucccucagugggaacccucuaagggguggaaugacuggcagcagguuccuuucugcucccaccacuuucaucaacuuauuaugaaagauggcagagagaucgugguccccugucgcaaccaggacgagcuggugggacgggcuagagucagccagggcgccggguggucccuccgcgaaaccgcuugccugggaaagucuuaugcccagauguggcaacugauguacuuccaccggagagaucuccgccuggcggccaaugcuauuuguagcgccgugccuguugacugggugcccacaucccggaccacguggagcauccaugcccaccaucaguggaugaccacagaggauaugcuuucugucuggaacagaguguggauugaagagaauccguggauggaagacaaaacccacaucuccagcuggggcgacguuccuuaucuggggaagcgcgaggaucaguggugcggaucucucauuggccugacagcucgggccaccugggcgacaaacauccaaguggcuaucaaucaggucagacggcuuauugggaacgagaauuaccuggacuacaugaccagcaugaagagauuuaaaaacgaauccgaucccgagggcgcccucugguga

SEQ ID NO: 19278 - RNA, 9879 nt, Artificial Sequence
  derived and/or modified CDS sequence (opt5) from DENV-1__EU482809__SS-prME
agcgugaccaugcugcugaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucaucagaacaaccuuuucccugcacuaugccuggaaaacgauggcuaugguucuuagcauugugucucuguucccccucugucuguccacaaccagccagaagaccacauggcucccugugcugcuugggucucugggaugcaagccgcugaccauguuucucaucgccgagaauaaaauuuggggccggaaguccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgaggucagcugggaagaggaagcugagcauuccggcgcgucucacaauauucucguggaaguucaggaugacgggacaaugaaaaucaaggaugaggagcgcgacgauacgcugaccauccuucugaaagccacacuccuggcugugagcggagucuauccucucuccauucccgccacccuguucgugugguacuucuggcaaaagaagaaacagagaucuggcguccuuugggacacaccuuccccucccgaaguggagcgggccguucuggaugacggcaucuaucgcauuaugcagagagggcugcucggacggucccaggugggcgucgggguguuucaagaaaacguuuuccauaccauguggcacgugacgcgcggagcuguccugauguaccagggcaagagacuugagcccagcugggccucugugaaaaaggaccugaucuccuacgggggaggcuggcggcuccagggcagcuggaauaccggggaggaagugcagguuauugcggucgagcccggcaagaauccuaagaaugugcaaacagcucccggcaccuuuaagacaucugaaggggaggugggagccaucgcccuggauuucaaaccgggcaccuccgggagcccuauugucaacagagaaggaaagaucgugggccucuauggcaaugggguugugacaacguccggaaccuacgucucugcuaucgcccaggcgaaagcuagccaggagggcccccugccugagauugaagacgagguguuucgcaagcggaaccuuacaaucauggaucugcaccccggguccggaaaaaccagacgcuaucugcccgccauuguucgggaagccaucaagagacgccuccggacccugauucuugcuccuacaagaguggucgccagcgagauggcugaagcccugaagggcaugccgauccgcuaccaaacgaccgcggugaaaucugagcauacagggaaggagaucguugaccucaugugccacgccaccuucacaaugcggcugcugucccccgugagagucccuaauuauaacaugauuaucauggaugaagcucauuuuaccgaccccagcucuauugccgcucggggcuacaucagcacgcgcgugggaaugggcgaggccgccgcuauuuucaugacagcgaccccucccggguccguggaagccuuuccucagucuaaugcugucauccaggaugaggaaagagacaucccggagcggagcuggaacuccggauaugaguggauuaccgauuuccccggcaaaacaguuugguuugugccuucuaucaagagcgggaaugacauugccaacugucuccgcaaaaauggaaagagagugauccagcuuucccggaagaccuucgauacagaauaccagaagaccaagaacaacgacugggacuacgucgugacgacagauauuagcgagaugggcgccaauuucagagcugaccgcguuaucgauccccggagaugccugaaaccugugauucugaaggacgggcccgaacgcgucauccucgccggcccgaugccugugaccguugcgucugcugcccagcggagaggacgcaucggccggaaccacaauaaagagggggaucaguauauuuacaugggacagccccugaacaaugacgaggaucaugcccacuggacagaagcuaagaugcuucuggacaacaucaauacccccgagggcauuaucccugcccucuuugaacccgagagagaaaaguccgcggccauugauggggaguaucgccugagaggagaggcucggaaaacguucguggaacugaugcgcagaggcgaccucccugucuggcuuagcuacaagguggccuccgagggguuucaauauucugaucggcgcuggugcuucgacggcgaaagaaacaaucagguccuggaggaaaacauggauguggagaucuggaccaaagagggagaacggaagaaacugagaccgcgcuggcucgacgcucggacauacagcgacccccuggcccuuagagaguuuaaggaguucgcugccggccgccgguccguuucuggggaucugauccucgagauuggaaaacugccucagcaccugacccagagagcgcaaaaugcccucgacaaccuugugaugcugcauaauagcgaacagggcgggcgggcuuaucgccacgccauggaggagcugcccgauacaaucgaaacccucaugcugcuugcucugauugccgugcucacaggaggcgucacccuguuuuuccuguccggcagagggcucggaaagacgagcaucggccuucuguguguuauggccucuuccgugcugcucuggauggcuagcguggagccucauuggauugcggccucuaucauccuggaauuuuuccuuaugguccugcucauucccgagccggaccggcagcgcacaccucaggauaaccaacuggcuuacgugguuaucgggcugcucuuuaugauucuuaccguggccgccaaugagaugggacugcuggaaaccacaaagaaagaccucggcaucgggcacgucgcuguggagaaccaccaucacgccgcgaugcuggaugucgaccuucaucccgccuccgcuuggacccuguacgccguggcuacaacgauuaucaccccuaugaugagacacacaauugaaaacaccacagccaauaucagccucaccgcgaucgccaaccaggcugccauucugaugggacuggauaagggcuggcccaucucuaaaauggacauuggcguuccucuccuugcucuggggugcuauagccaggugaauccccugacgcucaccgccgcuguccugaugcuuguggcccauuacgcgaucauuggaccgggccugcaagccaaggcuacacgggaggcccagaaacgcaccgcugccgggaucaugaagaacccuacaguugauggaaucguggccauugaccucgaucccgucguguaugacgcgaaguucgaaaaacagcugggccagaucaugcugcucauucuuuguaccucccaaauccugcugaugagaacgacaugggcucucugcgagucuauuacccuggccacagggccccuuaccacccugugggagggaagcccuggcaaguuuuggaauacaacgaucgcuguguccauggccaacaucuuccggggcagcuaccucgccggggcuggacuggccuucucccugaugaaaucucucggcgggggacgcagaggcaccggggcgcagggagaaacacuuggcgagaaguggaaacggcagcugaaucagcugagcaaguccgaauuuaacaccuauaagagaucuggcauuauggagguugaccgcagcgaagccaaagaggggcucaagcggggagagacaaccaaacacgcugucuccagaggcacggccaagcugcgcugguucguggaacggaaucuugugaaaccggaggggaaggucaucgaucugggauguggcagagggggauggucuuacuauugcgcuggccucaagaaaguuacagaagugaagggcuacaccaaagggggacccggccacgaggaaccuauucccauggccaccuacggguggaaccuggugaagcugcauagcggaaaagacgucuuuuucaucccucccgagaagugugauacacuccuuugcgacauuggcgaguccagcccuaauccgaccaucgaagaggggcgcacacugcgggugcugaaaaugguugaacccuggcucagaggaaaccaauuuuguauuaagauccugaauccuuauaugcccucuguggucgagacgcuugagcagaugcagcgcaagcacggcggcaugcuggugcggaacccucucuccagaaauagcacccaugaaauguacuggguuucuugcgggacaggaaacaucguguccgcggucaauaugaccagccgcaugcugcugaaccgguucacaauggcccacagaaaacccaccuaugagcgcgauguggaccucggcgcugggacgagacacguggccgucgaaccggagguugcuaaccuggauauuaucggacagcggauugaaaauaucaagcaugagcacaaaucuaccuggcauuacgacgaggauaacccuuauaagacaugggccuaccacggcuccuaugaagugaaacccagcggguccgcuagcucuauggugaauggagucgugaaacuucugaccaagcccugggacguuauuccuauggugacacaaaucgccaugaccgauacaacccccuuuggccagcagcgcgucuucaaagagaagguggacacgagaacaccuaaagcgaagcggggcaccgcccaaaucauggaaguuaccgcuaaauggcucuggggguuucugagcagaaacaagaagccgcggauuuguacacgcgaggaguucacgagaaaagugcgguccaaugccgcuaucggagccgucuuuguggacgagaaccaguggaacucugccaaggaggcgguugaagaugagcgcuucugggaccuugugcauagagaacgggagcugcacaaacagggcaagugcgcuaccugcgucuacaacaugauggggaaacgcgaaaagaagcucggagaguuuggcaaagccaaggggagcagagccauuugguacauguggcugggcgcucgguuccuggaguucgaagcccucggauuuaugaaugaggaucacugguucucccgcgaaaacucucugagcggcguggagggggagggacuucauaaacugggcuauauccucagagacauuuccaagauccccgggggaaauauguacgcugaugacacagccggcugggauacccggaucacagaagacgaucugcagaacgaggcgaaaauuaccgacaucauggaaccugagcacgcccuucuggcuaagucuauuuuuaaacucacauaucaaaauaaggucgugcgcguucagagacccgccaagaacgggaccgugauggaugucaucagccggcgcgaccagagaggcuccggacaggugggcacguacgggcugaauaccuucacaaacauggaagcucaacugauucggcagauggagagcgagggaaucuuuucuccuuccgaacucgagacccccaaccuggccggcagagugcuugauuggcuggaaaaacaugggguugagcgccucaagcggauggcgaucagcggagacgacuguguggucaaaccgauugaugacagauucgccacagcucugaccgcccuuaaugauaugggcaaggugcgcaaagacaucccucagugggaacccucuaagggguggaacgauuggcagcaaguuccuuuuugcucccaccacuuccaucagcugauuaugaaggacggccgggagaucgugguccccuguagaaaucaggaugagcucgugggacgcgcucgggucagccagggcgccggguggucccugagagaaacggcuugccugggaaaaucuuaugcccaaauguggcagcucauguacuuucaccgccgggaccugagacuugcggccaacgcuauuuguagcgccgugccuguugauugggugcccacaucccgcaccacauggagcauccaugcccaccaucaguggaugaccacggaggacaugcugucugucuggaaucggguguggauugaagagaacccguggauggaagauaagacccacguuuccagcuggggcgacgugccuuaucucgggaaaagagaggaccaauggugcggaucucugaucggccuuacagcucgggccaccugggcgacaaauauccaggucgcuauuaaccaggugagacgccugcucgggaaugagaacuaccuggauuacaugaccagcaugaagcgguucaaaaaugaauccgaccccgagggcgcccugugguga

SEQ ID NO: 19279 - RNA, 9879 nt, Artificial Sequence
  derived and/or modified CDS sequence (opt5) from DENV-1__EU482810__SS-prME
agcgugacaaugcugcugaugcugaugcccacagcccuugcuuuccaccugacgacccggggaggggagccucauaugaucgucuccaagcaggaacgggggaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagaugugcgaccaccggcuuaugucugccgcuauuaaagauuccaaggccguucacgccgacaugggcuacuggaucgaaagcgagaaaaaugaaacauggaagcucgcuagagccucuuucaucgaggugaagaccuguauuuggcccaaaucccauacacuguggagcaacggggugcuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggucgugguugaugagcacugcggaaaccggggccccucccucagaaccacaaccgugacaggcaagaucauccacgaaugguguugccggagcuguacccugccuccccugcgcuucaaaggggaggacggaugcugguauggcauggagauuagaccggucaaggaaaaggaggaaaaucuugugaaaucuaugguuuccgcugggagcggagagguggacuccuuuucucucggccugcuguguaucagcauuaugaucgaagaggucaugcgguccagauggucucgcaagaugcucaugacggggacacuggccguguucuuucuucugauuaugggacagcucaccuggaacgaucugauccggcugugcauuaugguuggcgccaaugcuagcgacagaaugggcauggggacaaccuaccuugcccugauggcgaccuucaaaaugcgcccuauguuugcugugggacuccuguucagacggcucacaucccgcgagguccugcuucugacgaucggccucucucugguggccagcguggaacugcccaacucccuugaggaacugggggauggacucgccaugggcaucaugauucugaagcuccugaccgacuuucaaagccaucagcuuugggcuacacugcucucuaugaccuucaucagaacaaccuuuucccugcacuaugccuggaaaacgauggcuaugguccugagcauuguuucucuuuucccccugugucucuccacaaccagccagaagaccacauggcugccugugcuccuggggucucuuggaugcaagccgcugaccauguuucugaucgccgagaauaaaauuuggggccggaaguccuggccccucaacgaaggcaucauggcgguggggaucgucagcauucugcuuuccagccugcucaaaaacgaugugccucuggccggaccccucaucgcuggcgggaugcugauugccuguuacguuaucucuggaagcuccgcugaccuuucucuggagaaggccgccgaggugagcugggaagaggaagcugagcauuccggcgcgucucacaauauucuggucgaagugcaggaugacgggacaaugaaaaucaaggaugaggagcgcgacgauacgcucaccauccugcuuaaagccacacugcucgcuguuagcggaguguauccucuguccauucccgccacccucuucgucugguacuucuggcaaaagaagaaacagagaucuggcgugcugugggacacaccuuccccucccgaaguccagcgggccgugcuugaugacggcaucuaucgcauuaugcagagagggcugcugggacggucccaaguuggcgugggggucuuucaggagaacguguuccauaccauguggcacguuacgcgcggagcugugcucauguaccagggcaagagacuggaacccagcugggccucugucaaaaaggaccuuaucuccuacgggggaggcuggcggcugcagggcagcuggaauaccggggaggaggugcaagugauugcgguugaacccggcaagaacccuaagaauguccagacagcucccggcaccuuuaagacaucugagggggaagugggagccaucgcccucgauuucaaaccgggcaccuccgggagcccuauugugaacagagagggaaagaucgucggccuguauggcaauggggugguuacaacguccggaaccuacgugucugcuaucgcccaggcgaaagcuagccaagaaggcccccucccugagauugaggacgaagucuuucgcaagcggaaccugacaaucauggaucuucaccccggguccggaaaaaccagacgcuaucugcccgccauugugcgggaggccaucaagagaaagcugcgcacccucauucuggcuccuacacggguuguggccagcgaaauggcugaggcccuuaaaggcaugccgaucagauaccagacgaccgcggucaagucugaacauacagggaaagagaucguggaccugaugugccacgccaccuucacaaugcgccuccugucccccguucgggugccuaauuauaacaugauuaucauggaugaggcucauuuuaccgaccccagcucuauugccgcuagaggcuacaucagcacgcgggucggaaugggcgaagccgccgcuauuuucaugacagcgaccccucccggguccguggaggccuuuccucagucuaaugcugugauccaggaugaagaaagagacaucccggaaagaagcuggaacuccggauaugaguggauuaccgauuuccccggcaagacagucugguuuguuccuucuaucaaaagcgggaaugacauugccaacugucugcggaagaauggaaagcgcgugauccaacucuccagaaaaaccuucgauacagaguaccagaagaccaaaaacaacgacugggacuacguggucacgacagauauuagcgaaaugggcgccaauuuccgggcugacagagugaucgauccccgccggugccuuaagccuguuauucugaaagacgggcccgagagagugauccuggccggcccgaugccugucaccguggcgucugcugcccagcgccggggaagaaucggccgcaaccacaauaaggaaggggaucaguauauuuacaugggacaaccccucaacaaugacgaggaucaugcccacuggacagaggcuaagaugcugcuugacaacaucaauacccccgaaggcauuaucccugcccuguuugagcccgaacgggagaaauccgcggccauugauggggaauauagacuccgcggagaggcuagaaagacguucguugagcugaugcggcgcggcgaccugccuguguggcucagccacaaagucgccuccgaaggguuucaguacucugauagacgguggugcuucgacggcgagcgcaacaaucaggugcuugaagagaacauggaugucgaaaucuggaccaaggagggagagcgcaagaagcugcggccgagauggcuggacgcucgcacauauagcgacccccucgcccugcgggaauuuaaagaguucgcugccggcagacgcuccgugucuggggaucuuauccuggaaauuggaaagcucccucagcaucugacccaacgggcgcagaaugcccuggacaaccucguuaugcuucacaauagcgagcagggcgggagagcuuaccggcaugccauggaggaacugcccgauacaaucgagacccugaugcuccuggcucuuauugccgugcugacaggaggcgugacccucuuuuuccuguccggccgcgggcugggaaagacgagcaucggccuccuuugugucauggccucuuccguucugcuguggauggcuagcguggaaccucacuggauugcggccucuaucauccucgaguuuuuccugauggugcuucugauucccgaaccggacagacagcggacaccucaagauaaccagcucgcuuaugucgugaucgggcugcuguuuaugauucucaccguugccgccaaugagaugggacuucuggagaccaccaaaaaggaccugggcaucgggcacguggcugucgaaaaccaucaccaugccgcgaugcucgauguggaccugcaccccgccuccgcuuggacccuuuacgccgucgcuacaacgauuaucaccccuaugaugcgccauacaauugagaacaccacagccaauaucagccugaccgcgaucgccaaccaggcugccauucucaugggacuggauaaaggcuggcccaucucuaagauggacauuggcgugccucugcucgcucuugggugcuacagccaaguuaauccccugacgcugaccgccgcugugcucaugcuggucgcccacuaugcgaucauuggaccgggccuucaggccaaagcuacaagagaagcccagaagcggaccgcugccgggaucaugaagaacccuacaguggauggaaucguugccauugaccuggaucccguggucuacgacgcgaaauucgagaagcagcucggccaaaucaugcugcugauucucuguaccucccagauccuucugaugcgcacgacaugggcucugugcgaaucuauuacccucgccacagggccccugaccacccuuugggagggaagcccuggcaaauuuuggaauacaacgaucgcuguguccauggccaacaucuucagaggcagcuaucuggccggggcuggacucgccuucucccugaugaagucucugggcgggagccggcgcggaaccggcgcgcagggggagacacucggagaaaaauggaagagacagcuuaaucaacuguccaagucugaguuuaacaccuacaaacggagcggcauuauggaaguggacagauccgaggccaaggaaggccugaaacgcggggagacaaccaagcacgcuguuucucggggaacggccaaacucagaugguucgucgagcgcaaucuggugaagccggaaggcaaggugaucgaucuuggguguggacggggcggguggagcuauuacugcgcuggacugaaaaaggucacagagguuaaaggcuauaccaagggcgggcccggacaugaggagccuauucccauggccaccuacggcuggaaccucgugaaacugcacuccgggaaggacguguuuuucaucccucccgaaaaaugugauacacugcucugcgacauuggagagagcucuccuaauccgaccaucgaggaaggcagaacacuucgcguccugaagaugguggagcccuggcugcgggggaaccaguuuuguauuaagauccucaauccuuacaugcccuccguuguggaaacgcuggagcagaugcagagaaaacauggaggcaugcuuguccgcaacccucugagcagaaauucuacccacgagauguauuggguguccugcggcacagggaacaucguuagcgcggugaauaugaccucuagaaugcuccugaaccgcuucacaauggcccaccggaagcccaccuacgaaagagaugucgaccugggagcuggcacgcgccauguggccguggagccggaagucgcuaaccucgauauuaucgggcaaagaauugagaauaucaaacacgaacauaaguccaccuggcacuaugacgaggauaacccuuacaaaacaugggccuaucauggaagcuacgagguuaagcccuccggcagcgcuucuagcauggugaaugggguggucaagcugcuuaccaaacccugggacgugauuccuaugguuacacagaucgccaugaccgauacaacccccuuuggacagcaacggguguucaaggaaaaagucgacacgcgcacaccuaaggcgaaaagaggcaccgcccagaucauggaggugaccgcuaaguggcuguggggcuuucucucccggaacaagaaaccgagaauuuguacacgggaagaguucacgcgcaagguuagaucuaaugccgcuaucggggccguguuugucgacgaaaaccaguggaauagcgccaaagaggcgguggaggaugaacgguucugggaccugguucaccgcgagagagaacuucacaagcagggaaaaugcgcuaccugcguguauaacaugaugggcaagcgggagaagaaacugggggaauuuggaaaggccaaaggcucccgcgccauuugguacauguggcucggggcuagauuccuggaguucgaggcccugggcuuuaugaaugaagaucauugguucucucgggagaacagccucuccggagucgaaggcgaggggcugcacaaacuuggauacauccugcgcgacauuucuaaaauccccggcgggaauauguaugcugaugacacagccggaugggauaccagaaucacagaggacgaucuccaaaacgaagcgaagauuaccgacaucauggagccugaacaugcccugcuugcuaaaagcauuuuuaagcugacauaccagaauaaggugguccgggugcagcgccccgccaaaaacggcaccguuauggaugugaucuccagacgggaccagcgcgggagcggccaagucggaacguauggccucaauaccuucacaaacauggaggcucagcugauuagacagauggaaucugaggggaucuuuuccccuagcgagcuggauacccccaaccucgccggacgggugcuggacuggcuugaaaagcacggcguggagagacugaaacgcauggcgaucucuggggacgauuguguugugaagccgauugacgaucgguucgccacagcucucaccgcccugaaugacaugggaaaagucagaaaggauaucccucagugggaacccuccaagggcuggaacgacuggcaacaggugccuuuuugcagccaccauuuccaccagcuuauuaugaaagaugggcgcgagaucguugugcccugucggaaucaggacgaacuggucggcagagcucgcgugucccaaggagccggcuggucucuccgggagacggcuugccugggaaagagcuacgcccagauguggcagcugauguauuuucauagacgcgaucuccggcuggcggccaacgcuauuuguuccgccgucccuguggacuggguucccacaagcagaaccacauggucuauccacgcccaucaccaauggaugaccacggaggauaugcuuuccguguggaaucgcgucuggauugaagagaacccguggauggaagacaaaacccacaucagcucuuggggagacgugccuuaccugggcaagcgggaggaucaguggugcgggagccucaucggacugacagcuagagccaccugggcgacaaauauucagguugcuaucaaccaggugcggagacuucugggcaaugaaaacuaucucgacuacaugaccuccaugaaacgcuucaagaaugagucugggcccgagggcgcccugugguga

SEQ ID NO: 19280 - RNA, 9879 nt, Artificial Sequence
  derived and/or modified CDS sequence (opt5) from DENV-1__EU482811__SS-prME
agcgugaccaugcugcucaugcugaugcccacggcccuugcuuuccaccugacgaccagaggaggggagccucauaugaucgucuccaagcaggaacggggaaaaucucuccuguuuaagaccagcgccggaguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugacuccggaugcguuaucaacuggaaaggccgcgagcugaagugugggagcggaauuuucgugaccaaugaaguccacacauggaccgagcaauauaaguuucaggccgauuccccuaaacggcucucugcggccaucggcaaggcuugggaggaaggggugugcggcauuagaagcgccacgcgccuggagaacaucauguggaaacagaucuccaacgaacuuaaucauauucugcucgagaacgacaugaaguucacaguuguggucggagacguggcuggcauccuggugcaggggaaaaagaugauucggccgcaacccauggaauacaaauauucuuggaaaagcuggggaaaggccaaaaucauuggcgccgauguccaaaauuccaccuuuaucaucgacgggccuaacacccccgaguguccugaugaccagagagcuuggaauauuugggagguugaagauuacggauucggcaucuuuacaaccaacauuuggcugaaacuucgcgacagcuauacacaggugugcgaucaccggcucaugucugcggccaucaaagacuccaaggcugugcacgccgauaugggcuacuggauugagagcgagaagaaugagacauggaagcuggccagagcuucuuucaucgaagucaagaccuguaucuggcccaaaucccauacacuguggagcaacggggugcucgagucugagaugauuaucccgaagauucacggaggcccuaucagccaacauaauuaucgccccggguacuucacccagacagccggaccuuggcaccugggcaaacuugaacuggacuuugaucucugcgaggggaccacgguuguggucgacgaacacugcggaaaccggggccccucccugagaaccacaaccgugacaggcaagauuauccaugagugguguugccggagcuguacccugccuccccuucgcuucagaggggaggauggaugcugguacggcauggaaauccggccgguuaaagagaaggaagagaaucucgugaagucuauggucuccgcggggagcggagaaguggacuccuuuucucugggccugcucuguauuagcaucaugauugaggagguuaugagaucccgcuggucucggaaaaugcugaugacggggacacuugcuguguucuuucugcucaucaugggacagcugaccuggaacgaccugauuagacuuugcaucauggucggcgccaaugccagcgaucgcaugggcauggggacaaccuaucuggcucucauggccaccuucaagaugagaccuauguuugcggugggacugcuguuccggcgccugacauccagagaagugcuucugcucacgauuggccugucucuggucgcuagcguugagcuucccaacucccuggaagaacucggggacggacuggccaugggcaucaugauccucaaacugcuuaccgauuuucaaagcuaccagcugugggccacacuccugucucugaccuucauuaagacaaccuuuucccuucacuaugcuuggaaaacgauggccauggugcugagcaucgugucucucuucccccugugucucuccacaaccagccagaagaccacauggcugccuguccuucuggggucucugggaugcaagccgcucaccauguuucugauugcugaaaauaaaaucuggggccggaaguccuggccccuuaacgagggcauuauggccguggggaucguuagcauccugcucuccagccugcucaaaaacgacgugccucuggcgggaccccuuauugccggcgggaugcugaucgcuuguuacgucauuucuggaagcuccgccgaucugucucucgagaaggcugccgaagugagcugggaggaagaggccgaacauuccggcgcuucucacaauauccugguugaggugcaggacgaugggacaaugaaaauuaaggacgaggaacgcgaugacacgcuuaccauccugcucaaagcgacacugcucgccgucagcggaguguauccucuguccauccccgcuacccuuuucgucuggcauuucuggcaaaagaagaaacagagaucuggcgugcugugggauacaccuagcccucccgagguugaacgggccgugcuggacgauggcauuuaccgcaucaugcagagagggcuccugggacggucccaggucggcguggggguuuuucaagagaacguguuccacaccauguggcacgucacgcgcggagccgugcuuauguaucagggcaagagacuggagcccagcugggcuucugugaaaaaggaccucauuuccuacgggggaggcuggcggcugcagggcagcuggaauaccggggaagagguucaggucaucgccguggaacccggcaagaacccuaagaaugugcaaacagcgcccggcaccuuuaagacaccggagggggaagucggagcuauugcccucgacuucaaaccuggcaccucugggucccccaucgugaacagagagggaaagauuguuggccuguacggcaaugggguggucacaacgagcggaaccuauguguccgccaucgcucaggccaaagcgucucaggagggcccucuucccgaaaucgaggaugaaguuuuucgcaagcggaaccugacaauuauggaccugcaucccgggagcggaaaaaccagacgcuaccucccugcuaucgugcgggaggccauuaagagaaagcugcgcacccuuauccuggccccgacacgggucguggcuuccgaaauggccgaggcucucaaaggcaugcccauuagauaucaaacgaccgccguuaagagcgagcacacagggaaagaaaucguggaucugaugugccaugcgaccuucacaaugcgccugcucucuccuguccgggugcccaauuacaacaugaucauuauggacgaggcccacuuuaccgauccuuccagcaucgcugccagaggcuauauuucuacgcgggugggaaugggcgaagcugccgccaucuucaugacagcuacacccccugggagcauggaggcguuuccgcaguccaaugccgucauucaggacgaagaaagagauauccccgagagaucuuggaacagcggauacgaauggaucaccgacuucccuggcaagacaguuugguuugugcccuccauuaaagcugggaaugauaucgccaacugucuucggaagaauggaaagcgcgugauucagcugucuagaaaaaccuucgacacagaguaucaaaagaccaaaaacaacgauugggacuacgucgugacgacagacaucagcgaaaugggcgccaauuuccgggcugauagaguuauugacccucgccggugccugaagcccgugauccucaaagaugggccggagagagucauucuggccggcccuaugcccgugaccguugcguccgcugcccagcgccggggaagaaucggccgcaaccauaauaaggagggggaccaguacaucuauaugggacagccccuuaacaaugaugaagaccacgcccacuggacagaggcuaagaugcugcucgauaacauuaauaccccugaaggcaucauucccgcccuguuugagccugaacgggagaaaagcgcggccaucgacggggaguacagacugcgcggagaagcuagaaagacguucguggagcucaugcggcgcggcgaucuuccggucuggcugucuuauaaaguggccuccgaaggguuucaauacagcgacagacgguggugcuucgauggcgagcgcaacaaucagguccuggaagagaacauggacguggagauuuggaccaaggaaggagagcgcaagaagcuccggcccagauggcuggaugcucgcacauauuccgacccucuugcccugcgggaauuuaaagaguucgcugccggcagacgcucuguuagcggggaccucauccuggaaaucggaaagcugccccagcaucucacccagcgggcgcaaaaugcccuugauaaccuggugaugcugcacaauuccgagcagggcgggagagcuuaccggcaugccauggaggaacucccugacacaauugagacccugaugcuucuggcucucaucgccgugcugacaggaggcgucacccuguuuuuccucucuggcaaggggcuuggaaaaacgagcauuggccugcuguguguuauggccuccagcgugcuccuguggauggcuucuguggaaccccacuggaucgcggccuccauuauccuugaguuuuuccugaugguccuccugaucccggagccugaucgccagagaacaccccaggacaaccaacuggcuuaugugguuauugggcuccuuuuuaugauccugaccguggccgccaaugaaaugggacugcucgagaccacaaagaaagaucugggcauugggcacgucgcuguggaaaaccaucaccaugccgcgaugcuugacgucgaucugcacccugccagcgcuuggacccucuacgccguggcuacaacgaucauuacccccaugaugcggcauacaaucgagaacaccacagccaauauuucucugaccgcgaucgccaaccaggcugccauccugaugggacucgacaagggcuggccuauuuccaaaauggauaucggcguuccccuucuggcucuggggugcuacagccaggugaauccgcucacgcugaccgccgcuguccuuaugcugguggcccacuaugcgauuaucggaccuggccuccaagccaaggcuacacgcgaagcccagaagagaaccgcugccgggauuaugaaaaaccccacaaucgacggaaucguugccauugaucuggaccccguggucuacgaugcgaaguucgagaaacagcugggccagaucaugcuccuuauucuguguaccucucaaauccugcucaugcggacgacaugggcucugugcgagagcauuacccuugccacagggccucugaccacccucugggaaggauccccgggcaaguuuuggaauacaacgaucgcugugucuauggccaacaucuuccgcggcagcuaucuggccggggcuggacuggccuucucccucaugaaaagccuuggcgggggaagacggggcaccggggcgcagggagagacacugggcgaaaaguggaagcgccagcugaaucagcucuccaaaucugaguuuaacaccuacaagagaagcggcauuauggaaguggaccgguccgaggccaaagaggggcugaagagaggagaaacaaccaaacacgcuguuucucgcggcacggccaaacuucggugguucgucgagagaaaucuggugaagcccgaagggaaagugaucgaccucggauguggccgcgggggauggagcuauuacugcgcuggccugaagaaagucacagagguuaagggcuauaccaaagggggaccuggccaugaggagcccauuccuauggccaccuacggguggaaccuggugaagcuccacuccggaaaagauguguuuuucauucccccugagaagugugacacacuucugugcgauaucggcgaaucuagcccgaaucccaccaucgaggaagggcggacacugagaguccucaagaugguggagccuuggcugcgcggaaaccaauuuuguauuaaaauccuuaaucccuacaugccuuccguuguggagacgcuggaacagaugcagcggaagcauggcggcaugcucgucagaaacccccugagccgcaauucuacccacgagauguauuggguguccugcgggacaggaaacaucguuagcgcggugaauaugaccucucggaugcugcucaacagauucacaauggcccaccgcaaaccgaccuacgaacgggacgucgaucugggcgcugggacgagacauguggccguggagccugaagucgcuaaccuugacauuaucggacagcgcauugagaauaucaagcacgagcauaaauccaccuggcacuaugaugaagacaaccccuacaagacaugggccuaucauggcagcuacgagguuaagcccucuggguccgcuagcuccauggugaauggaguggucaaacugcucaccaagccuugggaugugauucccaugguuacacaaaucgccaugaccgacacaaccccuuuuggccagcagagaguguucaaagaaaaggucgauacgcggacaccgaaagcgaagcgcggcaccgcccaaaucauggaggugaccgcuagauggcuguggggguuucuuagccggaacaagaaacccagaauuuguacacgggaagaguucacgcgcaagguuagaucuaaugccgcuaucggagccguguuugucgacgagaaccaguggaauagcgccaaagaagcgguggaggacgaucgguucugggaccugguucaccgcgaaagagagcuccacaagcagggcaaaugcgcuaccugcguguauaacaugauggggaagcgggaaaagaaacugggagaguuuggcaaggccaaagggucccgcgccauuugguacauguggcugggcgcuagauuccucgaguucgaagcccugggauuuaugaaugaggaucauugguucucucgggaaaacagccuuuccggcgucgagggggagggacugcacaagcucggcuacauccugcgcgacauuucuaaaaucccugggggaaauauguaugcugaugacacagccggcugggauaccagaaucacagaagacgaucuucagaacgaggcgaagauuaccgacaucauggaacccgagcaugcccugcucgcuaaaagcauuuuuaagcugacauaccaaaauaaggugguccgggugcagcgcccugccaaaaacgggaccguuauggaugugaucuccagacgggaccagcgcggcucuggacaggucggcacguaugggcugaauaccuucacaaacauggaagcucaacucauuagacagauggagagcgagggaaucuuucugcccaacgaacuugagaccccgaaucuggccggccgggugcucgauuggcuggaaaaguacgggguggagagacuuaaacgcauggcgaucuccggagacgacuguguugugaagccuauugaugaccgguucgccacagcucugaccgcccucaacgauaugggcaaagucagaaaggacaucccccagugggaaccuagcaagggguggaaugauuggcagcaagugcccuuuugcucucaccacuuccaucagcugauuaugaaagacggccgcgagaucguugugccuugucggaaccaggaugagcuggucggcagagcucgcgugucccagggcgccggguggagccuccgggaaacggcuugccugggaaagucuuaugcccaaauguggcagcuuauguacuuucacagacgcgaccugcggcucgcggccaaugcuauuuguuccgccguccccguggauuggguuccgacaagcagaaccacaugguccauccaugcccaccaucaguggaugaccacggaggacaugcugucuguguggaaccgcgucuggauugaagagaauccuuggauggaagauaaaacccggaucagcuccugggaggacgugcccuaucuuggcaagagagaggaccaauggugcgggagccugaucggacucacagcucgggccaccugggcgacaaacauucagguugcuaucaaucaggugagacgccugauuggcaacgaaaauuacucugauuacaugaccuccaugaaacgguucaagaacgagagcgaacccgagggggcccugugguga

SEQ ID NO: 19281 - RNA, 9879 nt, Artificial Sequence
  derived and/or modified CDS sequence (opt5) from DENV-1__EU482812__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggcgacgcagaacggacggcugaucaccgcuaaucccauugugacagacaaagagaagccugucaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguguuuaccagcguuggcaaacugguccaucagauuuucgggacggcuuacggagugcucuuuuccggcgugagcuggaccaugaagaucgggauuggcguccugcuuacauggcugggacucaauucuagauccaccagccugucuaugacauguaucgccgugggccugguuacccuuuaccucggggugaugguccaggcugauuccggaugcgugauuaacuggaaaggccgcgaacugaagugugggagcggaaucuucguuacaaaugaggugcacaccuggacggaacaauauaaguuucaggccgacuccccuaaacggcugucugcggccauuggcaaggcuugggaggagggggucugcggcaucagaagcgccacacgccucgaaaacaucauguggaaacagauuuccaacgagcugaaucauauccuucuggaaaacgacaugaaguucaccgugguugugggagaugucgcuggcauucucgcccaggggaaaaagaugauccggccgcaacccauggaguacaaauauucuuggaaaagcuggggaaaggccaagauuaucggcgcugacgugcagaauaccacauuuaucauugaugggccuaacacccccgaauguccugacgaucagagagcguggaauaucugggagguggaggacuacggauucggcauuuuuacgacaaacaucuggcugaagcugcgcgauuccuauacccaggucugcgaccaccggcuuaugagcgccgcuauuaaagauucuaaggccguucacgccgacaugggcuacuggaucgaauccgagaaaaaugaaacauggaagcucgcuagagccagcuucaucgaggugaagaccuguauuuggcccaaaucucauacacugugguccaacggggugcuggaaagcgagaugaucauuccgaagaucuauggaggcccuauuucucaacacaauuaccgccccggguacuucacccagacggcgggaccuuggcaucucggcaaacuggagcuugauuuugaccugugcgaagggaccacagucgugguugaugagcacugcggaaaccggggccccagccucagaaccacaaccgugacgggcaagaucauccacgaaugguguugccgguccuguacacugccuccccugcgcuucagaggggaggacggaugcugguauggcauggagauucggccggucaaagaaaaggaggaaaaucuugucaagagcaugguuucugcuggguccggagagguggacagcuuuucccucggccugcuguguaucucuauuaugaucgaagaggucaugagaagccgcuggucccggaaaaugcucaugaccgggacacuggccguguucuuucuucugauuaugggacagcucaccuggaacgaucugaucagacugugcauuaugguuggcgccaaugcuucugaccgcaugggcauggggaccacauaccuugcccugauggcgacguucaagaugagaccuauguuugcugugggacuccuguuccggcgccucaccagcagagagguccugcuucugacaaucggccucucccugguggccucuguggaacugcccaacagccuugaggaacugggggauggacucgccaugggcaucaugauucugaaacuccugaccgacuuucaaucccaucagcuuugggcuacacugcucagccugaccuucaucaagacgacauuuucucugcacuaugccuggaaaaccauggcuaugguccuuuccauuguuagccuguucccccucugucugucuaccacaucccagaagaccacauggcucccugugcugcuugggagccugggaugcaagccgcugacgauguuucucaucgccgagaauaaaauuuggggccggcgcucuuggccccugaacgaaggcaucauggcgguggggaucgucuccauucuucugagcucccuccugaagaacgaugugccucucgccggaccccugaucgcuggcgggaugcuuauugccuguuacguuaucagcggaucuagcgcugaccugucccuggagaaagccgccgaggugucuugggaagaggaagcugagcauagcggcgcgucccacaauauucucgucgaagugcaggaugacgggaccaugaagaucaaagaugaggagagagacgauacacugaccauccuucugaaggccacacuccuggcuguuucuggaguguauccucucagcauucccgccacccuguucgucugguacuucuggcagaagaagaagcagcgguccggcgugcuuugggacacgccuucucccccggaagucgagcgcgccgugcuggaugacggcaucuauagaauuaugcagcgggggcugcucggacgcagccagguuggcgugggggucuuucaagaaaacguguuccauaccauguggcacguuacaagaggagcugugcugauguaccagggcaaacggcuugagccuuccugggccagcgucaagaaagaccugaucucuuacgggggaggcuggagacuccagggcuccuggaauaccggggaggaaguccaggugauugcgguugagcccggaaagaacccuaaaaauguccaaacagcucccggcaccuuuaagacaccggaaggggaggugggagccaucgcccuggauuucaagccuggcacgagcgggucucccauugugaaccgcgaaggaaaaaucgucggccucuauggcaauggggugguuaccacauccggaaccuacgugagcgcuaucgcccaggcgaaggcuucccaggagggcccucugcccgagauugaagacgaggucuuucggaaaagaaaccuuaccaucauggaucugcaccccgggucuggaaagacacgccgguaucugccugccauugugagagaagccaucaaacgcaagcuccggacgcugauucuugcuccgaccagaguuguggccagcgagauggcugaagcccugaagggcaugcccauccgcuaccaaacaaccgcggucaaauccgagcauacagggaaggagaucguggaccucaugugccacgccaccuucacgaugcggcugcugagcccuguuagagugcccaauuauaacaugauuaucauggaugaagcucauuuuacagacccuucuuccauugccgcucggggcuacaucagcacccgcgucggaaugggcgaggccgccgcuauuuucaugaccgcgacacccccugggucuguggaagccuuuccgcagagcaaugcugugauccaggaugaggaaagagacauccccgagcgguccuggaacucuggauaugaguggauuaccgauuucccuggcaaaacagucugguuuguucccagcaucaaguccgggaaugacauugccaacugucuccgcaaaaauggaaagagagugauccagcuuucucggaagaccuucgauacggaauaccagaaaaccaagaacaacgacugggacuacguggucaccacagauauuagcgagaugggcgccaauuucagagcugaccgcgugaucgauccucggagaugccugaaacccguuauucugaaggacgggccggaacgcgugauccucgccggcccuaugcccgucaccguggcguccgcugcccagcggagaggacgcaucggccggaaccacaauaaagagggggaucaguauauuuacaugggacagccccugaacaaugacgaggaucaugcccacuggacggaagcuaagaugcuucuggacaacaucaauaccccugagggcauuauccccgcccucuuugaaccugagagagaaaagagcgcggccauugauggggaguaucgccugagaggagaggcucggaaaacauucguugaacugaugcgcagaggcgaccucccgguguggcuuucuuacaaggucgccuccgagggguuucaauauagcgaucggcgcuggugcuucgacggcgaaagaaacaaucaggugcuggaggaaaacauggaugucgagaucuggaccaaagagggagaacggaagaaacugagaccccgcuggcucgacgcucggacauacuccgacccucuggcccuuagagaguuuaaggaguucgcugccggccgccggucugugagcggggaucugauccucgagauuggaaaacugccccagcaccugacccagagagcgcaaaaugcccucgacaaccuuguuaugcugcauaauuccgaacagggcgggcgggcuuaucgccacgccauggaggagcugccugauacaaucgaaacccucaugcugcuugcucugauugccgugcucacgggaggcgugacacuguuuuuccugucuggcagagggcucggaaagaccagcaucggccuucugugugucauggccuccagcguucugcucuggauggcuucuguggagccccauuggauugcggccuccaucauccuggaauuuuuccuuauggugcugcucauuccggagccugaccggcagcgcacaccccaggauaaccaacuggcuuacgucgugaucgggcugcucuuuaugauucuuacaguugccgccaaugagaugggacugcuggaaaccacaaagaaagaccucggcaucgggcacguggcugucgagaaccaccaucacgccgcgaugcuggauguggaccuucauccugccagcgcuuggacgcuguacgccgucgcuaccacaauuaucacccccaugaugagacacacaauugaaaacaccacggccaauaucucucucaccgcgaucgccaaccaggcugccauucugaugggacuggauaagggcuggccuaucuccaaaauggacauuggcgugccccuccuugcucuggggugcuauagccagguuaauccgcugacacucaccgccgcugugcugaugcuugucgcccauuacgcgaucauuggaccuggccugcaagccaaggcuacacgggaggcccagaaacgcaccgcugccgggaucaugaagaaccccacgguggauggaaucguugccauugaccucgaucccguggucuaugacgcgaaguucgaaaaacagcugggccagaucaugcugcucauucuuuguacaucucaaauccugcugaugagaaccacaugggcucucugcgagagcauuacccuggccaccgggccucuuacaacgcugugggagggauccccgggcaaguuuuggaauaccacaaucgcugugucuauggccaacaucuuccggggcagcuaccucgccggggcuggacuggccuucucccugaugaaaagccucggcgggggacgcagaggcaccggggcgcagggagaaacacuuggcgagaaguggaaacggcagcugaaucagcuguccaagucugaauuuaacaccuauaagagaagcggcauuauggagguggaccgcuccgaagccaaagaggggcucaagcggggagagacgacaaaacacgcuguuucuagaggcaccgccaagcugcgcugguucgucgaacggaaucuugugaaacccgaggggaaggugaucgaucugggauguggcagagggggauggagcuacuauugcgcuggccucaagaaagucaccgaaguuaagggcuacacaaaagggggaccuggccacgaggaacccauuccuauggccaccuacggguggaaccuggugaagcugcauuccggaaaagacguguuuuucauucccccugagaagugugauacacuccuuugcgacauuggcgagucuagcccgaaucccacgaucgaagaggggcgcacccugcggguccugaaaaugguggaaccuuggcucagaggaaaccaauuuuguauuaagauccugaaucccuauaugccuuccguuguggagacacuugagcagaugcagcgcaagcacggcggcaugcugguccggaacccccucagcagaaauucuacccaugaaauguacuggguguccugcgggacaggaaacaucguuagcgcggugaauaugaccucucgcaugcugcugaaccgguucacgauggcccacagaaaaccgaccuaugagcgcgaugucgaccucggcgcugggacaagacacguggccguggaaccugaggucgcuaaccuggauauuaucggacagcggauugaaaauaucaagcaugagcacaaauccaccuggcauuacgacgaggauaaccccuauaagacaugggccuaccacggcagcuaugaaguuaaacccucuggguccgcuagcuccauggugaauggaguggucaaacuucugaccaagccuugggacgugauucccaugguuacacaaaucgccaugaccgauacgacaccuuuuggccagcagcgcguguucaaagagaaggucgacaccagaaccccgaaagcgaagcggggcacagcccaaaucauggaagugacggcuaaauggcucuggggguuucugagcagaaacaagaagccccggauuuguacccgcgaggaguucacaagaaaaguucggucuaaugccgcuaucggagccguguuugucgacgagaaccaguggaauagcgccaaggaggcgguggaagaugagcgcuucugggaccuuguucauagagaacgggagcugcacaaacagggcaagugcgcuaccugcguguacaacaugauggggaaacgcgaaaagaagcucggagaguuuggcaaagccaagggguccagagccauuugguacauguggcugggcgcucgguuccuggaguucgaagcccucggauuuaugaaugaggaucacugguucucucgcgaaaacagccuguccggcgucgagggggagggacuucauaaacugggcuauauccucagagacauuucuaagaucccugggggaaauauguacgcugaugacacagccggcugggauacccggaucacagaagacgaucugcagaacgaggcgcgcauuaccgacaucauggaacccgagcacgcccuucuggcuaaaagcauuuuuaagcucacguaucaaaauaaaguggucagagugcagcggccugccaagaacgggaccguuauggaugugaucucccgcagagaccagcggggcucuggacaggucggcacauacgggcugaauaccuucacaaacauggaagcucaacugauuagacagauggagagcgagggaaucuuuucccccagcgaacucgagaccccgaaccuggccgaacgcgugcuugauuggcuggagaaguauggcguggaacggcucaaaagaauggcgaucucuggggacgacuguguugugaagccuauugaugaccgcuucgccacggcucugacagcccuuaaugauaugggaaaaguccggaaggacaucccccagugggagccuuccaaaggcuggaacgauuggcagcaagugcccuuuugcagccaucacuuccaccagcugauuaugaaggacgggagagagaucguugugccuugucgcaaucaggaugaacucgucggccgggcuagagugucucagggagccggcuggucccugcgcgagaccgcuugccugggaaagagcuacgcccaaauguggcagcucauguauuuucaucggagagaccugcgccuugcggccaacgcuauuuguuccgccguccccguggauuggaucccgacaucucggaccacguggagcauucacgcccaucaccaguggaugaccacagaagacaugcuguccguuuggaauagaguguggaucgaggaaaacccuuggauggaggauaaaacccauaucagcucuuggggagacguccccuaccucggcaagcgggaggaccaauggugcgggucccugauuggacuuacagcuagagccaccugggcgacaaauauccagguggcuauuaaccagguucgccggcugaucggcaaugaaaacuaccucgauuauaugaccagcaugaaaagauucaagaaugagucugaccccgaaggggcccugugguga

SEQ ID NO: 19282 - RNA, 9879 nt, Artificial Sequence
  derived and/or modified CDS sequence (opt5) from DENV-1__EU482813__SS-prME
agcgugaccaugcugcucaugcugaugcccaccgcccuugcuuuccaccugacgaccagaggcggggagccucauaugaucgucuccaagcaggaacggggaaagucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaagaggcucugaaacuuagcugguuuaagaaaggcuccucuaucgggaagauguucgaagccacagcuagaggcgcccgccggauggcgauucucggagauaccgccugggacuuuggcagcaucgggggaguuuucacauccgucggcaaacuggugcaucagaucuuugggaccgcuuacggagugcuguucagcggcgucucuuggacgaugaagauugggaucggcgugcuccugaccuggcuuggacucaauuccagaagcacaucucucuccaugaccuguauugccguuggccuggugacacuguaccuuggggucauggugcaggcugauagcggaugcguuaucaacuggaaaggccgcgagcucaaguguggguccggaauuuuugugaccaaugaaguccacacauggaccgagcaguauaaguuccaagccgacucuccuaaacggcugagcgcggccaucggcaaggcuugggaggaaggggugugcggcauuagauccgccacgcgccuggagaacaucauguggaaacagaucucuaacgaacucaaucauauucugcuugagaacgacaugaaguuuacaguuguggucggagauguggcuggcauccuggcccaggggaaaaagaugauucggccgcagcccauggaauacaaauauagcuggaaguccuggggaaaggccaaaaucauuggcgcugacgugcaaaauaccaccuucaucaucgaugggccuaacacacccgaguguccugacgaucagagagcguggaauauuugggaggucgaagacuacggauuuggcaucuucaccacgaacauuuggcucaagcugcgcgauagcuauacacagguuugcgaccaccggcugaugucugccgcuaucaaagauuccaaggccgugcacgccgacaugggcuacuggauugagagcgagaagaaugagaccuggaaacuugcuagagccucuuucaucgaagugaagacauguaucuggcccaaaucccauacccucuggagcaacgggguccuggagucugagaugauuaucccgaagauuuauggaggcccuaucagccagcacaauuaccgccccggguacuuuacacaaaccgcgggaccuuggcaucugggcaaacucgaacuggauuucgaccuuugcgaggggacgaccgugguuguggaugaacacugcggaaaccggggccccucccugagaacaaccacagucaccggcaagauuauccacgagugguguugccggagcuguacgcucccuccccugcgcuuuaaaggggaggacggaugcugguauggcauggaaaucagaccggugaaggagaaggaagagaaucugguuaaaucuaugguguccgcugggagcggagaagucgacuccuucucucuuggccuccuguguauuagcaucaugauugaggaggugaugcgguccagauggucucgcaagaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaaaaugcgcccuauguucgcugucggacugcucuuuagacggcugacgucccgcgaagugcuccugcuuaccauuggccugucucucguggccagcgucgagcugcccaacucccuggaagaacuuggggauggacuggccaugggcaucaugauccucaagcugcucacagacuuccagagccaucaacugugggcuacccuucugucucucacauuuauuaaaaccacguucucccugcacuaugccuggaagacaauggcuaugguucugagcaucgugucucuuuuuccccugugucucuccaccaccagccagaagacaaccuggcugccugugcuccuggggucucuuggaugcaaaccgcugacaauguuccugauugccgaaaauaagaucuggggcagaaaauccuggccccucaacgagggcauuauggcggucgggaucgugagcauccugcuuuccagccugcucaagaacgauguuccucuggccggaccccucauugcuggcgggaugcugaucgccuguuacgugauuucuggaagcuccgcugaccuuucucuggagaaagccgccgaagucagcugggaggaagaggcugaacauuccggcgcgucucacaauauccugguggagguucaggaugacgggacgaugaagauuaaagaugaggaacgggacgauacccucacaauccugcuuaaggccacccugcucgcugugagcggagucuauccucuguccauccccgccacacucuucgugugguacuuuuggcagaagaaaaagcaacgcucuggcguccugugggacaccccuuccccucccgagguggaaagagccguucuugaugacggcauuuaucggaucaugcagcgcgggcugcugggaagaucccaggugggcgucgggguguuccaggagaacguuuuucauacgauguggcacgugacccggggagcuguccucauguaccaaggcaaacgccuggagcccagcugggccucugugaagaaagaccuuauuuccuacgggggaggcuggagacugcagggcagcuggaauacaggggaagaggugcagguuaucgcggucgaacccggaaagaacccuaagaaugugcagaccgcucccggcacauucaaaaccucugagggggaagugggagccauugcccucgauuuuaagccgggcacauccgggagcccuaucgucaaccgggagggaaaaauugugggccuguauggcaaugggguugugacgaccuccggaacauacgucucugcuaucgcccaagcgaaggcuagccaggagggcccccucccugaaaucgaggacgaaguguucagaaaacgcaaccugaccauuauggaucuucaccccggguccggaaagacccggagauaucugcccgccaucguucgcgaggccauuaagcggaaacugagaacacucauccuggcuccuacgcgcguggucgccagcgaaauggcugaggcccuuaagggcaugccgauucgguaccagaccacagcggugaaaucugagcauaccgggaaggaaaucguugaccugaugugccacgccacauuuaccaugagacuccugucccccgugcgcgucccuaauuauaacaugaucauuauggaugaggcucauuucacggaccccagcucuaucgccgcucggggcuacauuagcacaagagugggaaugggcgaagccgccgcuaucuuuaugaccgcgaccccucccggguccguggaggccuucccucaaucuaaugcugucauucaggaugaggaacgggacaucccggagcgcagcuggaacuccggauaugaauggaucacagauuuucccggcaaaaccguuugguucgugccuucuauuaagagcgggaaugacaucgccaacugucugagaaagaauggaaaacgggugauucagcucucccgcaagacauucgauaccgaguaccagaaaacgaagaacaacgacugggacuacgucgugacaaccgauaucagcgaaaugggcgccaauuuuagagcugaccggguuauugaucccagacgcugccuuaaaccugugauccugaaggacgggcccgagcgggucauucuggccggcccgaugccugugacaguugcgucugcugcccaaagacgcggacggaucggcagaaaccacaauaaggagggggaucaguauaucuacaugggacagccccucaacaaugacgaagaucaugcccacuggaccgaggcuaaaaugcugcuugacaacauuaauacgcccgaaggcaucauuccugcccuguucgagcccgaacgcgagaaguccgcggccaucgauggggaguaucggcucagaggagaagcucgcaaaaccuuuguggagcugaugagacggggcgaccugccugucuggcucagcuacaagguggccuccgaaggguuccaguauucugaucgcagauggugcuuugacggcgagcggaacaaucaaguccuugaagagaacauggauguggagauuuggacaaaagaaggagagcgcaagaaacugagaccgcgguggcuggacgcuagaaccuacagcgacccccucgcccugcgcgaguucaaggaguuugcugccggccggagauccguuucuggggaucuuauccuggaaaucggaaagcucccucagcaccugacacagcgcgcgcagaaugcccuggacaaccucgugaugcuucauaauagcgagcaaggcgggcgggcuuauagacacgccauggaggaacugcccgauaccauugagacacugaugcuccuggcucuuaucgccgugcugaccggaggcgucacgcuguucuuucuguccggccgggggcugggaaaaacaagcauuggccuccuuuguguuauggccucuuccgugcugcuguggauggcuagcguggaaccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugaaaugggacuucuggagacaaccaagaaagaccugggcauugggcacgucgcuguggaaaaccaccaucacgccgcgaugcucgaugucgaccugcaucccgccuccgcuuggacacuuuacgccguggcuacgaccaucauuacaccuaugaugcggcacaccaucgagaacacaaccgccaauauuagccugacggcgaucgccaaccaagcugccauccucaugggacuggauaagggcuggcccauuucuaaaauggacaucggcguuccucugcucgcucuugggugcuauagccaggugaauccccugacccugacagccgcuguccucaugcugguggcccauuacgcgauuaucggaccgggccuucaggccaaggcuacccgcgaagcccaaaagagaacagcugccgggauuaugaaaaacccuaccguugauggaaucguggccaucgaccuggaucccgucguguaugacacgaaguuugagaaacagcucggccagauuaugcugcugauccucuguacaucccagauucuucugaugcggaccacaugggcgcugugcgagucuaucacccucgcuaccgggccccugacaacgcuuugggaaggaagcccuggcaaguucuggaauaccacaauugccguguccauggcuaacaucuuccgcggcagcuaccuggccggggccggacucgcuuuuucccugaugaaaucucugggcgggggaagacggggcaccggggcccaaggagagacacucggcgaaaaguggaagcgccagcuuaaucagcugagcaaauccgaguucaacaccuauaagagaucuggcaucauggaaguugaccggagcgaggcgaaagaggggcugaagagaggagaaacgacaaaacacgccgucucccgcggcaccgcuaagcuccggugguuuguggagagaaaucuggugaagccggaagggaaagucauugaucuuggauguggccgcgggggauggucuuacuauugcgccggccugaagaaaguuaccgaggugaagggcuacacaaaagggggacccggccacgaggaaccuauccccauggcuaccuacggguggaaccucgugaagcugcauagcggaaaagacgucuucuuuauuccucccgagaagugugauacacugcucugcgacaucggcgaauccagcccuaauccgacgauugaggaagggcggacccuuagagugcugaagaugguugagcccuggcugcgcggaaaccaguucuguaucaaaauucucaauccuuauaugcccucuguggucgagacacuggaacaaaugcagcggaagcacggcggcaugcuugugagaaacccucugucccgcaauagcacccaugagauguacuggguuucuugcgggacaggaaacaucguguccgccgucaauaugaccagccggaugcuccugaacagauuuacgauggcgcaccgcaaacccaccuaugaacgggauguggaccugggcgccgggacaagacacguggcugucgagccggaaguugccaaccucgauaucauuggacagcgcaucgagaauauuaagcaugagcacaaaucuaccuggcauuacgacgaagauaacccuuauaagacaugggcuuaccacggcuccuaugaggugaagcccagcggguccgccagcucuauggugaauggagucgugaaacugcuuaccaagcccugggacguuaucccuauggugacacagauugcuaugaccgauacgacacccuucggccaacagagagucuuuaaagaaaagguggacacccggaccccuaaagccaagcgcggcacagcgcagaucauggagguuacggccaaguggcuguggggguuccucagcagaaacaaaaagccgcggaucuguaccagagaagaguuuacacggaaagugcgcuccaaugcugccauuggagcugucuucguggacgagaaccaauggaacucugccaaggaagccguugaggaugaaagauuuugggaccuggugcaucgggagcgcgaacuucacaaacagggcaagugcgcgaccugcgucuacaacaugauggggaagagagagaaaaagcugggagaguucggcaaagcuaaggggagccgggccaucugguacauguggcucggcgcccgcuuccuggaauuugaggcucugggauucaugaaugaagaucacugguuuuccagagagaacucucucagcggcguggagggggaaggacugcauaaacuuggcuauauucugcgggacaucuccaagauucccgggggaaauauguacgccgaugacacagcuggcugggauacccgcaucacagaggacgaucuccagaacgaagccaaaaucaccgacauuauggagccugaacacgcgcugcuugccaagucuaucuucaagcugacguaucagaauaaagucgugagaguucaacggcccgcuaagaacgggaccgugauggaugucauuagccgcagagaccagcggggcuccggacaggugggcacauacgggcucaauaccuuuacaaacauggaggcccagcugauccgccaaauggagagcgaaggaauuuucucuccuuccgagcuggaaacccccaaccucgcuggcagagugcuggauuggcuugagaaacaugggguugaacggcugaagagaauggccaucagcggagacgacuguguggucaaaccgaucgaugaccgcuuugcgacggcccucacagcucugaaugauaugggcaaggugcggaaggacauuccucagugggagcccucuaaaggguggaacgauuggcagcagguuccuuucugcucccaccacuuucaucaacuuaucaugaaggacggcagagagauugugguccccugucgcaaucaggaugaacuggugggacgggccagagucagccagggcgcuggguggucccuccgcgagaccgccugccugggaaaaucuuaugcucagauguggcaacugauguacuuccaccggagagaccuccgccuggccgcgaacgccaucuguagcgcugugccuguugauugggugcccacaucccggaccacguggagcauucaugcccaccaucaguggaugaccacagaagacaugcuuucugucuggaauagaguguggaucgaggaaaacccguggauggaggauaagacccacauuuccagcuggggcgacguuccuuaucuggggaaacgcgaggaccaguggugcggaucucucaucggccugacagcccgggcuaccugggccacaaauauccaaguggcgauuaaccaggucagacggcuuaucgggaaugaaaacuaccuggauuacaugaccagcaugaagagauuuaagaaugaguccgaccccgaaggcgcucucugguga

SEQ ID NO: 19283 - RNA, 9879 nt, Artificial Sequence
  derived and/or modified CDS sequence (opt5) from DENV-1__EU482814__SS-prME
agcgugaccaugcugcucaugcugaugcccaccgcccuugcuuuccaccugacgaccagaggcggggaaccucauaugauugucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucaugugggguuuggacuggagacaagaaccgaaacguggaugagcuccgagggcgccuggaaacagauucagcggguugaaacaugggcucugcgccaccccggcuucaccgugaucgcccucuuucuggcgcaugccauugggacaucuaucacccagaagggaaucauuuucauccuucugaugcucgucaccccuagcauggcuaugagaugcgugggcauugggucccgggauuuuguugagggacugagcggcgccacauggguggacgucgugcuugagcacgggucuugugugacgaccauggcuaaggauaaacccacacuggacaucgaacuccugaagaccgaggucacaaacccugccguucugcgcaaacucugcauugaagcgaagaucuccaauaccacgacagauagcagauguccgacccaaggagaggccacccugguggaagaacaagacgcuaacuucgugugccggcgcacauuugucgauagaggcuggggcaauggguguggacuuuucggcaaagggucucugauuaccugcgccaaguuuaagugcgugacaaaacucgagggaaagacgguucaguacgaaaaccugaaauauuccgugaucgucaccgugcacacaggcgaccagcaucaaguugggaaugagagcaccgaacacggaacaaccgcuacgaucacaccccaggccccuucuacagagauucagcuuaccgacuacggcgcccugacacucgauuguagcccccggaccggccuggacuucaacgaaauggugcugcucacgaugaaggagaaaagcuggcugguccauaagcagugguuucuugaucugccucuccccuggacauccggggcuucuaccagccaagagacauggaaucgcaaagaccugcuugugaccuucaagaccgcgcacgccaagaaacaggaagucgugguucugggaucccaggagggcgcuaugcacacagcccucacgggggccaccgaaauccaaacaagcggaaccacaaccauuuucgcuggccaucugaagugcagacugaaaauggauaagcucacgcugaaagggaugucuuaugugauguguacaggcuccuuuaaacuugagaaggaagucgccgagacccagcacggaaccgugcugguucagaucaaauacgagggcacagacgcgccgugcaagauuccuuucagcacccaggaugaaaaaggggugacacaaaacggacggcucaucacggcuaaucccaucgucaccgacaaggagaaaccugugaacauugaagccgagccgcccuuuggcgagucuuauaucgugauuggggccggagaaaaggcucugaagcugagcugguucaaaaagggcuccucuaucgggaaaauguuugaggccacagcuagaggcgcccgccggauggcgauucuuggagauaccgccugggacuucggcagcaucgggggaguuuuuacauccgucggcaagcucgugcaucagaucuucgggaccgcuuacggagugcuguuuagcggcgucucuuggacgaugaaaauugggaucggcgugcugcucaccuggcugggacuuaauuccagaagcacaucucuguccaugaccuguauugccguuggccucgugacacuguaccugggggucauggugcaggcugauagcggaugcguuaucaacuggaagggccgcgaacuuaaguguggguccggaauuuucgugaccaaugagguccacacauggaccgaacaguauaaauuucaagccgacucuccuaagcggcucagcgcggccaucggcaaggcuugggaggagggggugugcggcauuagauccgccacgcgccuggaaaacaucauguggaagcagaucucuaacgagcugaaucauauucuccuggaaaacgacaugaaauucacaguuguggucggagauguggcuggcauccuugcccaggggaagaaaaugauucggccgcagcccauggaguacaaguauagcuggaaguccuggggaaaagccaagaucauuggcgcugacgugcaaaauaccaccuuuaucaucgaugggccuaacacacccgaauguccugacgaucagagagcguggaauauuugggaggucgaggacuacggauucggcaucuucaccacgaacauuuggcugaaacuccgcgauagcuauacacagguuugcgaccaccggcugaugucugccgcuaucaaggauuccaaagccgugcacgccgacaugggcuacuggauugaaagcgagaagaaugaaaccuggaagcuggcuagagccucuuuuaucgaggugaaaacauguaucuggcccaagucccauacccuuuggagcaacgggguccucgaaucugagaugauuaucccgaaaauuuauggaggcccuaucagccagcacaauuaccgccccggguacuucacacaaaccgcgggaccuuggcaucugggcaagcuggagcucgauuuugaccugugcgaagggacgaccgugguuguggaugagcacugcggaaaccggggccccucccuuagaacaaccacagucaccggcaaaauuauccacgaaugguguugccggagcuguacgcugccuccccuccgcuucaagggggaggacggaugcugguauggcauggagaucagaccggugaaggaaaaagaggaaaaucugguuaagucuaugguguccgcugggagcggagaggucgacuccuuuucucugggccuucucuguauuagcaucaugauugaagaggugaugcgguccagauggucucgcaaaaugcugaugacagggacccuggccguuuucuuucuccugaucaugggacagcuuacauggaacgaucugauucggcucugcaucauggugggcgccaaugcuagcgacagaaugggcauggggaccaccuaccuggcccugauggcgacauucaagaugcgcccuauguuugcugucggacuucuguucagacggcucacgucccgcgaggugcugcuccugaccauuggccuuucucugguggccagcgucgaacuccccaacucccuggaggaacugggggauggacuugccaugggcaucaugauccugaaacuccugacagacuuucagagccaucaacucugggcuacccugcuuucucugacauucauuaagaccacguuuucccuccacuaugccuggaagacaauggcuaugguucugagcaucgugucucuguucccccuuugucuguccaccaccagccagaaaacaaccuggcucccugugcugcucgggucucugggaugcaagccgcuuacaauguuccugauugccgagaauaaaaucuggggcagaaaguccuggccccugaacgaaggcauuauggcggucgggaucgugagcauccuccuguccagccuucugaaaaacgauguuccucucgccggaccccugauugcuggcgggaugcucaucgccuguuacgugauuucuggaagcuccgcugaccugucucuugagaaggccgccgaggucagcugggaagaggaagcugagcauuccggcgcgucucacaauauccugguggaaguucaggaugacgggacgaugaaaauuaaggaugaggagcgggacgauacccugacaauccuccugaaggccacccuucuggcugugagcggagucuauccucucuccauccccgccacacuguuugugugguacuucuggcagaaaaagaaacaacgcucuggcguccucugggacaccccuuccccucccgaaguggagagagccguucuggaugacggcauuuaucggaucaugcagcgcgggcuucugggaagaucccaggugggcgucgggguguuucaggaaaacguuuuccauacgauguggcacgugacccggggagcuguccugauguaccaaggcaagcgccucgagcccagcugggccucugugaaaaaggaccugauuuccuacgggggaggcuggagacuucagggcagcuggaauacaggggaggaagugcagguuaucgcggucgagcccggaaagaacccuaaaaaugugcagaccgcucccggcacauuuaagaccucugaaggggaggugggagccauugcccuggauuucaaaccgggcacauccgggagcccuaucgucaaccgggaaggaaagauugugggccucuauggcaaugggguugugacgaccuccggaacauacgucucugcuaucgcccaagcgaaagcuagccaggagggcccccugccugagaucgaagacgagguguuuagaaagcgcaaccucaccauuauggaucugcaccccggguccggaaagacccggagauaucuucccgccaucguucgcgaagccauuaaacggaagcugagaacacugauccucgcuccuacgcgcguggucgccagcgagauggcugaagcccugaaaggcaugccgauucgguaccagaccacagcggugaagucugagcauaccgggaaagagaucguugaccuuaugugccacgccacauucaccaugagacugcucucccccgugcgcgucccuaauuauaacaugaucauuauggaugaagcucauuuuacggaccccagcucuaucgccgcucggggcuacauuagcacaagagugggaaugggcgaggccgccgcuaucuucaugaccgcgaccccucccggguccguggaagccuuuccucaaucuaaugcugucauucaggaugaggaacgggacaucccggagcgcagcuggaacuccggauaugaguggaucacagauuuccccggcaagaccguuugguucgugccuucuauuaagagcgggaaugacaucgccaacugucugcgcaagaauggaaagcgggugauucagcugucccgcaaaacauuugauaccgaauaccagaagacgaaaaacaacgacugggacuacgucgugacaaccgauaucagcgagaugggcgccaauuucagagcugaccggguuauugaucccagacgcugccucaagccugugauccuuaaggacgggcccgaacgggucauucuggccggcccgaugccugugacaguugcgucugcugcccaaagacgcggacggaucggcagaaaccacaauaaagagggggaucaguauaucuacaugggacagccccugaacaaugacgaggaucaugcccacuggaccgaagcuaagaugcuccuggacaacauuaauacgcccgagggcaucauuccugcccuuuuugaacccgagcgcgaaaaauccgcggccaucgauggggaguaucggcugagaggagaggcucgcaagaccuucguggaacucaugagacggggcgaccugccugucuggcugagcuacaaaguggccuccgagggguuucaguauucugaucgcagauggugcuucgacggcgaacggaacaaucaaguccucgaggaaaacauggauguggagauuuggacaaaggagggagaacgcaagaaacuuagaccgcgguggcuggacgcuagaaccuacagcgacccccuggcccuccgcgaguuuaaagaguucgcugccggccggagauccguuucuggggaucugauccuugagaucggaaaacugccucagcaccucacacagcgcgcgcagaaugcccuggacaaccuggugaugcuccauaauagcgaacaaggcgggcgggcuuauagacacgccauggaggagcuucccgauaccauugaaacacugaugcugcucgcucugaucgccgugcuuaccggaggcgucacgcuguuuuuccucuccggccgggggcugggaaagacaagcauuggccugcucuguguuauggccucuuccgugcuucuguggauggcuagcguggagccucauuggaucgcggccucuauuauccuggaauuuuuccucaugguccugcuuauccccgagccggaccgccagagaaccccucaggauaaccagcuggcuuacgugguuauugggcuccuguuuaugauccugaccguggccgccaaugagaugggacuccuugaaacaaccaaaaaggaccugggcauugggcacgucgcuguggagaaccaccaucacgccgcgaugcuggaugucgaccuccaucccgccuccgcuuggacacuguacgccguggcuacgaccaucauuacaccuaugaugcggcacaccaucgaaaacacaaccgccaauauuagccuuacggcgaucgccaaccaagcugccauccugaugggacucgauaaaggcuggcccauuucuaagauggacaucggcguuccucugcuggcucucgggugcuauagccaggugaauccccuuacccugacagccgcuguccugaugcucguggcccauuacgcgauuaucggaccgggccugcaggccaaggcuacccgcgaggcccagaagagaacagcugccgggauuaugaagaacccuaccguugauggaaucguggccaucgaccuugaucccgucguguaugacgcgaaauucgaaaagcagcugggccagauuaugcuccugauccuguguacgucccagauucuccuuaugcggacaaccugggcucugugcgagucuaucacacuggccaccgggccccucaccacacugugggagggaagcccuggcaaauucuggaauacgaccauugcuguguccauggccaacaucuuucgcggcagcuaccuugccggggcuggacuggccuucucccucaugaagucucugggcgggggaagacggggcacaggggcgcaaggagaaacccugggcgagaaguggaaacgccagcucaaucagcuuagcaaguccgaauuuaacacauauaaaagaucuggcaucauggagguugaccggagcgaagccaaggaggggcugaaaagaggagagaccacgaagcacgcugucucccgcggcacagccaagcugcggugguucguggaaagaaaucucgugaaaccggaggggaaggucauugaucugggauguggccgcgggggauggucuuacuauugcgcuggccuuaaaaagguuaccgaagugaaaggcuacaccaaagggggacccggccacgaggaaccuauccccauggccacauacggguggaaccuggugaaacuccauagcggaaaggacgucuuuuucauuccucccgagaagugugauacccugcugugcgacaucggcgaguccagcccuaauccgacaauugaagaggggcggacgcucagagugcuuaaaaugguugaacccuggcugcgcggaaaccaguuuuguaucaagauucugaauccuuauaugcccucuguggucgagacccucgagcaaaugcagcggaaacacggcggcaugcuggugagaaacccucuuucccgcaauagcacacaugaaauguacuggguuucuugcgggaccggaaacaucguguccgcggucaauaugacaagccggaugcugcucaacagauucaccauggcccaccgcaagcccacguaugagcgggauguggaccugggcgcugggaccagacacguggccgucgaaccggagguugcuaaccuggauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcuccugacaaaacccugggacguuaucccuauggugacccagauugccaugacagauaccacgcccuuuggccaacagagagucuucaaggagaaaguggacacacggaccccuaaggcgaagcgcggcaccgcccagaucauggaaguuacagcuaaauggcuuuggggguuucugagcagaaacaagaaaccgcggaucuguacgagagaggaguucacccggaaggugcgcuccaaugccgcuauuggagccgucuuuguggacgagaaccaauggaacucugccaaagaggcgguugaagaugagagauucugggaccucgugcaucgggaacgcgagcugcacaagcagggcaagugcgcuacaugcgucuacaacaugauggggaaaagagaaaagaaacuuggagaguucggcaaggccaaagggagccgggccaucugguacauguggcugggcgcucgcuuucucgaguucgaagcccugggauuuaugaaugaggaucacugguucuccagagaaaacucucugagcggcguggagggggagggacuccauaagcugggcuauauucuucgggacaucuccaaaauucccgggggaaauauguacgcugaugacaccgccggcugggauacacgcaucaccgaagacgaucugcagaacgaggcgaagaucacagacauuauggaaccugagcacgcccuccuggcuaagucuaucuuuaaacuuaccuaucagaauaaggucgugagaguucaacggcccgccaaaaacgggacggugauggaugucauuagccgcagagaccagcggggcuccggacaggugggcaccuacgggcugaauacauucaccaacauggaagcucagcucauccgccaaauggagagcgagggaaucuuuucuccuuccgaacuggagacacccaaccuggccggcagagugcucgauuggcuggaaaagcaugggguugagcggcuuaaaagaauggcgaucagcggagacgacuguguggucaagccgaucgaugaccgcuucgccaccgcucugacggcccucaaugauaugggcaaggugcggaaagacauuccucagugggaacccucuaagggguggaacgauuggcagcagguuccuuuuugcucccaccacuuccaucaacugaucaugaaagacggcagagagauugugguccccugucgcaaucaggaugagcuugugggacgggcuagagucagccagggcgccggguggucccugcgcgaaacagcuugccucggaaagucuuaugcccagauguggcaacugauguacuuucaccggagagaccugcgccucgcggccaacgcuaucuguagcgccgugccuguugauugggugcccaccucccggacaaccuggagcauucaugcccaccaucaguggaugacgaccgaggacaugcugucugucuggaauagaguguggaucgaagagaacccguggauggaagauaaaacacacauuuccagcuggggcgacguuccuuaucuugggaagcgcgaggaccaguggugcggaucucugaucggccucaccgcucgggccacaugggcgaccaauauccaaguggcuauuaaccaggucagacggcugaucgggaaugagaacuaccuugauuacaugacaagcaugaagagauucaaaaaugaauccgaccccgagggcgcccugugguga

SEQ ID NO: 19284 - RNA, 9879 nt, Artificial Sequence
  derived and/or modified CDS sequence (opt5) from DENV-1__EU482815__SS-prME
agcgugaccaugcugcugaugcugaugcccgccgcucuugccuuccaccugaccacgagaggcggggaaccucauaugaucgucuccaagcaggaacggggaaagucucuccuguuuaagaccagcgcgggcguuaauaugugcacacuuauugcuauggaccugggggaguucugugaagauaccaugacauacaagugcccgagaaucaccgaggccgaacccgacgauguggacuguuggugcaaugccacagauaccugggugacguauggaaccuguucccagacaggcgagcacagacgggacaagcgcucuguugcucucgccccucauguggggcugggacuggagaccagaacagaaaccuggaugagcuccgagggcgcuuggaaacagauucagcggguugaaacgugggcccuccgccaccccggcuuuacagugaucgcgcuguuccuugcccaugcuauugggaccucuaucacacagaagggaaucauuuuuauccugcucaugcuggucaccccuagcauggccaugagaugcgugggcauugggucccgggauuucguugagggacuuagcggcgcuaccuggguggacgucgugcuggagcacgggucuugugugacaacgauggccaaggauaaacccacccucgacaucgaacugcugaagacagaggucaccaacccugcgguucuccgcaaacugugcauugaagccaagaucuccaauacaaccacggauagcagauguccgacacaaggagaggcuacccuuguggaagaacaagacgccaacuuugugugccggcgcaccuucgucgauagaggcuggggcaauggguguggacuguuuggcaaagggucucucauuacaugcgcuaaguucaagugcgugaccaaacuggagggaaagacaguucaguacgaaaaccuuaaauauuccgugacggucaccgugcacacaggcgaccagcaucaaguugggaaugagagcaccgaacacggaacaaccgccacgaucacaccccaggccccuucuacagagauccagcugaccgacuacggcgcucucacacuggauuguagcccccggaccggccuggacuuuaacgaaauggugcuccugacgaugaaggagaaaagcuggcuuguccauaagcagugguuccuggaucucccucugcccuggacauccggggcgucuaccagccaagagacauggaaucgcaaagaccuucuggugaccuuuaagaccgcccacgcuaagaaacaggaagucgugguucucggaucccaggagggcgccaugcacacagcccugacgggggcuaccgaaauucaaacaagcggaaccacaaccaucuucgccggccaucugaagugcagacucaaaauggauaagcugacgcuuaaagggaugucuuaugugauguguacaggcuccuucaagcuggagaaggaagucgcggagacccagcacggaaccgugcucguucagauuaaauacgagggcacagacgcuccgugcaagaucccuuuuagcacccaggaugaaaaaggggugacacaaaacggacggcugauuacggccaaucccaucgucaccgacaaggagaaaccugugaacaucgaagccgagccgcccuucggcgagucuuauauugugaucggggcuggagaaaaggcccugaaacuuagcugguuuaaaaagggcuccucuauugggaaaauguucgaggcuacagccagaggcgcgcgccggauggccauccucggagauaccgcuugggacuuuggcagcauugggggaguuuucacauccgucggcaagcuggugcaucagaucuuugggaccgccuacggagugcuguucagcggcgucucuuggacgaugaaaaucgggauuggcgugcuccugaccuggcuuggacucaauuccagaagcacaucucucuccaugaccuguaucgcuguuggccuggugacacuguaccuuggggucauggugcaggccgauagcggaugcguuauuaacuggaagggccgcgaacucaaguguggguccggaaucuuugugaccaaugagguccacacauggaccgaacaguauaaauuccaagcggacucuccuaagcggcugagcgccgcuauuggcaaagccugggaggagggggugugcggcaucagauccgcuacgcgccuggaaaacauuauguggaagcagaucucuaacgagcucaaucauauccugcuugaaaacgacaugaaauuuacaguuguggucggagauguggccggcauucuggcccaggggaagaaaaugauccggccgcagcccauggaguacaaguauagcuggaaguccuggggaaaagcuaagauuaucggcgcggacgugcaaaauaccaccuucauuaucgaugggccuaacacacccgaauguccugacgaucagagagccuggaauaucugggaggucgaggacuacggauuuggcauuuucaccacgaacaucuggcucaaacugcgcgauagcuauacacagguuugcgaccaccggcugaugucugcugccauuaaggauuccaaagccgugcacgcugacaugggcuacuggaucgaaagcgagaagaaugaaaccuggaaacuugccagagcgucuuucauugaggugaaaacauguaucuggcccaagucccauacccucuggagcaacgggguccuggaaucugagaugaucauuccgaaaaucuauggaggcccuauuagccagcacaauuaccgccccggguacuuuacacaaaccgcuggaccuuggcaucugggcaagcucgagcuggauuucgaccuuugcgaagggacgaccgugguuguggaugagcacugcggaaaccggggccccucccugagaacaaccacagucaccggcaaaaucauucacgaaugguguugccggagcuguacgcucccuccccugcgcuuuaagggggaggacggaugcugguauggcauggagaucagaccggugaaggaaaaagaggaaaaucugguuaagucuaugguguccgccgggagcggagaggucgacuccuucucucuuggccuccuguguaucagcauuaugaucgaagaggugaugcgguccagauggucucgcaaaaugcugaugacagggacccucgccgucuuuuuccugcuuauuaugggacagcugacauggaacgaucucauccggcugugcauuauggugggcgcuaaugccagcgacagaaugggcauggggaccaccuaccuggcgcuuauggcuacauuuaagaugcgcccuauguucgccgucggacugcucuuuagacggcugacgucccgcgaggugcuccugcuuaccaucggccugucucucguggccagcgucgaacugcccaacucccuggaggaacuuggggauggacuggcuaugggcauuaugauccucaaacugcucacagacuuccagagccaucaacugugggccacccuucugucucucacauuuaucaagaccacguucucccugcacuaugcuuggaagacaauggccaugguucugagcauugugucucuuuuuccccugugucucuccaccaccagccagaaaacaaccuggcugccugugcuccuggggucucuuggaugcaagccgcugacaauguucuucaucgcggagaauaaaauuuggggcagaaaguccuggccccugaacgaaggcaucauggccgucgggauugugagcauccuccuguccagccuucugaaaaacgauguuccucucgcuggaccccugaucgccggcgggaugcucauugcuuguuacgugaucucuggaagcuccgccgaccugucucuugagaaggccgcugaggucagcugggaagaggaagcggagcauuccggcgccucucacaauauucugguggaaguucaggaugacgggacgaugaaaaucaaggaugaggagcgggacgauacccugacaauucuccugaaggcuacccuucuggccgugagcggagucuauccucucuccauccccgccacacuguuugugugguacuucuggcagaaaaagaaacaacgcucuggcguccucugggacaccccuuccccucccgaaguggagagagcuguucuggaugacggcaucuaucggauuaugcagcgcgggcuucugggaagaucccaggugggcgucgggguguuucaggaaaacguuuuccauacgauguggcacgugacccggggagccguccugauguaccaaggcaagcgccucgagcccagcugggcgucugugaaaaaggaccugaucuccuacgggggaggcuggagacuucagggcagcuggaauacaggggaggaagugcagguuauugcugucgagcccggaaagaacccuaaaaaugugcagaccgcccccggcacauuuaagaccucugaaggggaggugggagccaucgcucuggauuucaaaccgggcacauccgggagcccuauugucaaccgggaaggaaagaucgugggccucuauggcaaugggguugugacgaccuccggaacauacgucucugccauugcgcaagcuaaagccagccaggagggcccccugccugagaucgaagacgagguguuuagaaagcgcaaccucaccaucauggaucugcaccccggguccggaaagacccggagauaucuucccgccauuguucgcgaagcuaucaaacggaagcugagaacacugauucucgccccuacgcgcguggucgcuagcgagauggccgaagcgcugaaaggcaugccgauccgguaccagaccacagccgugaagucugagcauaccgggaaagagauuguugaccuuaugugccacgcuacauucaccaugagacugcucucccccgugcgcgucccuaauuauaacaugaucaucauggaugaagcccauuuuacggaccccagcucuauugcugcccggggcuacaucagcacaagagugggaaugggcgaggccgcugcgauuuucaugaccgccaccccucccggguccguggaggcuuuuccucaaucuaaugccgucauccaggaugaagaacgggacauuccggagcgcagcuggaacuccggauaugaguggaucacagauuuccccggcaagaccguuugguucgugccuucuaucaagagcgggaaugacauugccaacugucugcgcaagaauggaaagcgggugauccagcugucccgcaaaacauuugauaccgaauaccagaagacgaaaaacaacgacugggacuacgucgugacaaccgauauuagcgagaugggcgcuaauuucagagccgaccggguuaucgaucccagacgcugccucaagccugugauucuuaaggacgggcccgaacgggucauccuggcgggcccgaugccugugacaguugcuucugccgcccaaagacgcggacggauuggcagaaaccacaauaaagagggggaucaguauaucuacaugggacagccccugaacaaugacgaggaucaugcucacuggaccgaagccaagaugcuccuggacaacaucaauacgcccgagggcauuaucccugcgcuuuuugaacccgagcgcgaaaaauccgccgcuauugauggggaguaucggcugagaggagaggcccgcaagaccuucguggaacucaugagacggggcgaccugccugucuggcugagcuacaaaguggcuuccgagggguuucaguauucugaucgcagauggugcuucgacggcgaacggaacaaucaaguccucgaggaaaacauggauguggagaucuggacaaaggagggagaacgcaagaaacuuagaccgcgguggcuggacgccagaaccuacagcgacccccuggcucuccgcgaguuuaaagaguucgccgcgggccggagauccguuucuggggaucugauucuugagaucggaaaacugccucagcaccucacacagcgcgcccagaaugcucuggacaaccuggugaugcuccauaauagcgaacaaggcgggcgggccuauagacacgcuauggaggagcuucccgauaccaucgaaacacugaugcugcucgcccugauugccgugcuuaccggaggcgucacgcuguuuuuccucuccggccgggggcugggaaagacaagcaucggccugcucuguguuauggcuucuuccgcgcuucuguggauggccagcguggagccucauuggauugcugccucuaucauucuggaauuuuuccucauggugcugcuuauccccgagccggaccgccagagaaccccucaggauaaccagcuggccuacgucgugaucgggcuccuguuuaugauucugaccguugcugccaaugagaugggacuccuugaaacaaccaaaaaggaccugggcaucgggcacguggcggucgagaaccaccaucacgccgcuaugcuggauguggaccuccaucccgccuccgcuuggacacuguacgccgucgcgacgaccauuaucacaccuaugaugcggcacaccauugaaaacacaaccgccaauaucagccuuacggcuauugccaaccaagcugccauccugaugggacucgauaaaggcuggcccaucucuaagauggacauuggcgugccucugcuggcucucgggugcuauagccagguuaauccccuuacccugacagccgcggugcugaugcucgucgcccauuacgcuaucauuggaccgggccugcaggccaaggcuacccgcgaggcccagaagagaacagccgcggggaucaugaagaacccuaccguggauggaauuguugcuaucgaccuugaucccguggucuaugacgccaaauucgaaaagcagcugggccagaucaugcuccugauucuguguacgucccagauccuccuuaugcggacaaccugggcucugugcgagucuauuacacuggccaccgggccccucaccacacugugggagggaagcccuggcaaauucuggaauacgaccaucgccguguccauggcuaacauuuuucgcggcagcuaccuugccggggcgggacuggccuucucccucaugaagucucugggcgggggaagacggggcacaggggcucaaggagaaacccugggcgagaaguggaaacgccagcucaaucagcuuagcaaguccgaauuuaacacauauaaaagaucuggcaucauggagguggaccggagcgaagccaaggaggggcugaaaagaggagagaccacgaagcacgcuguuucccgcggcacagccaagcugcggugguucgucgaaagaaaucucgugaaaccggaggggaaggugaucgaucugggauguggccgcgggggauggucuuacuauugcgcgggccuuaaaaaggucaccgaaguuaaaggcuacaccaaagggggacccggccacgaggaaccuauucccauggccacauacggguggaaccuggugaaacuccauagcggaaaggacguguuuuucaucccucccgagaagugugauacccugcugugcgacauuggcgaguccagcccuaauccgacaaucgaagaggggcggacgcucagaguccuuaaaaugguggaacccuggcugcgcggaaaccaguuuuguauuaagauccugaauccuuauaugcccucuguuguggagacccucgagcaaaugcagcggaaacacggcggcaugcuggucagaaacccucuuucccgcaauagcacacaugaaauguacugggugucuugcgggaccggaaacauuguuuccgcugugaauaugacaagccggaugcugcucaacagauucaccauggcccaccgcaagcccacguaugagcgggaugucgaccugggcgcugggaccagacacguggccguggaaccggaggucgcuaaccuggauaucaucggacagcgcauugaaaauaucaaacaugagcacaagucuacauggcauuacgacgaggauaacccuuauaagaccugggccuaccacggcuccuaugaaguuaaacccagcggguccgcgagcucuauggugaauggaguggucaagcuccugacaaaacccugggacgugauuccuaugguuacccagaucgccaugacagauaccacgcccuuuggccaacagagaguguucaaggagaaagucgacacacggaccccuaaggcuaagcgcggcaccgcccagauuauggaagugacagcuaaauggcuuuggggguuucugagcagaaacaagaaaccgcggaucuguacgagagaggaguucacccggaagguucgcuccaaugccgccaucggagcgguguuugucgacgagaaccaauggaacucugcuaaagaggccguggaagaugagagauucugggaccucguucaucgggaacgcgagcugcacaagcagggcaagugcgccacaugcguguacaacaugauggggaaaagagaaaagaaacuuggagaguucggcaaggcuaaagggagccgggccauuugguacauguggcugggcgcucgcuuucucgaguucgaagcccugggauuuaugaaugaggaucacugguucuccagagaaaacucucugagcggcgucgagggggagggacuccauaagcugggcuauauccuucgggacauuuccaaaauccccgggggaaauauguacgcggaugacaccgccggcugggauacacgcauuaccgaagacgaucugcagaacgaggcuaagaucacagacaucauggaaccugagcacgcccuccuggcuaagucuauuuuuaaacuuaccuaucagaauaagguggucagagugcaacggcccgccaaaaacgggacgguuauggaugugaucagccgcagagaccagcggggcuccggacaggucggcaccuacgggcugaauacauucaccaacauggaagcgcagcucauucgccaaauggagagcgagggaaucuuuucuccuuccgaacuggagacacccaaccuggccggcagagugcucgauuggcuggaaaagcaugggguggagcggcuuaaaagaauggcuauuagcggagacgacuguguugugaagccgaucgaugaccgcuucgccaccgcucugacggcccucaaugauaugggcaagguccggaaagacaucccucagugggaacccucuaagggguggaacgauuggcaacaggugccuuuuugcucccaccacuuccaucaacugauuaugaaagacggcagagagaucguugugcccugucgcaaucaggaugagcuugucggacgggcuagagugagccagggcgccggguggucccugcgcgaaacagcgugccucggaaagucuuaugcccagauguggcaacugauguacuuucaccggagagaccugcgccucgcugccaacgccauuuguagcgcugucccuguggauuggguucccaccucccggacaaccuggagcauccaugcccaccaucaguggaugacgaccgaggacaugcugucuguguggaauagagucuggauugaagagaacccguggauggaagauaaaacacacaucuccagcuggggcgacgugccuuaucuugggaagcgcgaggaccaguggugcggaucucugauuggccucaccgcgcgggcuacaugggccaccaauauccaaguugccaucaaccaggugagacggcugauugggaaugagaacuaccuugauuacaugacaagcaugaagagauucaaaaaugaauccgaccccgagggcgcucugugguga

SEQ ID NO: 19285 - RNA, 9879 nt, Artificial Sequence
  derived and/or modified CDS sequence (opt5) from DENV-1__EU482816__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuaccccucccgagaagugugauacacugcucugcgacauuggcgaguccagcccuaauccgacgaucgaagaggggcggacccuuagagugcugaaaaugguugaacccuggcugcgcggaaaccaguucuguauuaagauccucaauccuuauaugcccucuguggucgagacacuggagcaaaugcagcggaaacacggcggcaugcuugugagaaacccucugucccgcaauagcacccaugaaauguacuggguuucuugcgggacaggaaacauuguguccgcggucaauaugaccagccggaugcuccugaacagauuuacgauggcccaccgcaagcccaccuaugagcgggauguggaccugggcgcugggacaagacacguggccgucgaaccggagguugcuaaccucgauaucaucggacagcgcauugaaaauaucaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuauuccuauggugacacagaucgccaugaccgauacgacacccuucggccaacagagagucuuuaaggagaaaguggacacccggaccccuaaggcgaagcgcggcacagcccagauuauggaaguuacggcuaaauggcuguggggguuccucagcagaaacaagaaaccgcggaucuguaccagagaggaauuuacacggaaggugcgcuccaaugccgcuaucggagccgucuucguggacgagaaccaauggaacucugccaaagaggcgguugaagaugagagauuuugggaccuggugcaucgggaacgcgagcuucacaagcagggcaagugcgcuaccugcgucuacaacaugauggggaaaagagaaaagaaacugggagaguucggcaaggccaaagggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaaaauccccgggggaaauauguacgcugaugacacagccggcugggauacccgcauuacagaagacgaucuccagaacgaggcgaagaucaccgacaucauggaaccugagcacgcccugcuugcuaagucuauuuucaaacugacguaucagaauaaggucgugagaguucaacggcccgccaaaaacgggaccgugauggaugucaucagccgcagagaccagcggggcuccggacaggugggcacauacgggcucaauaccuuuacaaacauggaagcucagcugauucgccaaauggagagcgagggaaucuucucuccuuccgaacuggagacccccaaccucgccggcagagugcuggauuggcuugaaaagcaugggguugagcggcugaaaagaauggcgauuagcggagacgacuguguggucaagccgaucgaugaccgcuuugccacggcucucacagcccugaaugauaugggcaaggugcggaaagacaucccucagugggaacccucuaagggguggaacgauuggcagcagguuccuuucugcucccaccacuuucaucaacuuauuaugaaagacggcagagagaucgugguccccugucgcaaucaggaugagcuggugggacgggcuagagucagccagggcgccggguggucccuccgcgaaaccgcuugccugggaaagucuuaugcccagauguggcaacugauguacuuccaccggagagaccuccgccuggcggccaacgcuauuuguagcgccgugccuguugauugggugcccacaucccggaccacguggagcauccaugcccaccaucaguggaugaccacagaggacaugcuuucugucuggaauagaguguggauugaagagaacccguggauggaagauaaaacccacaucuccagcuggggcgacguuccuuaucuggggaagcgcgaggaccaguggugcggaucucucauuggccugacagcucgggccaccugggcgacaaauauccaaguggcuaucaaccaggucagacggcuuauugggaaugagaacuaccuggauuacaugaccagcaugaagagauuuaaaaaugaauccgaccccgagggcgcccucugguga

SEQ ID NO: 19286 - RNA, 9879 nt, Artificial Sequence
  derived and/or modified CDS sequence (opt5) from DENV-1__EU482821__SS-prME
uccgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuaucgcgauggaccugggggagcucugugaagauacaaugaccuacaaaugcccgcgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggaaccgggauuuuguugagggacuguccggcgcuacguggguggacgucgugcucgagcacgggagcugugugaccacaauggccaaggauaaacccacccuggacaucgaacugcucaagacagaggucaccaauccugcuguucugcgcaaacuuugcauugaagccaagaucucuaacacgacaaccgauuccagauguccgacccaaggagaggcgacacugguggaggaacaagacgccaauuucgugugccggcgcaccuuugucgauagaggcuggggcaacggguguggacucuucggcaaagggagccugauuacaugcgcuaaguuuaagugcgugacgaaacuugagggaaagaucguucaguacgaaaaucugaaauauucugugaucgucaccgugcacacaggcgaccagcaucaaguugggaacgaguccaccgaacacggaacaaccgccacgauuacaccccaagcuccuaccaccgagauccagcucacagacuacggcgcccugacccuggauuguagcccccggacgggccucgacuucaaugaaauggugcugcuuacaaugaaggagaaaucuuggcugguccauaagcagugguuucucgaucugccucuucccuggaccuccggggccagcacaucccaagagaccuggaaccgccaggaccugcucgugaccuucaaaacagcucacgcgaagaagcaggaagucgugguucugggaucucaagagggcgccaugcacacggcucugaccggggccacagaaauucagaccagcggaacaaccacgaucuuugccggccaucucaaaugcagacugaagauggauaaacuuacacugaaggggauguccuaugugauguguaccggcagcuucaaacucgagaaggaagucgcugagacccagcacggaacagugcugguucagauuaaguacgagggcaccgacgccccgugcaaaaucccuuucucuacacaagaugaaaagggggugacgcagaauggacggcugaucaccgcgaaccccauugucacagacaaagagaagccugugaauaucgaagcugagccgcccuuuggcgaguccuauauugugaucggggccggagaaaaagcccuuaagcucagcugguucaagaaaggcucuagcauugggaagauguuugaggcuaccgccagaggcgcucgccggauggccauccugggagauacagcgugggacuucggcuccaucgggggaguuuuuaccucugucggcaaacuggugcaucagauuuucgggacggccuacggagugcucuuuagcggcgucuccuggaccaugaagaucgggauuggcgugcugcuuacauggcugggacucaacagcagaucuaccucccugagcaugacauguaucgcuguuggccuggugacccuuuaccucggggucauggugcaggccgauucuggaugcguuauuaauuggaaaggccgcgaacugaaguguggguccggaaucuucgugacaaacgagguccacaccuggacggaacaauauaaguuucaggcugacagcccuaaacggcuguccgccgcgauuggcaaggccugggaggagggggugugcggcaucagaucugcuacacgccucgaaaacaucauguggaaacagauuagcaaugagcugaaccauauccuucuggaaaaugacaugaaguucaccguuguggucggagauguggccggcauucucgcucaggggaaaaagaugauccggccgcaacccauggaguacaaauauuccuggaagucuuggggaaaggccaaaauuaucggcgccgacgugcagaacaccacauuuaucauugaugggccuaauacccccgaauguccugacgaucagagagcuuggaacaucugggaggucgaggacuacggauucggcauuuuuacgacaaauaucuggcugaagcugcgcgauagcuauacccagguuugcgaccaccggcuuauguccgcggccauuaaagauagcaaggcugugcacgccgacaugggcuacuggaucgaaucugagaaaaacgaaacauggaagcucgccagagcuuccuucaucgaggugaagaccuguauuuggcccaaaagccauacacuguggucuaaugggguccuggaauccgagaugaucauuccgaagaucuauggaggcccuauuagccaacacaacuaccgccccggguacuucacccagacggccggaccuuggcaucucggcaaacuggagcuugauuuugaccugugcgaagggaccacagugguuguggaugagcacugcggaaaucggggccccucucucagaaccacaaccgucacgggcaagaucauccacgaaugguguugccggagcuguacacugccuccccugcgcuucagaggggaggacggaugcugguauggcauggagauucggccggugaaagaaaaggaggaaaaccuuguuaaguccauggugagcgcggggucuggagaggucgacuccuuuagccucggccugcuguguaucuccauuaugaucgaagaggugaugagaucucgcuggagccggaaaaugcucaugaccgggacacuggcuguuuucuuucuucugauuaugggacagcucaccuggaaugaucugaucagacugugcauuauggugggcgccaacgccuccgaccgcaugggcauggggaccacauaccuugcucugauggccacguucaagaugagaccuauguuugcggucggacuccuguuccggcgccucaccucuagagaggugcugcuucugacaaucggccucagccugguggcuuccgucgaacugcccaauucucuugaggaacugggggauggacucgccaugggcaucaugauucugaaacuccugaccgacuuucaaagccaucagcuuugggccacacugcucucccugaccuucaucaagacgacauuuagccugcacuaugcuuggaaaaccauggccaugguucuuucuauugugucccuguucccccucugucugagcaccacaucucagaagaccacauggcucccugugcugcuugggucccugggaugcaagccgcugacgauguuucucaucgcugagaacaaaauuuggggccggcgcagcuggccccugaacgaaggcaucauggccgucgggaucgugucuauucuucuguccagccuccugaagaaugauguuccucucgcgggaccccugaucgccggcgggaugcuuauugcuuguuacgugaucuccggaagcucugccgaccugagccuggagaaagcugccgaggucuccugggaagaggaagccgagcauucuggcgcuagccacaacauucucguggaaguucaggaugacgggaccaugaagaucaaagaugaggagagagacgauacacugaccauccuucugaaggcgacacuccuggccguguccggagucuauccucucucuauucccgcuacccuguucgugugguacuucuggcagaagaagaagcagcggagcggcguccuuugggacacgccuagcccucccgaagugggccgcgccguucuggaugacgggaucuauagaauuaugcagcggggacugcucggccgcucucaggugggggucggaguguuucaagagaauguuuuccauaccauguggcacgugacaagaggcgccguccugauguaccaggggaaacggcuugaacccagcugggcuuccgugaagaaagaccugaucagcuacggaggcggcuggagacuccaggggucuuggaacaccggagaggaggugcagguuauugccgucgaacccggcaagaauccuaaaaacgugcaaacagcgcccgggaccuuuaagacaccggagggagaagugggcgcuaucgcccuggauuucaagccugggacguccggaagccccauugucaaucgcgagggcaaaaucgugggccucuaugggaacggaguugugaccacaucuggcaccuacgucuccgccaucgcucaggccaaggcgagccaggaagggccucugcccgagauugaggacgaaguguuucggaaaagaaaucuuaccaucauggaucugcaccccggauccggcaagacacgccgguaucugccugcuauuguuagagaggccaucaaacgcaagcuccggacgcugauucuugccccgaccagaguggucgcuucugaaauggccgaggcucugaaggggaugcccauccgcuaccaaacaaccgccgugaaaagcgaacauacaggcaaggagaucguugaccucaugugccacgcgaccuucacgaugcggcugcuguccccugugagaguccccaacuauaauaugauuaucauggaugaggcccauuuuacagacccuagcucuauugcugcccggggauacaucuccacccgcgugggcaugggggaagcugccgccauuuucaugaccgcuacacccccuggaagcguggaggcguuuccgcagucuaacgccgucauccaggaugaagagagagacauccccgaacggagcuggaacuccggcuaugaguggauuaccgauuucccugggaaaacaguuugguuugugcccucuaucaagagcggaaacgacauugcuaauugucuccgcaaaaacggcaagagagugauccagcuuucccggaagaccuucgauacggaguaccagaaaaccaagaacaaugacugggacuacgucgugaccacagauauuucugaaaugggggccaacuucagagccgaccgcguuaucgauccucggagaugccugaaacccgugauucugaaggacggcccggagcgcgucauccucgcuggaccuaugcccgugaccguugccagcgcggcucagcggagaggccgcaucgggcggaaucacaacaaagaaggagaucaguauauuuacaugggccagccccugaauaacgacgaggaucaugcccacuggacggaggccaagaugcuucuggacaauaucaacaccccugaagggauuauccccgcucucuuugagccugaaagagagaaguccgccgcgauugauggagaauaucgccugagaggcgaggcccggaaaacauucguggagcugaugcgcagaggggaccucccggucuggcuuagcuacaagguggcuucugaaggcuuucaauauuccgaucggcgcuggugcuucgacggagagagaaauaaccagguccuggaagagaauauggauguggaaaucuggaccaaagagggcgagcggaagaaacugagaccccgcuggcucgacgcccggacauacagcgacccucuggcucuuagagaauuuaaggaguucgccgcugggcgccgguccguuucuggagaucugauccucgaaauuggcaaacugccccagcaccugacccagagagcccaaaacgcgcucgacaaucuugugaugcugcauaacagcgagcaagggggacgggccuaucgccacgcuauggaggaacugccugauacaaucgagacccucaugcugcuugcccugauugcugugcucacgggcggcgucacacuguuuuuccuguccgggagaggacucggcaagaccucuaucgggcuucuguguguuauggccagcuccgugcugcucuggauggccagcguggaaccccauuggauugcugcgucuaucauccuggaguuuuuccuuaugguccugcucauuccggaaccugaccggcagcgcacaccccaggauaaucaacuggccuacgugguuaucggacugcucuuuaugauucuuacaguggcugccaacgagaugggccugcuggagaccacaaagaaagaccucgggaucggacacgucgccguggaaaaccaccaucacgcugccaugcuggaugucgaccuucauccugcguccgccuggacgcuguacgcuguggccaccacaauuaucacccccaugaugagacacacaauugagaauaccacggcuaacaucagccucaccgccaucgcgaaucaggccgcuauucugaugggccuggauaagggcuggccuaucucuaaaauggacauugggguuccccuccuugcccugggaugcuauucccaggugaacccgcugacacucaccgcugccguccugaugcuuguggcucauuacgccaucauuggcccugggcugcaagcgaaggccacacgggaagcucagaaacgcaccgccgcuggaaucaugaagaaucccacgguugauggcaucguggccauugaccucgaucccgucguguaugacgccaaguucgagaaacagcuggggcagaucaugcugcucauucuuuguacaagccaaauccugcugaugagaaccacaugggcgcucugcgaaucuauuacccuggcuaccggaccucuuacaacgcugugggagggcagcccgggcaaguuuuggaacaccacaaucgccguguccauggcuaauaucuuccgggggucuuaccucgccggagccggccuggcuuucagccugaugaaaucccucgggggaggccgcagagggaccggagcccagggcgagacacuuggcgaaaaguggaaacggcagcugaaccagcugagcaaguccgaguuuaauaccuauaagagaucugggauuauggaaguugaccgcagcgaggcgaaagaaggacucaagcggggcgagacgacaaaacacgccgucuccagagggaccgcuaagcugcgcugguucguggagcggaaccuugugaaacccgaaggaaaggucaucgaucugggcugugggagaggaggcuggucuuacuauugcgccggccucaagaaaguuaccgaggugaagggguacacaaaaggaggcccugggcacgaggagcccauuccuauggcuaccuacggauggaaucuggugaagcugcauagcggcaaagacgucuuuuucauucccccugaaaagugugauacacuccuuugcgacauuggggaguccucuccgaaccccacgaucgaggaaggacgcacccugcgggugcugaaaaugguugagccuuggcucagaggcaaucaauuuuguauuaagauccugaaccccuauaugccuagcguggucgaaacacuugagcagaugcagcgcaagcacggcgggaugcuggugcggaauccccucuccagaaacagcacccaugagauguacuggguuucuugcggaacaggcaauaucguguccgccgucaacaugaccagccgcaugcugcugaaccgguucacgauggcgcacagaaaaccgaccuaugaacgcgauguggaccucggggccggaacaagacacguggcugucgagccugaaguugccaaucuggauauuaucggccagcggauugagaacaucaagcaugaacacaaaucuaccuggcauuacgacgaggauaaucccuauaagacaugggcuuaccacggguccuaugaggugaaacccagcggaucugccuccagcauggugaacggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucuguccagaaauaagaagccccggauuuguacccgcgaagaguucacaagaaaagugcggagcaacgcugccaucggcgcugucuuuguggacgaaaaucaguggaacucugccaaggaggccguugaggaugaacgcuucugggaccuugugcauagagagcgggaacugcacaaacaggggaagugcgcgaccugcgucuacaauaugaugggaaaacgcgagaagaagcucggcgaauuugggaaagcuaagggcagcagagccauuugguacauguggcugggagcccgguuccuggaguucgaggcucucggcuuuaugaacgaagaucacugguucucccgcgaaaauucucugagcgggguggaaggagagggccuucauaaacugggguauauccucagagacauuuccaacaucccuggaggcaauauguacgccgaugacacagcugggugggauacccggaucacagaggacgaucugcagaacgaagcccgcauuaccgacaucauggagcccgaacacgcgcuucuggccaagucuauuuuuaaacucacguaucaaaauaaggucgugagaguucagcggccugcuaaaaacggcaccgugauggaugucaucagccgcagagaccagcggggauccggccagguggggacauacggacugaacaccuucacaaauauggaggcccaacugauuagacagauggaaucugagggcaucuuuagccccuccgagcucgaaaccccgaaccuggcugagcgcgugcuugauuggcuggaaaaguaugggguugagcggcucaagagaauggccaucagcggagacgacuguguggucaaaccuauugaugaccgcuucgcgacggcccugacagcucuuaaugauaugggcaaggugcggaaagacaucccccagugggaaccuucuaagggguggaacgauuggcagcaaguucccuuuugcucccaucacuuccaccagcugauuaugaaagacggcagagagaucguggucccuugucgcaaucaggaugagcucgugggacgggccagagucagccagggcgcuggguggucucugcgcgaaaccgccugccugggaaaguccuacgcucaaauguggcagcucauguauuuucaucggagagaccugcgccuugccgcgaacgccauuuguagcgcugugcccguugauuggaucccgacaucccggaccacguggucuauucacgcccaucaccaguggaugaccacagaggacaugcugagcguguggaauagagucuggaucgaagagaacccuuggauggaagauaagacccauaucuccagcuggggcgacgugcccuaccucgggaaacgggaggaccaauggugcggaucucugauuggccuuacagccagagcuaccugggccacaaauauccagguugcgauuaaccaggugcgccggcugaucgggaaugagaacuaccucgauuauaugaccuccaugaagagauucaaaaaugaaagcgaccccgagggcgcucugugguga

SEQ ID NO: 19287 - RNA, 9879 nt, Artificial Sequence
  derived and/or modified CDS sequence (opt5) from DENV-1__EU482822__SS-prME
agcgugaccaugcugcucaugcugaugcccaccgcccuugcuuuccaccugacgaccagaggcggggagccucauaugaucgugaccaagcaggaacggggaaagucccuccuguuuaagaccucugccggcguuaacaugugcacccuuauugccauggaccugggggagcucugugaagauaccaugacauacaaaugcccgcgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccauucugcgcaaacuuugcaucgaagcgaagauuucuaauacgacaaccgauuccagauguccgacccaaggagaggccacacugauggaagaacaagacgcuaacuucguuugccggcgcaccuuuguggauagaggcuggggcaauggguguggacucuucggcaaagggagccugaucacaugcgccaaguuuaagugcgugacgaaacuugagggaaagaucguccaguacgaaaaccugaaauauucugugauuguuaccgugcacacaggcgaccagcaucaagucgggaaugaguccaccgaacacggaacaaccgcuacgaucacaccccaggccccuacaagcgagauucagcucaccgacuacggcgcccugacacuggauuguucuccccggaccggccucgacuucaacgaaauggugcugcuuacgaugaaggagaaauccuggcugguucauaagcagugguuucucgaucugccucuucccuggacaagcggggcuuccaccucucaagagacauggaaucgccaggaccugcucgugaccuucaaaaccgcgcacgccaagaagcaggaagucgugguccugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaaguugccgagacccagcacggaaccgugcugguccagaucaaguacgagggcacagacgcgccgugcaaaaucccuuucuccacccaagaugaaaagggggugacacagaacggacggcugauuacggcuaaucccaucguuaccgacaaagagaagccugugaacauugaagccgagccgcccuuuggcgagagcuauaucgucauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcaucggcaaacuggugcaucagauuuucgggaccgcuuacggaguucucuuuuccggcgucagcuggacgaugaagaucgggauuggcgugcugcuuaccuggcugggacucaauucuagauccacaagccugucuaugaccuguaucgccgugggccuggucacacuuuaccucggggugaugguucaggcugauuccggaugcgugauuaacuggaaaggccgcgaacugaagugugggagcggaaucuucgucaccaaugaggugcacacauggaccgaacaauauaaguuucaggccgacuccccuaaacggcugucugcggccaucggcaaggcuugggaggaggggguuugcggcauuagaagcgccacgcgccucgaaaacaucauguggaaacagauuuccaacgagcugaaucauauccuucuggaaaacgacaugaaguucacaguggucgugggagauguugugggcauucucgcucaggggaaaaagaugauccggccgcaacccauggagcacaaauacucuuggaaaagcuggggaaaggccaagaucauuggcgccgacguccagaauaccaccuuuaucauugaugggccuaacacacccgaauguccugacgaucagagagcuuggaauaucugggagguggaggacuauggauucggcauuuuuaccacgaacaucuggcugaagaugcgcgauuccuacacacaggugugcgaccaccggcugaugagcgcggccaucaaagauucuaaggcuguccaugccgacaugggcuauuggauugaauccgagaaaaaugaaaccuggaaacuugccagagcuagcuucaucgagguuaagacauguauuuggcccaaaucucacacccucugguccaacggggugcuggaaagcgagaugaucauuccgaagaucuacggaggcccuaucucucaacauaauuaucgccccggguacuucacacagaccgccggaccuuggcaccugggcaaacucgagcuggauuuugaccuuugcgaagggacgaccguggucguggaugagcacugcggaaaccggggccccagccugagaacaaccacaguuaccggcaagauuauccaugaaugguguugccgguccuguacgcucccuccccugcgcuucaaaggggaggacggaugcugguacggcauggagauuagaccggugaaggaaaaggaggaaaaucuggucaaaagcauggugucugcgggguccggagagguugacagcuuuucccuuggccuccuguguaucucuauuaugaucgaagaggugaugcggagcagauggucccgcaagaugcugaugacagggacccucgcugucuuccugcuucugauuaugggacagcucacauggaacgaucugauccggcugugcaucauggugggcgccaaugccucugacagaaugggcauggggaccaccuaucuugcucugauggccacauuuaaaaugcgcccuauguucgcgguuggacuccuguuuagacggcucacgagccgcgaggugcugcuucugaccauuggccucucccuggucgcuucuguggaacugcccaacagccuugaggaacugggggauggacucgccaugggcaucaugauucugaagcuccugacagacuuccaaucccaccagcuuugggccacccugcucagccugacauuuaucaaaaccacgcugucucuucauuacgcuuggaagacaauggccauggugcuguccauugucagccucaucccccugugucucucuaccaccucccagaagacaaccuggcugccuguucuucuggggagccugggaugcaaaccgcucacaauguuccugaucgcugagaauaagauuuggggcagaaaaucuuggccccuuaacgaaggcaucauggccguggggguggucuccauucugcucagcucccugcucaagaacgaugugccucuggcgggaccccuuaucgccggcgggaugcugauugcuuguuauguuaucagcggaucuagcgccgaccugucccucgagaaagcugccgaggugucuugggaagaggaagccgagcacagcggcgcuucccauucuauccuggucgaagugcaggaugacgggacgaugaagauuaaagaugaggagcgggacgauacccuuacaauccugcucaaggcgacccugcucgccguuagcggaguguacccucuguccauucccgcuacacuuuuugucugguauuucuggcaaaagaaaaagcagcgcucuggcgugcugugggacaccccuagcccucccgaagucgagagagccgugcuggaugacggcaucuaccggauuaugcagcgcgggcuccugggaagaucccagguuggcgugggggucuuucaagaaaauguguuccacacgauguggcacguuacccggggagccgugcuuauguaucagggcaaacgccuggagcccagcugggcuucugucaagaaagaccucaucuccuacgggggaggcuggagacugcagggcagcuggaacacaggggaggaaguccaggugauugccguugagcccggaaagaauccuaagaacguccaaaccgcgcccggcacauucaaaaccccggaaggggaggugggagcuaucgcccucgauuuuaagccuggcacaucugggucccccaucgugaaucgggaaggaaaaauugucggccuguacggcaacggggugguuacgaccagcggaacauauguguccgccaucgcucaggccaaggcgucucaggagggcccucuucccgagauugaagacgaggucuucagaaaacgcaaucugaccaucauggaucugcaucccgggagcggaaagacccggagauaccucccugcuauugugcgcgaagccaucaagcggaaacugagaacacuuauccuggccccgacgcgcguuguggcuuccgagauggccgaagcucucaagggcaugcccauucgguaucaaaccacagccgucaaaagcgagcacaccgggaaggagaucguggaccugaugugccaugcgacauuuaccaugagacugcucucuccuguucgcgugcccaacuacaauaugauuaucauggaugaagcccacuucacggacccuuccagcauugcugcccggggcuauaucucuacaagagucggaaugggcgaggcugccgccaucuuuaugaccgcuacacccccugggagcguggaagcguucccgcaguccaacgccgugauucaggaugaggaacgggacauccccgagcgcucuuggaauagcggauacgaguggauuacagauuuuccuggcaaaaccgucugguucguucccuccaucaagucugggaacgacauugcuaauugucuuagaaagaacggaaaacgggugauccagcugagccgcaagacauuugauaccgaauaucagaagacgaagaauaacgacugggacuacguggucacaaccgauauuuccgagaugggcgccaacuucagagccgaccgggugaucgauccuagacgcugccugaaacccguuauccucaaggacgggccggaacgggugauucuggcuggcccuaugcccgucacaguggccagcgcggcucagagacgcggacggaucggcagaaaucauaacaaggagggggaucaguacauuuauaugggacagccccuuaauaacgacgaggaucacgcccacuggaccgaagccaaaaugcugcucgacaauaucaacacgccugagggcauuauccccgcucuguuugaaccugagcgcgaaaagucugccgcgaucgauggggaguaccggcugagaggagaggcccgcaaaaccuucguugaacucaugagacggggcgaccuuccgguguggcuguccuauaaggucgcuagcgagggguuccaauacuccgaucgcagauggugcuuugacggcgaacggaauaaccaggugcuggaggaaaauauggaugucgagauuuggacaaaagagggagaacgcaagaaacucagaccccgguggcuggacgccagaaccuauucugacccucuugcucugcgcgaguucaaggaauuugccgcuggccggagaagcguguccggggaucucauccuggagauuggaaagcugccccagcaucucacacagcgcgcccaaaacgcgcuugacaaucugguuaugcugcacaacucugaacagggcgggcgggccuacagacaugcuauggaggagcucccugauaccaucgaaacacugaugcuucuggcccucauugcugugcugaccggaggcgugacgcuguucuuucucagcggccgggggcuuggaaaaacauccaucggccugcugugugucauggccagcucuguucuccuguggauggccuccguggagccccacuggaucgcugcgagcauuauccuugaguucuuucugauggugcuccugauuccggagccugaccgccagagaacaccccaggauaaucaacuggccuaugucgugaucgggcuccuuuucaugauucugaccguugcugccaacgagaugggacugcucgaaacaaccaagaaagaccugggcaucgggcacguggccgucgagaaucaucaccaugcuacaaugcuugauguggaccugcacccugccucugcguggacgcucuacgccgucgcuaccacaauuaucacccccaugaugcggcauacaaucgaaaacaccacggccaacauuucccugaccgcuaucgccaaucaggcggccauucugaugggacucgauaagggcuggccuaucagcaaaauggacauuggcgugccccuucuggcucuggggugcuacucucagguuaacccgcucacacugaccgccgcugugcuuaugcuggucgcccacuaugcuaucaucggaccuggccuccaagccaaggcgacacgcgaggcccagaagagaaccgcugccgggauuaugaaaaaucccacgguggauggaaucguugcuauugaccuggaucccguggucuacgacgccaaguuugaaaaacagcugggccagaucaugcuccuuauucuguguacaagccaaauccugcucaugcggaccacaugggcccugugcgaguccaucacccuugcgaccgggccucugacaacgcucugggagggaucuccgggcaaguucuggaacaccacaauugcugugagcauggccaauaucuuucgcggcuccuaucuggcuggggccggacuggccuucagccucaugaaaucccuuggcgggggaagacggggcaccggggcucagggagaaacacugggcgagaaguggaagcgccagcugaaccagcucucuaaaagcgaauuuaauauuuacaagagauccggcaucauggagguggaccggucugaagccaaagaggggcugaagagaggagagaccacgcgccacgcgguuagccggggcacagccaaacuuagaugguucgucgaacgcaaccuggugaagcccgaggggaaggugauugaucucggauguggcagagggggaugguccuauuacugcgcuggccugaaaaaggucaccgaaguuaaaggcuauaccaaagggggaccuggccaugaggaacccaucccuauggccacauacggguggaaucuggugaaacuccacucuggaaaggacguguucuuuacacccccugagaaaugugauacacuucugugcgacauuggcgagagcuccccgaaccccacgaucgaagaggggagaacccugcgcguccucaagaugguggaaccuuggcugcggggaaaucaauucuguaucaagauucuuaaccccuacaugccuagcguuguggagacacuggagcagaugcagagaaaacauggcggcaugcucguccgcaauccccugucucggaacuccacccacgaaauguauugggugagcugcgggacaggaaauaucguuucugcugugaacaugaccuccagaaugcugcucaaucgcuuuacgauggcccaccggaagccgaccuacgagaaagaugucgaccugggcgcggggacaagacauguggccguggaaccugaggucgcuaaccuugauauuaucggacagcgcauugaaaacaucaagcacgagcauaaaagcaccuggcacuaugacgaggauaaucccuacaagacaugggccuaucauggcucuuacgaaguuaagcccuccgggagcgcuuccagcauggugaacggaguggucaaacugcucaccaagccuugggacgugauccccaugguuacacaaauugccaugaccgauacgacaccuuucggccagcagagaguguuuaaagagaaggucgacacccggaccccgaaagcuaagcgcggcacagugcaaaucauggaaguuacggccagauggcuguggggguuccuuucucggaauaagaaacccagaauuuguacccgggaggaauuuacacgcaaggugagaagcaacgcggccaucggagcugucuucguggacgagaaucaguggaacuccgccaaagaggcuguugaagaugagcgguuuugggaccuggugaagaaagaacgcgagcuccacaagcagggcaagugcgcgaccugcgucuauaauaugauggggaaaagagaaaagaaacugggagaguucggcaaggccaaagggucucgggcgauuugguacauguggcugggcgcucgcuuucucgaguucgaagcccugggauuuaugaacgaggaucacugguucagcagagaaaauucccuuucuggcguggagggggagggacugcauaagcucggcuacauccugcgggacaucagcaaaauuccugggggaaacauguaugccgaugacacagcuggcugggauacccgcaucacagaagacgaucuucagaaugaggccaagauuaccgacaucauggaacccgagcacgcucugcucgccacguccauuuucaagcugaccuaccaaaacaaagucgugagaguucagcggccugcgaagaaugggacagugauggaugucaucucucgcagagaccagcggggcagcggacaggugggcaccuaugggcugaacacauuuaccaauauggaagcccaacucauccgccagauggaguccgagggaauuuuccugcccagcgaacuugagacgccgaaccuggcugaaagagugcucgauuggcuggagaaauacggcguugaacggcuuaagagaauggccaucucuggggacgacuguguggucaaaccuauugaugaccgcuuugcuacagcccugaccgcgcucaacgauaugggaaaggugcggaaggacaucccccagugggagccuuccaaaggcuggaaugauuggcagcaaguucccuucugcagccaucacuuucaccagcugauuaugaaggacgggagagagaucguggucccuugucgcaaccaggaugaacuggugggccgggccagagucucucagggagcuggcuggucccuccgcgagacagccugccuggggaaaagcuaugcucaaauguggcagcuuauguacuuccaucggagagaccugcgccucgccgcuaaugccauuuguuccgcggugcccguugauugggugccgaccucucggacgaccuggagcauccacgcccaucaccaguggaugacaaccgaagacaugcuguccgucuggaacagaguguggaucgaggaaaauccuuggauggaggauaagacacauguuagcucuuggggagacgugcccuaucuuggcaaacgcgaggaccaauggugcgggucccugauuggacucaccgcucgggccacaugggccagcaacauccaggucgcuauuaaucaggugagacggcugaucggcaacgaaaauuaccuggauuacaugaccucuaugaagagauuuaagaacgagggggaccccgaaggcgcccucugguga

SEQ ID NO: 19288 - RNA, 9879 nt, Artificial Sequence
  derived and/or modified CDS sequence (opt5) from DENV-1__EU482476__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaaaaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaagggggacgggccuacagacaugcuauggaggagcugccugacacaaucgaaacccuuaugcugcucgcccugauugcuguccugacgggcggcguuacacucuuuuuccuuucugggcggggacugggcaaaaccagcaucgggcugcucugugugauggccuccagcgugcugcuuuggauggccucugucgagccccacuggauugcugcguccaucauucuggaauuuuuccucauggugcugcugaucccggagccugaucgccagagaacaccccaggacaaccaacucgccuauguugugaucggacuucuguuuaugauucugacagucgcugccaaugagaugggccuccuggaaaccacaaagaaagaucuugggaucggacacguggccgucgagaaccaucaccaugcuacgaugcuggacguggaucuccacccugccagcgcguggacccuguacgccguugcuacaaccauuaucacacccaugaugcggcauaccauugaaaacacgaccgccaauaucucucugacagcuauugccaaccaggcggccauccucaugggccuugacaagggcuggccuaucuccaaaauggauauuggggugccccugcuggcucucggaugcuacagccaggucaauccgcugacccuuacagccgcugugcugaugcucguugcccacuaugcuaucauuggcccugggcugcaagccaaggcgacccgcgaggcccagaagagaacggcugccggaaucaugaaaaaccccacaguggacggcauugucgcuaucgaucuggaccccgugguguacgaugccaaguucgaaaaacagcucgggcagaucaugcuucugauucuguguaccucucaaauccuccugaugcggacaaccugggcccuuugcgagagcauuacccuggcgacaggaccucucacgacccugugggagggcuccccgggcaaguuuuggaauacaaccaucgcuguuucuauggccaacauuuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacaucuacaagagaagcgggaucauggaggucgaccgguccgaagccaaagagggacuuaagagaggcgagacgacacgccacgcggugucucgggggaccgccaaacugagaugguucguggaacgcaaucucgucaagcccgagggaaagguuauugaccugggcugugggcggggaggcuggagcuauuacugcgcuggccugaaaaaggugaccgaagugaaaggguauacaaagggaggcccugggcaugaggaacccaucccuauggccaccuacggauggaaccucgucaaacuucacuccggcaaggauguguuuuucacacccccugagaaaugugacacgcugcugugcgauauuggggagucuagcccgaaucccaccaucgaagagggaagaacacuccgcguucugaagaugguggaaccuuggcuucggggcaaccaauuuuguauuaagauccugaaucccuacaugccuuccgucguggagacccucgagcagaugcagagaaaacauggcgggaugcugguucgcaacccccugagcagaaauucuacacacgaaauguauuggguguccugcggaaccggcaacauugucagcgcugugaauaugacgucuagaaugcuccugaaccgcuucaccauggcccaccggaagccgacauacgagagagacguggaucuuggggcgggaacccgccaugucgccguugaaccugagguggcuaaccuggacaucaucggccagagaauugaaaauaucaaacacgagcauaaguccacauggcacuaugaugaggacaaccccuacaaaaccugggccuaucaugggagcuacgaagugaagcccucuggauccgcuagcuccauggucaauggcgugguuaagcuccugacaaaaccuugggaugugauucccauggucacccaaaucgccaugacggacacaaccccuuuuggccagcagcggguguucaaggagaaaguugauacccgcacaccgaaggcuaaaagagggacggcccaaauuauggaagugaccgcgcgguggcuuuggggauuucugagcagaaacaagaagccccggaucuguacacgcgaggaguucaccagaaaaguccggucuaaugccgcuaucggcgccguguuuguugacgagaaccaguggaauagcgcuaaggaggccguggaagacgagcgcuucugggaucucguccagaaagaaagagagcugcacaagcaggggaaaugcgccacaugcguguauaacaugaugggaaagcgggaaaagaaacugggcgaguuugggaaggcgaaaggcucccgcgcuauuugguacauguggcucggagccagauuccuggaguuugaagcccuuggcuucaugaaugaggaccacugguucucucgggaaaacagccuguccggggucgagggagagggccuccauaagcugggguacauccuucgcgauauuucuaaaaucccuggaggcaauauguaugcugacgauaccgccgggugggacacaagaauuaccgaagaugaccugcaaaacgaggcuaagaucacggauaucauggaacccgagcacgcccuccuggcgaccagcauuuuuaaacugacauaccagaauaaggugguucgggugcagcgcccugccaagaacggcaccgucauggacgugaucuccagacgggaucagcgcggaucuggccaaguggggacauauggacucaauaccuucacgaacauggaagcucagcugauuagacagauggagagcgagggcaucuuucuucccuccgaacuggagacaccgaaccucgccgaacggguucuggacuggcuugagaaauacgggguggaaagacugaagcgcauggcuauuagcggagaugacugugucgugaaaccuaucgacgaucgguucgccaccgcgcucgccgcucugaaugacaugggcaagguuagaaaagauaucccccagugggagccuucuaagggguggaacgacuggcaacaggugcccuuuugcucccaucacuuccaccagcugauuaugaaggauggccgcgagaucgucgugccuugucggaaucaggacgaacucgucggacgggcccgcgugagccaaggcgcuggguggucucugcgggagacagccugccuuggaaaauccuaugcucagauguggcagcugauguacuuucauagacgcgaucuccggcuggccgcgaacgccauuuguagcgcuguucccguggacugggucccgaccuccagaacgaccuggucuauccacgcccaucaccaauggaugacaaccgaagauaugcuuagcguguggaaucgcguuuggauugaggaaaacccuuggauggaggacaagacacauguguccagcuggggcgauguccccuaucuggggaaacgggaggaccaguggugcggaucucucaucggccugaccgccagagcuacaugggccuccaauauucagguggcgaucaaccaggugcggagacugaucgggaaugaaaacuaccucgacuacaugaccagcaugaagcgcuucaaaaaugagggcgaucccgaaggagcucugugguga

SEQ ID NO: 19289 - RNA, 9879 nt, Artificial Sequence
  derived and/or modified CDS sequence (opt5) from DENV-1__EU482477__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaacucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuauauugugaucggggccggagaaaaagcucuuaagcucagcugguucaagaaaggcuccucuauugggaagauguuugaggccaccgcuagaggcgcccgccggauggcgauccugggagauacagccugggacuucggcagcaucgggggaguuuuuaccuccgucggcaaacuggugcaucagauuuucgggacagcuuacggagugcucuuuagcggcgucucuuggaccaugaagaucgggauuggcgugcugcuuacguggcugggacucaauuccagaagcaccucucuguccaugacauguaucgccguuggccuggugacccuuuaccucggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcugagcgcggccauuggcaaggcuugggaggagggggugugcggcaucagauccgccacccgccucgaaaacaucauguggaaacagauuucuaacgagcugaaucauauccuucuggaaaacgacaugaaguucacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuuaaccugugcgaagggaccacggugguuguggacgagcacugcggaaaucggggccccucccucagaaccacaaccgucacaggcaagaucauccacgaaugguguugccggagcuguacccugccuccccugcgcuucaaaggggaggauggaugcugguauggcauggagauuagaccggugaaggaaaaggaggaaaaccuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaaugaccugauccggcugugcauuauggugggcgccaacgcuagcgauagaaugggcauggggacaaccuaccuugcccugauggcgaccuucaaaaugcgcccuaugcucgcugucggacugcucuuuagacggcugacaucccgcgaggugcuucugcucacgaucggccugucucugguggccagcgucgaacuucccaauucccuggaggaacucggggacggacuggccaugggcaucaugauucucaagcugcuuaccgauuuccaaagccaucagcugugggcuacacuccugucucugaccuuuaucaaaacaaccuauucccuucacuacgccuggaagacgauggcuaugguucugagcauugugucucucuucccccugugucucuccacaaccagccagaagaccacauggcugccugugcuucuggggucucugggaugcaaaccgcucaccauguuucugaucgccgagaacaagauuuggggcagaaaauccuggccccuuaacgaaggcaucauggcggucgggaucgugagcauucugcucuccagccugcucaagaaugacguuccucuggccggaccccuuaucgcuggcgggaugcugauugccuguuaugugaucucuggaagcuccgcugaucugucucucgagaaagccgccgaggucagcugggaagaggaagcugagcauuccggcgcgucucacaacauucugguggaaguucaggacgaugggacaaugaagaucaaagacgaggagcgggaugacacgcuuaccauccugcucaaggccacacugcucgcugugagcggagucuacccucuguccauucccgccacccuuuucgugugguauuuuuggcaaaagaaaaagcagcgcucuggcguccugugggauacaccuuccccucccgaaguggagagagccguucuggacgauggcaucuaccggauuaugcagcgcgggcuccugggaagaucccaggugggcgucgggguguuccaagaaaauguuuuccauaccauguggcacgugacgcggggagcuguccuuauguaccagggcaaacgccuggagcccagcugggccucugugaagaaagaccucaucuccuaugggggaggcuggagacugcagggcagcuggaacaccggggaggaagugcagguuauugcggucgagcccggaaagaauccuaagaacgugcaaacagcucccggcaccuuuaaaacaucugaaggggaggugggagccaucgcccucgacuucaagccgggcaccuccgggagcccuauugucaaucgggaaggaaaaaucgugggccuguacggcaacgggguugugacaacguccggaaccuaugucucugcuaucgcccaggcgaaggcuagccaggagggcccccuuccugagauugaaaaugagguguuuagaaaacgcaaccugacaaucauggaucugcaccccggguccggaaagacccggagauaccuccccgccauuguucgcgaagccaucaagcggaaacugagaacccuuauucuggcuccuacacgcguggucgccagcgagauggcugaagcccucaagggcaugccgauccgguaucaaacgaccgcggugaaaucugagcauacagggaaggagaucguugaccugaugugccacgccaccuucacaaugagacugcucucccccgugcgcgucccuaauuacaacaugauuaucauggaugaagcucauuuuaccgaccccagcucuauugccgcucggggcuauaucagcacgagagugggaaugggcgaggccgccgcuauuuucaugacagcgaccccucccggguccguggaagccuuuccucagucuaaugcugucauccaggaugaggaacgggacaucccggagcgcagcuggaacuccggauacgaguggauuaccgauuuccccggcaaaacaguuugguuugugccuucuaucaagagcgggaaugacauugccaacugucuuagaaagaacggaaaacgggugauccagcugucccgcaagaccuucgauacagaauaccagaagaccaagaauaacgacugggauuaugucgugacgacagacauuagcgagaugggcgccaauuuuagagcugaccggguuaucgaucccagacgcugccugaaaccugugauucucaaggacgggcccgaacgggucauccuggccggcccgaugccugugaccguugcgucugcugcccagagacgcggacggaucggcagaaaccacaauaaggagggggaucaguacauuuauaugggacagccccuuaacaaugacgaggaucaugcccacuggacagaagcuaaaaugcugcucgacaacaucaauacccccgagggcauuaucccugcccuguucgaacccgagcgcgaaaaguccgcggccauugauggggaguaccggcugagaggagaggcucgcaaaacguucguggaacucaugagacggggcgaccuuccugucuggcugagcuauaagguggccuccgagggguuucaauacucugaucgcagauggugcuucgacggcgaacggaacaaucagguccuggaggaaaacauggauguggagaucuggaccaaagagggagaacgcaagaaacucagaccgcgguggcuggacgcuagaacauauagcgauccccuugcccugcgcgaguuuaaggaguucgcugccggccggagauccguuucuggggaccucauccuggagauuggaaagcugccucagcaccucacccagcgcgcgcaaaaugcccuugacaaccuggugaugcugcauaauagcgaacagggcgggcgggcuuacagacacgccauggaggagcuccccgauacaaucgaaacccugaugcuucuggcucucauugccgugcugacaggaggcgucacccuguuuuuccucuccggccgggggcuuggaaaaacgagcaucggccugcuguguguuauggccucuuccgugcuccuguggauggcuagcguggagccucauuggauugcggccucuaucauccuugaauuuuuccugaugguccuccugauucccgagccggaccgccagagaacaccucaggauaaccaacuggcuuacgugguuaucgggcuccuuuuuaugauucugaccguggccgccaacgagaugggacugcucgaaaccacaaagaaagaccugggcaucgggcacgucgcuguggagaaucaccaucacgccgcgaugcuugaugucgaccugcaucccgccuccgcuuggacccucuaugccguggcuacaacgauuaucaccccuaugaugcggcacacaauugaaaacaccacagccaauaucagccugaccgcgaucgccaaccaggcugccauucugaugggacucgauaagggcuggcccaucucuaaaauggacauuggcguuccucuucuggcucuggggugcuacagccaggugaauccccucacgcugaccgccgcuguccuuaugcugguggcccauuaugcgaucauuggaccgggccuccaagccaaggcuacacgcgaggcccagaagagaaccgcugccgggaucaugaaaaacccuacaguugauggaaucguggccauugaccuggaucccgucguguacgacgcgaaguucgaaaaacagcugggccagaucaugcuccuuauucuguguaccucccaaauccugcucaugcggacgacaugggcucugugcgagucuauuacccuugccacagggccccugaccacccucugggagggaagcccuggcaaguuuuggaauacaacgaucgcuguguccauggccaacaucuuccgcggcagcuaucuggccggggcuggacuggccuuuucccucaugaaaucucuuggcgggggaagacggggcaccggggcgcagggagaaacacugggcgagaaguggaagcgccagcugaaucagcucagcaaauccgaguucaacaccuacaagagaucuggcauuauggagguugaucggagcgaagccaaagaggggcugaagagaggagagacaaccaaacacgcugucucccgcggcacggccaaacuucggugguucguggaaagaaaucuggugaagccggaggggaaagucaucgaccucggauguggccgcgggggauggucuuauuacugcgcuggccugaagaaaguuacagaagugaagggcuacaccaaagggggacccggccacgaggaaccuauucccauggccaccuauggguggaaccuggugaagcuccauagcggaaaagacgucuuuuucaucccucccgagaagugugauacacuucugugcgacauuggcgaguccagcccuaauccgaccaucgaagaggggcggacacugagagugcucaagaugguugaacccuggcugcgcggaaaccaauuuuguauuaaaauccuuaauccuuacaugcccucuguggucgagacgcuggagcagaugcagcggaagcacggcggcaugcucgugagaaacccucugucccgcaauagcacccaugaaauguauuggguuucuugcgggacaggaaacaucguguccgcggucaacaugaccagccggaugcugcucaauagauucacaauggcccaccgcaaacccaccuacgagcgggauguggaccugggcgcugggacgagacacguggccgucgaaccggagguugcuaaccuugauauuaucggacagcgcauugaaaauaucaagcaugagcacaaaucuaccuggcauuaugacgaggauaacccuuacaagacaugggccuaucacggcuccuacgaagugaagcccagcggguccgcuagcucuauggugaauggagucgugaaacugcucaccaagcccugggacguuauuccuauggugacacaaaucgccaugaccgauacaacccccuuuggccagcagagagucuucaaagagaagguggacacgcggacaccuaaagcgaagcgcggcaccgcccaaaucauggaaguuaccgcuaaguggcuguggggguuucuuagcagaaacaaaaagccgcggauuuguacaagagaggaguucacgcggaaagugcgcuccaaugccgcuaucggagccgucuuuguggaugagaaccaguggaacucugccaaggaggcgguugaagacgagagauucugggaccuggugcaucgggaacgcgagcuccacaaacagggcaagugcgcuaccugcgucuacaacaugauggggaagagagagaaaaagcugggagaguuuggcaaagccaaggggagccgggccauuugguauauguggcugggcgcucgcuuccucgaguuugaagcccugggauucaugaaugaggaucacugguucuccagagaaaacucucuuagcggcguggagggggagggacugcauaaacucggcuacauccugcgggacauuuccaagauccccgggggaaauauguaugcugaugacacagccggcugggauacccgcaucacagaagacgaucuucagaacgaggcgaaaauuaccgacaucauggaaccugagcacgcccugcucgcuaagucuauuuuuaagcugacauaccaaaauaaagucgugagaguucagcggcccgccaagaacgggaccgugauggaugucaucagccgcagagaccagcggggcuccggacaggugggcacguaugggcugaacaccuucacaaauauggaagcucaacucauucgccagauggagagcgagggaaucuuuucuccuuccgaacuggagacccccaaccuugccggcagagugcuggauuggcucgaaaaacaugggguugagcggcugaagagaauggcgaucagcggagacgauuguguggucaaaccgauugacgaccgcuucgccacagcucuuaccgcccugaaugauaugggcaaggugcggaaggacaucccucagugggaacccucuaaaggguggaacgauuggcagcaaguuccuuuuugcucccaccacuuccaucagcucauuaugaaggacggcagagagaucgugguccccugucgcaaucaggaugagcuggugggacgggcuagagucagccagggcgccggguggucccugcgcgaaacggcuugccucggaaaaucuuacgcccaaauguggcagcugauguauuuucaccggagagaccuucgccuggcggccaacgcuauuuguagcgccgugccuguugauugggugcccacaucccggaccacauggagcauccaugcccaccaucaguggaugaccacggaggacaugcucucugucuggaauagaguguggauugaagagaacccguggauggaagauaagacccacaucuccagcuggggcgacguuccuuaccuggggaaacgcgaggaucaauggugcggaucucuuaucggccugacagcucgggccaccugggcgacaaauauucagguggcuaucaaccaggucagacggcucauugggaaugagaacuaccuggacuauaugaccagcaugaagagauucaagaaugaauccgaccccgagggcgcccugugguga

SEQ ID NO: 19290 - RNA, 9879 nt, Artificial Sequence
  derived and/or modified CDS sequence (opt5) from DENV-1__EU482478__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagccacacccaggucugcgaccaccggcucauguccgcggccaucaaagauagcaaggcuguucaugccgacaugggcuauuggaucgaaucugagaaaaaugaaacauggaagcuggccagagcuuccuucauugaggugaagaccuguaucuggcccaaaagccacacacuguggucuaacggggugcucgaauccgagaugauuaucccgaagauuuacggaggcccuaucagccaacauaauuaucgccccggguacuucacccagacggccggaccuuggcaccugggcaaacuugagcuggauuuugaccucugcgaagggaccacagucgugguugaugagcacugcggaaaccggggccccucucugagaaccacaaccgugacgggcaagaucauucaugaaugguguugccggagcuguacacugccuccccuucgcuucagaggggaggacggaugcugguacggcauggagauccggccggucaaagaaaaggaggaaaaucucgugaaguccaugguuagcgcggggucuggagagguggacuccuuuagccugggccugcucuguauuuccaucaugauugaagaggucaugagaucucgcuggagccggaaaaugcugaugaccgggacacuugcuguguucuuucugcucaucaugggacagcugaccuggaacgaucugauuagacuuugcaucaugguuggcgccaaugccuccgaccgcaugggcauggggaccacauaucuggcucucauggccacguucaagaugagaccuauguuugcggugggacuccuguuccggcgccugaccucuagagagguccuucugcucacaaucggccugagccugguggcuuccguggaacuucccaacucucuggaggaacucggggauggacuggccaugggcauuaugauccucaaacugcuuaccgacuuucaaagccaccagcugugggccacacuccugucccugaccuucauuaagacgacauuuagccuucauuacgcuuggaaaaccauggccaugguccugucuaucguuucccucuucccccugugucucagcaccacaucucagaagaccacauggcugccugugcuucuggggucccugggaugcaagccgcucacgauguuucugauugcugagaauaaaaucuggggccggcgcagcuggccccuuaacgaaggcaucauggccguggggauugucucuauccugcucuccagccugcucaagaacgaugugccucuggcgggaccccuuauugccggcgggaugcugaucgcuuguuauguuauuuccggaagcucugccgaccugagccucgagaaagcugccgagguguccugggaagaggaagccgagcacucuggcgcuagccauaauauccuggucgaagugcaggaugacgggaccaugaagaucaaagaugaggagagagacgauacacuuaccauucugcucaaggcgacacugcucgccguuuccggaguguacccucugucuauccccgcuacccuuuucgucugguauuucuggcagaagaagaagcagcggagcggcgugcugugggacacgccuagcccucccgaagucgagcgcgccgugcuggaugacggcauuuacagaaucaugcagcgggggcuccugggacgcucucagguuggcgugggggucuuucaagaaaacguguuccacaccauguggcacguuacaagaggagccgugcuuauguaucagggcaaacggcuggagcccagcugggcuuccgucaagaaagaccucauuagcuacgggggaggcuggagacugcagggcucuuggaauaccggggaggaaguccaggugaucgccguugagcccggaaagaacccuaaaaauguccaaacagcgcccggcaccuuuaagacaccggaaggggaggugggagcuauugcccucgauuucaagccuggcacguccgggagccccaucgugaaccgcgaaggaaaaaucgucggccuguacggcaauggggugguuaccacaucuggaaccuauguguccgccauugcucaggccaaggcgagccaggagggcccucuucccgagaucgaagacgaggucuuucggaaaagaaaccugaccauuauggaucugcaucccggguccggaaagacacgccgguaccucccugcuaucgugagagaagccauuaaacgcaagcugcggacgcuuauccuggccccgaccagaguuguggcuucugagauggccgaagcucucaagggcaugcccauccgcuaucaaacaaccgccgucaaaagcgagcacacagggaaggagauuguggaccugaugugccaugcgaccuucacgaugcggcugcucuccccuguuagagugcccaauuacaacaugaucauuauggaugaagcccacuuuacagacccuagcucuaucgcugcccggggcuauauuuccacccgcgucggaaugggcgaggcugccgccaucuucaugaccgcuacacccccugggagcguggaagcguuuccgcagucuaaugccgugauccaggaugaggaaagagacauucccgagcggagcuggaacuccggauacgaguggaucaccgauuucccuggcaaaacagucugguuuguucccucuauuaagagcgggaaugacaucgcuaacugucuucgcaaaaauggaaagagagugauucagcugucccggaagaccuucgauacggaauaucagaagaccaagaacaacgacugggacuacguggucaccacagauaucucugagaugggcgccaauuucagagccgaccgcgugauugauccucggagaugccugaaacccguuauccucaaggacgggccggaacgcgugauccuggcuggcccuaugcccgucaccguggccagcgcggcucagcggagaggacgcauuggccggaaccauaauaaagagggggaucaguacaucuauaugggacagccccuuaacaaugacgaggaucacgcccacuggacggaagccaagaugcugcucgacaacauuaauaccccugagggcaucauucccgcucuguuugaaccugagagagaaaaguccgccgcgaucgauggggaguaccgccugagaggagaggcccggaaaacauucguugaacucaugcgcagaggcgaccuuccgguguggcugagcuauaaggucgcuucugagggguuucaauacuccgaucggcgcuggugcuucgacggcgaaagaaacaaucaggugcuggaggaaaacauggaugucgagaucuggaccaaagagggagaacggaagaaacucagaccccgcuggcuggacgcccggacauauagcgacccucuugcucugagagaguuuaaggaguucgccgcuggccgccgguccgugucuggggaucucauucuggagaucggaaaacugccccagcaucucacccagagagcccaaaaugcgcuugacaaccugguuaugcugcacaauagcgaacagggcgggcgggccuaccgccaugcuauggaggagcucccugauacaauugaaacccugaugcuucuggcccucaucgcugugcugacgggaggcgugacacuguuuuuccucuccggcagagggcuuggaaagaccucuauuggccugcugugugucauggccagcuccguucuccuguggauggccagcguggagccccacuggaucgcugcgucuaucauucuugaauuuuuccugauggugcuccugaucccggagccugaccggcagcgcacaccccaggauaaccaacuggccuaugucgugauugggcuccuuuuuaugauccugacaguugcugccaaugagaugggacugcucgaaaccacaaagaaagaccugggcauugggcacguggccgucgagaaccaucaccaugcugccaugcuugauguggaccugcacccugcguccgccuggacgcucuacgcugucgccaccacaaucauuacccccaugaugagacauacaaucgaaaacaccacggcuaauaucagccugaccgccauugcgaaccaggccgcuauccugaugggacucgauaagggcuggccuauuucuaaaauggacaucggcgugccccuucuggcccuggggugcuacucccagguuaauccgcucacacugaccgcugccgugcuuaugcuggucgcucacuaugccauuaucggaccuggccuccaagcgaaggccacacgggaggcucagaaacgcaccgccgcugggaucaugaagaaccccacgguggauggaauuguugccaucgaccuggaucccguggucuacgacgccaaguucgaaaaacagcugggccagauuaugcuccuuauccuguguacaagccaaauucugcucaugagaaccacaugggcgcugugcgagucuaucacccuugcuaccgggccucugacaacgcucugggagggaagcccgggcaaguuuuggaauaccacaaucgccguguccauggcuaacauuuuccggggcucuuaucuggccggggccggacuggcuuucagccucaugaaaucccuuggcgggggacgcagaggcaccggggcccagggagaaacacugggcgagaaguggaaacggcagcugaaucagcucagcaaguccgaauuuaacaccuacaagagaucuggcaucauggagguggaccgcagcgaagcgaaagaggggcugaagcggggagagacgacaaaacacgccguuuccagaggcaccgcuaaacuucgcugguucgucgaacggaaucuggugaaacccgaggggaaggugauugaucucggauguggcagagggggauggucuuauuacugcgccggccugaagaaagucaccgaaguuaagggcuauacaaaagggggaccuggccaugaggaacccaucccuauggcuaccuacggguggaaccuggugaagcuccacagcggaaaagacguguuuuucauucccccugagaagugugauacacuucugugcgacaucggcgaguccucuccgaaucccacgauugaagaggggcgcacccugcggguccucaaaaugguggaaccuuggcugagaggaaaccaauuuuguaucaagauccuuaaucccuacaugccuagcguuguggagacacuggagcagaugcagcgcaagcauggcggcaugcucguccggaacccccuguccagaaauagcacccacgaaauguauugggugucuugcgggacaggaaacauuguuuccgccgugaauaugaccagccgcaugcugcucaaccgguucacgauggcgcacagaaaaccgaccuacgagcgcgaugucgaccugggcgccgggacaagacauguggcuguggaaccugagaucgccaaccuugauauuaucggacagcggauugaaaauaucaagcacgagcauaaaucuaccuggcacuaugacgaggauaaccccuacaagacaugggcuuaucauggcuccuacgaagucaaacccagcgggucugccuccagcaugguuaauggaguggugaagcugcucaccaagccuugggacgucauccccauggugacacaaauugcuaugaccgauacgacaccuuuuggccagcagcgcguuuucaaagagaagguggacaccagaaccccgaaagccaagcggggcacagcgcaaaucauggaagucacggccaaauggcuguggggguuucuuuccagaaacaagaagccccggauuuguacccgcgaggaguucacaagaaaagugcggagcaaugcugccaucggagcuguuuuuguggacgagaaccaguggaacucugccaaggaggccgucgaagaugagcgcuucugggaccuggugcacagagaacgggagcuccacaaacagggcaagugcgcgaccugcguuuauaacaugauggggaaacgcgaaaagaagcugggagaguuuggcaaagcuaaggggagcagagccauuugguacauguggcugggcgcccgguuccucgaguucgaagcucugggauuuaugaaugaggaucauugguucucccgcgaaaacucucuuagcggcguggagggggagggacugcacaaacucggcuacauccugagagacaucuccaagauuccugggggaaauauguaugccgaugacacagcuggcugggauacccggaucacagaagacgaucuucagaacgaggcccgcauuaccgacaucauggaacccgagcaugcgcugcucgccaaaucuauuuuuaagcugacguaccaaaauaaagucgugagaguccagcggccugcuaagaacgggaccgugauggauguuaucagccgcagagaccagcggggcuccggacaggugggcacauaugggcugaauaccuucacaaacauggaagcccaacucaucagacagauggagucugagggaauuuuuagccccuccgaacuggagaccccgaaccuugcugaacgcguccuggauuggcucgagaaguacggcguggaacggcugaaaagaauggccaucagcggggacgacugugugguuaagccuauugaugaccgcuucgcgacggcccuuacagcucugaaugauaugggaaaagugcggaaggacaucccccagugggagccuucuaaaggcuggaacgauuggcagcaaguccccuuuugcucccaccacuuccaucagcucauuaugaaggacgggagagagaucgugguuccuugucgcaaucaggaugaacuggugggccgggccagagucagccagggagcuggcuggucucugcgcgagaccgccugccucgggaaguccuaugcucaaauguggcagcugauguacuuucaccggagagaccuucgccuggccgcgaacgccauuuguagcgcugugcccgucgauuggaucccgacaucccggaccacguggucuauccaugcccaccaucaguggaugaccacagaagacaugcucagcguguggaauagaguuuggauugaggaaaacccuuggauggaggauaaaacccacaucuccagcuggggagacgugcccuaucugggcaagcgggaggaccaauggugcgggucucuuauuggacugacagccagagcuaccugggccacaaauauccaggucgcgauuaaccaggugcgccggcucaucggcaaugaaaacuaccuggauuacaugaccuccaugaaaagauucaagaaugagggggaccccgaaggcgcucugugguga

SEQ ID NO: 19291 - RNA, 9879 nt, Artificial Sequence
  derived and/or modified CDS sequence (opt5) from DENV-1__EU482479__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauuuguaccggcucuuucaaacucgagaaggaagucgcugagacccagcacggaacagugcugguucagaucaaguacgagggcaccgacgccccgugcaaaaucccuuucuccacacaagaugaaaagggggugacgcagaacggacggcugauuaccgcgaaucccaucgucacagacaaagagaagccugugaacauugaagcugagccgcccuuuggcgagagcuauaucauuaucggggccggagaaaaagcccuuaagcucucuugguucaagaaaggcagcuccaucgggaagauguuugaggcuaccgccagaggcgcucgccggauggccauucugggagauacagcgugggacuucggcucuaucgggggaguguuuaccagcguuggcaaacugguccaucagauuuucgggacggccuacggagugcucuuuuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcugucugccgcgaucggcaaggccugggaggagggggucugcggcauuagaagcgcuacacgccucgaaaacaucauguggaaacagauuuccaacgagcugaaucauauccuucuggaaaacgacaugaaguucaccgugguugugggagaugucgccggcauucucgcucaggggaaaaagaugauccggccgcaacccauggaguacaaauauucuuggaaaagcuggggaaaggccaagaucauuggcgccgacgugcagaauaccacauuuaucauugaugggccuaacacccccgaauguccugacgaucagagagcuuggaauaucugggagguggaggacuacggauucggcauuuuuacgacaaacaucuggcugaagcugcgcgauucccacacccaggucugcgaccaccggcuuaugagcgcggccaucaaagauucuaaggcuguucaugccgacaugggcuauuggauugaauccgagaaaaaugaaacauggaagcucgccagagcuagcuucaucgaggugaagaccuguauuuggcccaaaucucacacacugugguccaacggggugcuggaaagcgagaugaucauuccgaagaucuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagauuauccaugaaugguguugccgguccuguacacugccuccccugcgcuucagaggggaggacggaugcugguacggcauggagauucggccggucaaagaaaaggaggaaaaucuugucaagagcaugguuucugcgggguccggagagguggacagcuuuucccucggccugcuguguaucucuauuaugaucgaagaggucaugagaagccgcuggucccggaaaaugcucaugaccgggacacuggcuguguucuuucuucugauuaugggacagcucaccuggaacgaucugaucagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaauuggccucucccugguggcuucuguggaacugcccaacagccuugaggaacugggggauggacucgccaugggcaucaugauucugaaacuccugaccgacuuucaaucccaccagcuuugggccacacugcucagccugaccuucaucaagacgacauuuucucugcauuacgcuuggaaaaccauggccaugguccuuuccauuguuagccuguucccccucugucugucuaccacaucccagaagaccacauggcucccugugcugcuugggagccugggaugcaagccgcugacgauguuucucaucgcugagaauaaaaucuggggccggcgcucuuggccccugaacgaaggcauuauggccguggggaucgucuccauucuucugagcucccuccugaagaacgaugugccucucgcgggaccccugaucgccggcgggaugcuuauugcuuguuauguuaucagcggaucuagcgccgaccugucccuggagaaagcugccgaggugucuugggaagaggaagccgagcacagcggcgcuucccauaauauccucgucgaagugcaggaugacgggaccaugaagauuaaagaugaggagagagacgauacacugaccauccuucugaaggcgacacuccuggccguuucuggaguguacccucucagcauucccgcuacccuguucgucugguauuucuggcagaagaagaagcagcgguccggcgugcuuugggacacgccuucucccccggaagucgagcgcgccgugcuggaugacggcaucuacagaauuaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuuuaagacaccggaaggggaggugggagcuaucgcccuggauuucaagccuggcacgagcgggucucccaucgugaaccgcgaaggaaaaauugucggccucuacggcaauggggugguuaccacauccggaaccuaugugagcgccaucgcucaggccaaggcgucccaggagggcccucugcccgagauugaagacgaggucuuucggaaaagaaaccuuaccaucauggaucugcaucccgggucuggaaagacacgccgguaccugccugcuauugugagagaagccaucaaacgcaagcuccggacgcugauccuugccccgaccagaguuguggcuagcgagauggccgaagcucugaagggcaugcccauucgcuaucaaacaaccgccgucaaauccgagcacacagggaaggagaucguggaccucaugugccaugcgaccuucacgaugcggcugcugagcccuguuagagugcccaauuacaacaugauuaucauggaugaagcccacuuuacagacccuucuuccauugcugcccggggcuauaucagcacccgcgucggaaugggcgaggcugccgccaucuucaugaccgcuacacccccugggucuguggaagcguuuccgcagagcaaugccgugauucaggaugaggaaagagacauccccgagcgguccuggaacucuggauacgaguggauuaccgauuucccuggcaaaacagucugguuuguucccagcaucaaguccgggaaugacauugcuaacugucuccgcaaaaauggaaagagagugauccagcuuucucggaagaccuucgauacggaauaucagaaaaccaagaacaacgacugggacuacguggucaccacagauauuagcgagaugggcgccaauuucagagccgaccgcgugaucgauccucggagaugccugaaacccguuauccugaaggacgggccggaacgcgugauucucgcuggcccuaugcccgucaccguggccuccgcggcucagcggagaggacgcaucggccggaaccauaauaaagagggggaucaguacauuuauaugggacagccccugaacaaugacgaggaucacgcccacuggacggaagccaagaugcuucuggacaacaucaauaccccugagggcauuauccccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagauuuggaccaaagagggagaacggaagaaacugagaccccgcuggcucgacgcccggacauauuccgacccucuggcucuuagagaguuuaaggaguucgccgcuggccgccggucugugagcggggaucugauccucgagauuggaaaacugccccagcaucugacccagagagcccaaaaugcgcucgacaaccuuguuaugcugcacaauuccgaacagggcgggcgggccuaccgccaugcuauggaggagcugccugauacaaucgaaacccucaugcugcuugcccugauugcugugcucacgggaggcgugacacuguuuuuccugucuggcagagggcucggaaagaccagcaucggccuucugugugucguugccuccagcgugcugcucuggauggccucuguggagccccacuggaucgcugcguccauuauccuggaauuuuuccuuaugguccugcucauuccggagccugaccggcagcgcacaccccaggauaaccaacuggccuaugugguuaucgggcugcucuuuaugauucuuacaguggcugccaaugagaugggacugcuggaaaccacaaagaaagaccucggcaucgggcacgucgccguggagaaccaucaccaugcugccaugcuggaugucgaccuucacccugcgagcgccuggacgcuguacgcuguggccaccacaauuaucacccccaugaugagacauacaaucgaaaacaccacggcuaauauuucucucaccgccaucgcgaaccaggccgcuauucugaugggacuggauaagggcuggccuaucuccaaaauggacauuggcguuccccuccuugcccuggggugcuacagccaggugaauccgcugacacucaccgcugccguccugaugcuuguggcucacuaugccaucaucggaccuggccugcaagcgaaggccacacgggaggcucagaaacgcaccgccgcugggauuaugaagaaccccacgguugauggaaucguggccauugaccucgaucccgucguguacgacgccaaguucgaaaaacagcugggccagaucaugcugcucauucuuuguacaucucaaauccugcugaugagaaccacaugggcgcucugcgagagcaucacccuggcuaccgggccucuuacaacgcugugggagggauccccgggcaaguuuuggaauaccacaauugccgugucuauggcuaacaucuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggauguggcagagggggauggagcuauuacugcgccggccucaagaaaguuaccgaagugaagggcuauacaaaagggggaccuggccaugaggaacccauuccuauggcuaccuacggguggaaccuggugaagcugcacuccggaaaagacgucuuuuucauucccccugagaagugugauacacuccuuugcgacauuggcgagucuagcccgaaucccacgaucgaagaggggcgcacccugcgggugcugaaaaugguugaaccuuggcucagaggaaaccaauuuuguaucaagauucugaaucccuacaugccuuccguggucgagacacuugagcagaugcagcgcaagcauggcggcaugcuggugcggaacccccucagcagaaauucuacccacgaaauguauuggguuuccugcgggacaggaaacaucgugagcgccgucaauaugaccucucgcaugcugcugaaccgguucacgauggcgcacagaaaaccgaccuacgagaaggauguggaccucggcgccgggacacgccauguggcugucgaaccugagguugccaaccuggauauuaucggacagagaauugaaaauaucaaacacgagcauaaguccaccuggcacuaugacgaggauaaccccuacaaaacaugggcuuaucauggcagcuacgaagugaagcccucuggguccgccagcuccauggugaauggagucgugaaacuucugaccaaaccuugggacguuauccccauggugacacaaauugcuaugaccgauacgacaccuuuuggccagcagcgggucuucaaggagaaaguggacacccgcaccccgaaggccaaaagaggcacagcgcaaaucauggaaguuacggccaaguggcucuggggguuucugagccggaacaagaaacccagaauuuguacccgggaggaguucacacgcaaggugagaucuaaugcugccaucggagcugucuuuguggacgagaaccaguggaauagcgccaaagaggccguugaagaugagcgguucugggaccuugugcaccgcgaaagagagcugcacaagcagggcaaaugcgcgaccugcgucuauaacaugauggggaagcgggaaaagaaacucggagaguuuggcaaggcuaaagggucccgcgccauuugguacauguggcugggcgccagauuccuggaguucgaagcucucggauuuaugaaugaggaucauugguucucucgggaaaacagccuguccggcguggagggggagggacuucacaagcugggcuacauccuccgcgacaucucuaaaauuccugggggaaauauguaugccgaugacacagcuggcugggauaccagaaucacagaagacgaucugcagaacgaggcccggauuaccgacaucauggaacccgagcaugcgcuucuggccaagagcauuuuuaaacucacguaccaaaauaaggucgugcgcguucagagaccugcuaagaacgggaccgugauggaugucaucucccggcgcgaccagagaggcucuggacaggugggcacauaugggcugaauaccuucacaaacauggaagcccaacugauccggcagauggagagcgagggaaucuuuucccccagcgaacucgagaccccgaaccuggcugaaagagugcuugauuggcugaaaaaguacggcguugagcgccucaaacggauggccaucucuggggacgacuguguggucaagccuauugaugacagauucgcgacggcccugacagcucuuaaugauaugggaaaagugcgcaaggacaucccccagugggaaccuuccaagggcuggaacgauuggcagcaaguucccuuuugcagccaccacuuccaucagcugauuaugaaagacgggcgggagaucguggucccuuguagaaaucaggaugagcucgugggccgcgcccgggucucucagggagcuggcuggucccugagagaaaccgccugccugggaaagagcuaugcucaaauguggcagcucauguacuuucaccgccgggaccugagacuugccgcgaacgccauuuguuccgcugugcccguugauuggaucccgacaucucgcaccacguggagcauccaugcccaccaucaguggaugaccacagaggacaugcuguccguguggaaucgggucuggauugaagagaacccuuggauggaagauaaaacccacaucagcucuuggggagacgugcccuaucucggcaagagagaggaccaauggugcgggucccugauuggacuuacagcccgggcuaccugggccacaaauauccagguugcgauuaaccaggugagacgccugaucggcaaugagaacuaccucgauuacaugaccagcaugaaacgguucaagaaugaaggggaccccgagggcgcucugugguga

SEQ ID NO: 19292 - RNA, 9879 nt, Artificial Sequence
  derived and/or modified CDS sequence (opt5) from DENV-1__EU482480__SS-prME
agcgugaccaugcugcugaugcugaugcccacagcucuugcuuuccaccugacgaccagaggaggggaaccucauaugaucguguccaagcaggaacggggaaaaucucuccuguuuaagacaagcgccggcguuaacaugugcacccuuaucgcgauggaccugggggaguucugugaagauacaaugaccuacaaaugcccgcgcaucacagaggcugaacccgacgauguggacuguuggugcaaugccaccgauacgugggugaccuauggaacauguacccaaauuggcgagcacagacgggacaagcgcuccgucgcccucgcuccucauguggggcugggacuggagacaagaaccgaaacguggaugucuagcgagggcgccuggaaacagauccagcggguugaaacaugggcucuccgccaccccggcuuuaccgugauugcccuguuccuugcgcaugccaucgggacauccaucacccagaagggaauuaucuuuauucugcucaugcuggcuaccccuucuauggccaugagaugcgucggcaucgggagccgggauuucguggagggacuuuccggcgcuacauggguugacgugguccuggagcacgggagcugugugacgaccauggccaaggauaaacccacacucgacauugaacugcugaagaccgaggugacaaacccugcgguccuccgcaaacugugcaucgaagccaagauuucuaauaccacgacagauuccagauguccgacccaaggagaggcuacccuuguugaagaacaagacgccaacuuugugugccggcgcacauucguggauagaggcuggggcaauggguguggacuguuuggcaaagggagccucauuaccugcgcuaaguucaagugcgucacaaaacuggagggaaagaucgugcaguacgaaaaccuuaaauauucuguuauugugacgguccacaccggcgaccagcaucaaguggggaaugaguccacagaacacggaaccaucgccacaauuacaccccaggccccuagcacggagauccagcugaccgacuacggcgcucucacacuggauuguucuccccggaccggccuggacuuuaacgaaaugguucuccugacaaugaaggagaaauccuggcuugugcauaagcagugguuccuggaucucccucugcccuggaccagcggggcguccacgucucaagagacauggaaucgccaggaccuucuggucaccuuuaaaacagcccacgcuaagaagcaggaaguggucgugcucggaagccaagagggcgccaugcacaccgcccugaccggggcuacagaaauucagacguccggaaccacaaccaucuucgccggccaucugaaaugcagacucaagauggauaaacugacacuuaaggggaugagcuauguuauguguaccggcucuuucaaacuggagaaggaaguggcggagacgcagcacggaacaguccucgugcagaucaaguacgagggcaccgacgcuccgugcaaaauuccuuuuuccacccaagaugaaaaggggguuacacagaacggacggcugaucaccgccaaucccauugugacagacaaagagaagccugucaacaucgaagccgagccgcccuucggcgagagcuauauugugaucggggcuggagaaaaagcccugaaacuuucuugguuuaagaaaggcagcuccaucgggaagauguucgaggcuacggccagaggcgcgcgccggauggccauucucggagauaccgcuugggacuuuggcucuaucgggggaguguucacaagcguuggcaaacugguccaucagauuuuugggaccgccuacggagugcuguucuccggcgugagcuggacaaugaagaucgggauuggcguccuccugaccuggcuuggacucaauucuagauccacgagccucucuaugaccuguaucgcugugggccugguuacacuguaccuuggggugaugguccaggccgauuccggaugcgugauuaacuggaaaggccgcgaacucaagugugggagcggaaucuuuguuaccaaugaggugcacacauggaccgaacaauauaaguuccaggcggacuccccuaaacggcugucugccgcuaucggcaaggccugggaggagggggucugcggcauuagaagcgcuacacgccuggaaaacaucauguggaaacagauuuccaacgagcucaaucauauccugcuugaaaacgacaugaagcugaccgugguugugggagaugucgccggcauucucgcccaggggaaaaagaugauccggccgcaacccauggaguacaaauauucuuggaagaucuggggaaaggcuaaaauuaucggcgcggacgugcagaauacgacauuuauuaucgaugggccuaacacccccgaauguccugacgaucagagagccuggaauauuugggagguggaggacuacggauucggcaucuuuaccacaaacaucuggcugaagcugcgcgauagcuauacccaggucugcgaccaccggcuuauguccgcugccauuaaagauagcaaggccguucacgcugacaugggcuacuggaucgaaucugagaaaaaugaaacguggaagcucgccagagcguccuucauugaggugaagacauguaucuggcccaaaagccauacccuguggucuaacggggugcuggaauccgagaugauuaucccgaagaucuauggaggcccuauuagccaacacaauuaccgccccggguacuucacacagaccgcuggaccuuggcaucucggcaaacuggagcuugauuuugaccugugcgaagggacaaccgucgugguugaugagcacugcggaaaccggggccccucucucagaacgaccacagugaccggcaagaucauucacgaaugguguugccggagcuguacacugccuccccugcgcuucaaaggggaggacggaugcugguauggcauggagaucagaccggucaaggaaaaggaggaaaaucuugugaaauccaugguuagcgccgggucuggagagguggacuccuuuagccucggccugcuguguauuuccaucaugauugaagaggucaugcggucuagauggagccgcaagaugcucaugaccgggacgcuggccguguucuuucuucugaucaugggacagcucacauggaacgaucugauccggcugugcauuaugguuggcgcuaaugccuccgacagaaugggcauggggaccacauaccuugcgcugauggcuaccuucaaaaugcgcccuauguuugccgugggacuccuguucagacggcucaccucucgcgagguccugcuucugacaaucggccucagccugguggccuccguggaacugcccaacucucuugaggaacugggggauggacucgcuaugggcauuaugauccugaagcuccugacggacuuucaaagccaucagcuuugggccacccugcucucccugacauucauuagaaccacauuuagccugcacuaugcuuggaaaaccauggccaugguccuuucuaucguuucccuguucccccucugucugagcacgacaucucagaagaccaccuggcucccugugcugcuugggucccugggaugcaagccgcugacaauguuucucaucgcggagaauaaaauuuggggccggaaguccuggccccugaacgaaggcaucauggccguggggauugucucuauccuucuguccagccuccugaaaaacgaugugccucucgcuggaccccugauugccggcgggaugcuuaucgcuuguuacguuaucuccggaagcucugccgaccugagccuggagaaggccgcugagguguccugggaagaggaagcggagcauucuggcgccagccacaauauucucgucgaagugcaggaugacgggaccaugaaaaucaaggaugaggagcgcgacgauacacugacgauucuucugaaagcuacccuccuggccguuuccggaguguauccucucucuauccccgccacacuguucgucugguacuucuggcaaaagaagaaacagagaagcggcgugcuuugggacaccccuagcccucccgaagucgagcgggcugugcuggaugacggcauuuaucgcaucaugcagagagggcugcucggacggucucagguuggcgugggggucuuucaagaaaacguguuccauacaauguggcacguuacccgcggagccgugcugauguaccagggcaagagacuugagcccagcugggcguccgucaaaaaggaccugauuagcuacgggggaggcuggcggcuccagggcucuuggaauacgggggaggaaguccaggugaucgcuguugagcccggcaagaacccuaagaauguccaaaccgcccccggcacauuuaagaccuccgaaggggaggugggagccaucgcucuggauuucaaaccgggcacaagcgggucuccuauugugaacagagaaggaaagaucgucggccucuauggcaauggggugguuaccacauccggaacguacgugagcgccauugcgcaggcuaaagccucccaggagggcccccugccugagaucgaagacgaggucuuucgcaagcggaaccuuaccauuauggaucugcaccccgggucuggaaaaacaagacgcuaucugcccgccaucgugcgggaagcuaucaagagacgccuccggacccugauucuugccccuaccagaguuguggcuagcgagauggccgaagcgcugaagggcaugccgauccgcuaccaaacaacggccgucaaauccgagcauaccgggaaggagauuguggaccucaugugccacgcuacauucaccaugcggcugcugagccccguuagagugccuaauuauaacaugaucauuauggaugaagcccauuuuacagaccccucuuccaucgcugcccggggcuacaucagcacccgcgucggaaugggcgaggccgcugcgauuuucaugacggccacaccucccgggucuguggaggcuuuuccucagagcaaugccgugauccaggaugaagaaagagacauuccggagcgguccuggaacucuggauaugaguggaucaccgauuuccccggcaaaaccgucugguuuguuccuagcauuaaguccgggaaugacaucgccaacugucuccgcaaaaauggaaagagagugauucagcuuucucggaagacauucgauaccgaauaccagaagaccaagaacaacgacugggacuacguggucaccacggauaucagcgagaugggcgcuaauuucagagccgaccgcgugaucgauccccggagaugccugaaaccuguuauucugaaggacgggcccgaacgcgugauccucgcgggcccgaugccugucacaguggcuuccgccgcccagcggagaggacgcauuggccggaaccacaauaaagagggggaucaguauaucuacaugggacagccccugaacaaugacgaggaucaugcucacuggaccgaagccaagaugcuucuggacaacauuaauacacccgagggcaucaucccugcgcucuuugaacccgagagagaaaagagcgccgcuauugauggggaguaucgccugagaggagaggcccggaaaaccuucguugaacugaugcgcagaggcgaccucccuguguggcuuucuuacaaggucgcuuccgagggguuucaauauagcgaucggcgcuggugcuucgacggcgaaagaaacaaucaggugcuggaggaaaacauggaugucgagaucuggacgaaagagggagaacggaagaaacugagaccgcgcuggcucgacgcccggaccuacuccgacccccuggcucuuagagaguuuaaggaguucgccgcgggccgccggucugugagcggggaucugauucucgagaucggaaaacugccucagcaccugacacagagagcccaaaaugcucucgacaaccuuguuaugcugcauaauuccgaacagggcgggcgggccuaucgccacgcuauggaggagcugcccgauaccauugaaacacucaugcugcuugcccugaucgccgugcucaccggaggcgugacacuguuuuuccugucuggcagagggcucggaaagaccagcaucggccuucugugugucauggcuuccagcguucugcucuggauggcgucuguggagccucauuggauugccgcuuccaucauucuggaauuuuuccuuauggugcugcucauccccgagccggaccggcagcgcacgccucaggauaaccaacuggccuacgucgugauugggcugcucuuuaugauccuuacaguugccgcuaaugagaugggacugcuggaaaccaccaagaaagaccucggcauugggcacguggccgucgagaaccaccaucacgcggccaugcuggauguggaccuucaucccgcuagcgccuggacacuguacgcugucgccaccacaaucaucacgccuaugaugagacacaccauugaaaacacaaccgcgaauaucucucucacagccauugcuaaccaggccgcuauccugaugggacuggauaagggcuggcccauuuccaaaauggacaucggcgugccucuccuugcccuggggugcuauagccagguuaauccccugacccucacggcugccgugcugaugcuugucgcgcauuacgccaucauuggaccgggccugcaagcuaaggccacccgggaggcucagaaacgcacagccgccgggaucaugaagaacccuaccguggauggaauuguugcgaucgaccucgaucccguggucuaugacgcuaaguucgaaaaacagcugggccagauuaugcugcucauccuuuguacaucucaaauccugcugaugagaaccacgugggcccucugcgagagcauuacacuggcuaccgggccccuuacaacccugugggagggauccccuggcaaguuuuggaauaccacaaucgccgugucuauggccaacauuuuccggggcagcuaccucgcuggggccggacuggcguucucccugaugaaaagccucggcgggggacgcagaggcacgggggcccagggagaaacccuuggcgagaaguggaaacggcagcugaaucagcuguccaagucugaauuuaacacauauaagagaagcggcaucauggagguggaccgcuccgaagcuaaagaggggcucaagcggggagagaccacaaaacacgccguuucuagaggcaccgcuaagcugcgcugguucgucgaacggaaucuugugaaaccggaggggaaggugauugaucugggauguggcagagggggauggagcuacuauugcgccggccucaagaaagucacggaaguuaagggcuacacaaaagggggacccggccacgaggaaccuauccccauggcgaccuacggguggaaccuggugaagcugcauuccggaaaagacguguuuuucauuccucccgagaagugugauacccuccuuugcgacaucggcgagucuagcccuaauccgacaaucgaagaggggcgcacccugcggguccugaaaaugguggaacccuggcucagaggaaaccaauuuuguauuaagauccugaauccuuauaugcccuccguuguggagacacuugagcagaugcagcgcaagcacggcggcaugcugguccggaacccucucagcagaaauucuacgcaugaaauguacuggguguccugcgggaccggaaacauuguuagcgccgugaauaugacaucucgcaugcugcugaaccgguucaccauggcucacagaaaacccacauaugagcgcgaugucgaccucggcgccgggaccagacacguggcuguggaaccggaggucgccaaccuggauaucauuggacagcggaucgaaaauaucaagcaugagcacaaauccacguggcauuacgacgaggauaacccuuauaagaccugggcuuaccacggcagcuaugaaguuaaacccucuggguccgccagcuccauggugaauggaguggucaaacuucugacaaagcccugggacgugauuccuaugguuacccaaaucgcgaugacagauaccacacccuuuggccagcagcgcguguucaaagagaaggucgacaccagaacgccuaaagccaagcggggcacagcucaaauuauggaagugaccgccaaauggcucuggggguuucugagcagaaacaagaagccgcggaucuguacccgcgaggaguucacaagaaaaguucggucuaaugcugccauuggagccguguuugucgacgagaaccaguggaauagcgcgaaggaggcuguggaagaugagcgcuucugggaccuuguucauagagaacgggagcugcacaaacagggcaagugcgccacgugcguguacaacaugauggggaaacgcgaaaagaagcucggagaguuuggcaaagccaagggguccagagcuaucugguacauguggcugggcgcccgguuccuggaguucgaagcucucggauuuaugaaugaggaucacugguucucucgcgaaaacagccuguccggcgucgagggggagggacuucauaaacugggcuauauccucagagacauuucuaagauccccgggggaaauauguacgccgaugacaccgcgggcugggauacacggauuaccgaagacgaucugcagaacgaggccaaaaucacagacauuauggaaccugagcacgcccuucuggccaagagcaucuuuaaacucaccuaucaaaauaaggugguccgcgugcagagacccgcuaagaacgggacaguuauggaugugaucucccggcgcgaccagagaggcucuggacaggucggcaccuacgggcugaauacguucaccaacauggaagcccaacugauucggcagauggagagcgagggaaucuuuuccccuagcgaacucgagacacccaaccuggcgggcagagugcuugauuggcuggaaaaacaugggguggagcgccucaagcggauggccauuucuggagacgacuguguugugaaaccgaucgaugacagauucgcuaccgcccugacagcucuuaaugauaugggcaagguccgcaaagacauuccucagugggaacccuccaagggguggaacgauuggcagcaagugccuuuuugcagccaccacuuccaucagcugaucaugaaggacggccgggagauuguugugcccuguagaaaucaggaugagcucgucggacgcgcccgggugucucagggcgcuggguggucccugagagaaaccgccugccugggaaaaagcuaugcgcaaauguggcagcucauguacuuucaccgccgggaccugagacuugccgcuaacgccaucuguuccgccgucccuguggauuggguucccacgucucgcacaaccuggagcauccaugcucaccaucaguggaugacaaccgaggacaugcuguccguguggaaucgggucuggauugaagagaacccguggauggaagauaagacgcacgugagcucuuggggcgacguuccuuaucucgggaaaagagaggaccaauggugcggaucccugaucggccuuaccgcccgggcgacaugggcuaccaauauucagguggccaucaaccaggucagacgccugcucgggaaugagaacuaccuggauuacaugacaagcaugaagcgguucaaaaaugaaucugaccccgagggcgcccugugguga

SEQ ID NO: 19293 - RNA, 9879 nt, Artificial Sequence
  derived and/or modified CDS sequence (opt5) from DENV-1__EU482481__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaauaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaaucaccgccccggguauuucacacagaccgccggaccuuggcaccucggcaaacuggagcuugauuuugaccugugcgaagggacgaccguuguggucgaugagcauugcggaaaccggggccccagccucagaacaaccacagugaccggcaagauuauccacgaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaccuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaucagcugugggccacccuccugagccugacauuuauuaaaaccacgcuuucucugcacuaugcuuggaagacaauggccauggugcucuccaucgugagccuguucccccucugucugucuaccaccucccagaagacaaccuggcuuccuguccugcuggggagccucggaugcaaaccgcugacaauguuucuuauuacggagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuacgugaucagcggaucuagcgcugaccucucccuggagaaagccgcugagguuucuugggaagaggaagccgagcauagcggcgccucccacaauauucuuguggaaguccaggaugacgggaccaugaagaucaaagaugaggagcgggacgauacacugaccauucuccugaaggcuacacuccuggcggugucuggagucuauccucuuagcauccccgccacccuguucgugugguacuuuuggcaaaagaaaaagcagcgcuccggcguucugugggacacgccuucucccccggaaguggagagagcuguccucgaugacggcaucuaucggauuaugcagcgcgggcugcuuggaagaagccaggugggcguugggguguuccaagaaaacgucuuccacaccauguggcaugugacacggggagccgugcugauguaccagggcaaacgccucgagccuuccugggccagcguuaagaaagaccugaucucuuaugggggaggcuggagacuccagggcuccuggaauaccggggaggaaguccaggugauugcuguggagcccggaaagaacccuaagaauguccaaacagcccccggcaccuuuaaaacaccggaaggggaggugggagcgaucgcucuggauuucaagccuggcacgagcgggucucccauuguuaaccgggaaggaaaaaucgugggccuuuacggcaauggggucgugaccacauccggaaccuacguuagcgccauugcccaggcuaaggccucccaggagggcccucugcccgagaucgaagacgagguguuuagaaaacgcaaccugaccaucauggaucuccaccccgggucuggaaagacacggagauaucugccugcgauuguccgcgaagcuaucaagcggaaacuuagaacgcugauucucgccccgacccgcgugguugccagcgagauggcugaagcccugaagggcaugcccauccgguaccaaacaaccgcugugaaauccgagcauacagggaaggagauugucgaccugaugugccacgccaccuucacgaugagacuccuuagcccugugcgcgugcccaauuauaacaugaucaucauggaugaagcgcauuuuacagacccuucuuccauugccgcucggggcuacaucagcaccagagucggaaugggcgaggccgcugccauuuucaugaccgccacacccccugggucuguugaggcuuuuccgcagagcaaugcggugauccaggaugaggaacgggacauucccgagcgcuccuggaacucuggauaugaguggaucaccgauuucccuggcaaaacagugugguuuguccccagcaucaaguccgggaaugacauugccaacugucugagaaagaauggaaaacgggugauccagcugucucgcaagaccuucgauacggaauaccagaagaccaagaacaacgacugggacuauguugugaccacagauauuagcgagaugggcgcuaauuuuagagccgaccgggucaucgauccuagacgcugccucaaacccgugauucugaaggacgggccggaacggguuauccuugccggcccuaugcccgugaccgucgcuuccgccgcgcagagacgcggacggauuggcagaaaccacaauaaggagggggaucaguacaucuacaugggacagccccugaacaaugacgaggaucacgcucauuggacggaagccaaaaugcuccuggacaacaucaauaccccugagggcauuauccccgcccuguucgaaccugagcgcgaaaagagcgcugccauugauggggaguaucggcucagaggagaggcgcgcaaaacauucguggaacuuaugagacggggcgaccugccggucuggcugucuuacaagguggccuccgagggguuucaauauagcgaucgcagauggugcuucgacggcgaacggaacaaucagguucucgaggaaaacauggauguggagaucuggaccaaagagggagaacgcaagaaacugagaccccgguggcuugacgcuagaacauacuccgacccucuggcccuccgcgaguuuaaggaguucgcugccggccggagaucugugagcggggaucugauuuccgagaucggaaagcugccccagcaccucacccagcgcgcucaaaaugcccuugacaaccuggucaugcugcauaauucugaacagggcgggcgggcguauagacacgccauggaggagcucccugauacaaucgaaacccugaugcuucuggcucucauugccguucugacgggaggcgugacacuguuuuuccucagcggccgggggcuuggaaaaaccuccaucggccugcugugugugauggcuagcucuguccuccuguggauggccuccguggagccccacuggauugccgcuagcaucauucuugaauuuuuccugaugguucuccugaucccggagccugaccgccagagaacaccccaggauaaccaacuggcguacguggucaucgggcuccuuuuuaugauucugacaguggccgcuaaugagaugggacugcucgaaaccacaaagaaagaccugggcaucgggcaugucgccguggagaaccaccaucacgccacgaugcuugauguugaccugcauccugcuucugccuggacccucuaugcgguggccacaaccauuaucacacccaugaugcggcacaccauugaaaacacgaccgcuaauaucucccugacagccauugcuaaccaggccgcgauccugaugggacucgauaagggcuggccuaucagcaaaauggacauuggcgucccccuucuggcccuggggugcuacucucaggugaauccgcucacccugacagcugccguucuuaugcugguggcucacuacgccaucauuggaccuggccuccaagcuaaggccacccgcgaggcgcagaagagaacggccgcugggaucaugaaaaaccccacagucgauggaauuaucgccaucgaccuggaucccgugguguaugacgcuaaguucgaaaaacagcugggccagauuaugcuccuuauccuguguaccagccaaauucugcucaugcggacaaccugggcccugugcgaguccaucacccuugccacagggccucugacgacccucugggagggaucuccgggcaaguuuuggaauacaaccauugcgguuagcauggcuaacaucuuccgcggcuccuaccuggccggggcuggacuggccuuuagccucaugaaaucccuuggcgggggaagacggggcacaggggcccagggagaaacccugggcgagaaguggaagcgccagcugaaucagcucucuaaaagcgaguucaacaucuauaagagauccggcauuauggaggucgaccggucugaagcuaaagaggggcugaagagaggagagacgacacgccaugccgugagccggggcaccgcgaaacuuagaugguucguggaacgcaaucuggucaagcccgaggggaagguuaucgaucucggauguggcagagggggaugguccuacuauugcgccggccugaaaaaggugaccgaagugaaaggcuacacaaaagggggaccuggccacgaggaacccauuccuauggcuaccuauggguggaaccuggucaaacuccauucuggaaaggacguguuuuucacacccccugagaaaugugauacgcuucugugcgacaucggcgagagcuccccgaaucccaccauugaagaggggagaacacugcgcguucucaagaugguggaaccuuggcugcggggaaaccaauuuuguaucaagauucuuaaucccuacaugccuagcgucguggagacccuggagcagaugcagagaaaacacggcggcaugcucguucgcaacccccugucuagaaauuccacacacgaaauguacugggugagcugcgggaccggaaacaucgucucugccgugaauaugacguccagaaugcugcucaaccgcuucaccauggcucaucggaagccgacauaugagagagauguggaccugggcgccgggacccgccacgucgcgguugaaccugagguggccaaccuugauaucauuggacagagaaucgaaaauauuaaacaugagcacaagagcacauggcauuacgacgaggauaaccccuauaaaaccugggcuuaccacggcucuuaugaagugaagcccuccgggagcgccuccagcauggucaauggagugguuaagcugcucacaaaaccuugggacgugauccccauggucacccaaauugcuaugacggauacaaccccuuuuggccagcagcggguguucaaggagaaaguugacacccgcacaccgaaggccaaaagaggcacggcucaaaucauggaagugaccgcccgguggcuguggggguuucuuucuagaaacaagaagccccggaucuguacacgcgaggaguucaccagaaaaguccggagcaaugcggccauuggagcuguguuuguugacgagaaccaguggaacuccgccaaggaggcuguggaagaugagcgcuucugggaccugguccagaaagaaagagagcuccacaagcagggcaaaugcgccacaugcguguacaacaugauggggaagcgggaaaagaaacugggagaguuuggcaaggccaaagggucucgcgcgaucugguauauguggcugggcgcuagauuccucgaguuugaagcccugggauucaugaaugaggaucauugguucagccgggaaaacucccuuucuggcgucgagggggagggacugcacaagcucggcuacauucugcgcgacaucagcaaaauuccugggggaaauauguacgccgaugacaccgcuggcugggauacaagaaucaccgaagacgaucuucaaaacgaggccaagaucacggacauuauggaacccgagcaugcucugcucgccaccuccaucuuuaaacugacauaucagaauaaggugguucgggugcagcgcccugcgaagaacgggaccgucauggaugugauuucuagacgggaccagcgcggcagcggacaagugggcacauacgggcugaauaccuucacgaacauggaagcccagcucaucagacagauggaguccgagggaauuuuucugcccagcgaacuugagacaccgaaccuggcugaacggguucucgauuggcuggagaaauauggcguggaaagacuuaagcgcauggccaucucuggggacgacugugucgugaaaccuaucgaugaccgguucgcuaccgcccugacagcgcucaaugauaugggaaagguuagaaaagacauuccccagugggagccuuccaagggcuggaacgauuggcaacaggugcccuuuugcagccaccacuuccaucagcugaucaugaaggacgggcgcgagauugucgugccuugucggaaucaggaugaacuggucggcagagcccgcgugucucaaggagcuggcuggucccuccgggagaccgccugccuggggaaaagcuacgcucagauguggcagcuuauguauuuucacagacgcgaccugcggcucgccgcuaacgccaucuguuccgcgguucccguggauugggucccgacgucuagaaccacauggagcauucaugcccaccaucaauggaugaccacagaagacaugcuguccguguggaaucgcguuuggaucgaggaaaacccuuggauggaggauaagacccacgugagcucuuggggagacguccccuaccuuggcaaacgggaggaccaguggugcgggucccugauuggacucacagcuagagccaccugggccagcaauauccagguggcuaucaaccaggugcggagacugauuggcaaugaaaacuaucuggauuacaugacgucuaugaagcgcuucaaaaaugagggggaccccgaaggcgcccucugguga

SEQ ID NO: 19294 - RNA, 9879 nt, Artificial Sequence
  derived and/or modified CDS sequence (opt5) from DENV-1__EU482482__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaauaaaauuuggggccggcgcucuuggccccuuaacgaaggcaucauggccguggggaucgucuccauucugcucagcucccugcucaagaacgaugugccucuggcgggaccccuuaucgccggcgggaugcugauugcuuguuacguuaucagcggaucuagcgccgaccugucccucgagaaagcugccgaggugucuugggaagaggaagccgagcauagcggcgcuucccacaauauucuggucgaagugcaggaugacgggaccaugaagaucaaagaugaggagagagacgauacacuuaccauccugcucaaggcgacacugcucgccguuucuggaguguauccucugagcauucccgcuacccuuuucgucugguacuucuggcagaagaagaagcagcgguccggcgugcugugggacacgccuucucccccggaagucgagcgcgccgugcuggaugacggcaucuauagaauuaugcagcgggggcuccugggacgcagccagguuggcgugggggucuuucaagaaaacguguuccauaccauguggcacguuacaagaggagccgugcuuauguaccagggcaaacggcuggagccuuccugggcuagcgucaagaaagaccucaucucuuacgggggaggcuggagacugcagggcuccuggaauaccggggaggaaguccaggugauugccguugagcccggaaagaacccuaaaaauguccaaacagcgcccggcaccuuuaagacaccggaaggggaggugggagcuaucgcccucgauuucaagccuggcacgagcgggucucccauugugaaccgcgaaggaaaaaucgucggccuguauggcaauggggugguuaccacauccggaaccuacgugagcgccaucgcucaggccaaggcgucccaggagggcccucuucccgagauugaagacgaggucuuucggaaaagaaaccugaccaucauggaucugcaccccgggucuggaaagacacgccgguaucucccugcuauugugagagaagccaucaaacgcaagcugcggacgcuuauucuggccccgaccagaguuguggcuagcgagauggccgaagcucucaagggcaugcccauccgcuaccaaacaaccgccgucaaauccgagcauacagggaaggagaucguggaccugaugugccacgcgaccuucacgaugcggcugcucagcccuguuagagugcccaauuauaacaugauuaucauggaugaagcccauuuuacagacccuucuuccauugcugcccggggcuacaucagcacccgcgucggaaugggcgaggcugccgccauuuucaugaccgcuacacccccugggucuguggaagcguuuccgcagagcaaugccgugauccaggaugaggaaagagacauccccgagcgguccuggaacucuggauaugaguggauuaccgauuucccuggcaaaacagucugguuuguucccagcaucaaguccgggaaugacauugcuaacugucuucgcaaaaauggaaagagagugauccagcugucucggaagaccuucgauacggaauaccagaagaccaagaacaacgacugggacuacguggucaccacagauauuagcgagaugggcgccaauuucagagccgaccgcgugaucgauccucggagaugccugaaacccguuauucucaaggacgggccggaacgcgugauccuggcuggcccuaugcccgucaccguggccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaagagcgccgcgauugauggggaguaucgccugagaggagaggcccggaaaacauucguugaacucaugcgcagaggcgaccuuccgguguggcugucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacucagaccccgcuggcuggacgcccggacauacuccgacccucuugcucugagagaguuuaaggaguucgccgcuggccgccggucugugagcggggaucucauccuggagauuggaaaacugccccagcaccucacccagagagcccaaaaugcgcuugacaaccugguuaugcugcauaauuccgaacagggcgggcgggccuaucgccacgcuauggaggagcucccugauacaaucgaaacccugaugcuucuggcccucauugcugugcugacgggaggcgugacacuguuuuuccucucuggcagagggcuuggaaagaccagcaucggccugcugugugucauggccuccagcguucuccuguggauggccucuguggagccccauuggauugcugcguccaucauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcgagcgccuggacgcucuacgcugucgccaccacaauuaucacccccaugaugagacacacaauugaaaacaccacggcuaauaucucucugaccgccaucgcgaaccaggccgcuauucugaugggacucgauaagggcuggccuaucuccaaaauggacauuggcgugccccuucuggcccuggggugcuauagccagguuaauccgcucacacugaccgcugccgugcuuaugcuggucgcucauuacgccaucauuggaccuggccuccaagcgaaggccacacgggaggcucagaaacgcaccgccgcugggaucaugaagaaccccacgguggauggaaucguugccauugaccuggaucccguggucuaugacgccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaauaccacaaucgccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaacacgccguuucuagaggcaccgcuaaacuucgcugguucgucgaacggaaucuggugaaacccgaggggaaggugaucgaucucggauguggcagagggggauggagcuacuauugcgccggccugaagaaagucaccgaaguuaagggcuacacaaaagggggaccuggccacgaggaacccauuccuauggcuaccuacggguggaaccuggugaagcuccauuccggaaaagacguguuuuucauucccccugagaagugugauacacuucugugcgacaucggcgagucuagcccgaaucccacgaucgaagaggggcgcacccugcggguccucaaaaugguggaaccuuggcugagaggaaaccaauuuuguauuaagauccuuaaucccuauaugccuuccguuguggagacacuggagcagaugcagcgcaagcacggcggcaugcucguccggaacccccugagcagaaauucuacccaugaaauguacuggguguccugcgggacaggaaacaucguuagcgccgugaauaugaccucucgcaugcugcucaaccgguucacgauggcgcacagaaaaccgaccuaugagcgcgaugucgaccugggcgccgggacaagacacguggcuguggaaccugaggucgccaaccuugauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcugcucaccaagccuugggacgugauucccaugguuacacaaaucgcuaugaccgauacgacaccuuuuggccagcagcgcguguucaaagagaaggucgacaccagaaccccgaaagccaagcggggcacagcgcaaaucauggaagugacggccaaauggcuguggggguuucuuagcagaaacaagaagccccggauuuguacccgcgaggaguucacaagaaaaguucggucuaaugcugccaucggagcuguguuugucgacgagaaccaguggaauagcgccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcgucgagggggagggacugcauaaacucggcuauauccugagagacauuucuaagaucccugggggaaauauguacgccgaugacacagcuggcugggauacccggaucacagaagacgaucuucagaacgaggcccgcauuaccgacaucauggaacccgagcacgcgcugcucgccaaaagcauuuuuaagcugacguaucaaaauaaaguggucagagugcagcggccugcuaagaacgggaccguuauggaugugaucucccgcagagaccagcggggcucuggacaggucggcacauacgggcugaauaccuucacaaacauggaagcccaacucauuagacagauggagagcgagggaaucuuuucccccagcgaacuggagaccccgaaccuugcuaagcgcgugcuggauuggcucgaaaaauauggcguggagcggcugaagagaauggccaucucuggggacgacuguguugugaaaccuauugaugaccgcuucgcgacggcccuuacagcucugaaugauaugggaaagguccggaaagacaucccccagugggaaccuuccaagggcuggaacgauuggcagcaagugcccuuuugcagccaucacuuccaccagcucauuaugaaggacgggagagagaucguugugccuugucgcaaucaggaugagcuggucggccgggccagagugucucagggagcuggcuggucccugcgcgaaaccgccugccucgggaaaagcuacgcucaaauguggcagcugauguauuuucaucggagagaccuucgccuggccgcgaacgccauuuguuccgcuguccccguggauuggaucccgacaucucggaccacguggagcauucacgcccaucaccaguggaugaccacagaggacaugcucuccguuuggaauagaguguggaucgaagagaacccuuggauggaagauaagacccauaucagcucuuggggagacguccccuaccugggcaaacgggaggaccaauggugcgggucccuuauuggacugacagccagagcuaccugggccacaaauauccagguggcgauuaaccagguucgccggcucaucggcaaugagaacuaccuggauuauaugaccagcaugaagagauucaaaaaugaaucugaccccgagggggcucugugguga

SEQ ID NO: 19295 - RNA, 9879 nt, Artificial Sequence
  derived and/or modified CDS sequence (opt5) from DENV-1__EU482485__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugugggagaggaggcuggagcuacuauugcgccggccucaagaaaguuaccgaggugaagggguacacaaaaggaggcccugggcacgaggagcccauuccuauggcuaccuacggauggaaccuggugaagcugcauuccggcaaagacgucuuuuucauucccccugaaaagugugauacacuccuuugcgacauuggggagucuagcccgaaucccacgaucgaggaaggacgcacccugcgggugcugaaaaugguugagccuuggcucagaggcaaccaauuuuguauuaagauccugaaucccuauaugccuuccguggucgaaacacuugagcagaugcagcgcaagcacggcgggaugcuggugcggaacccccucagcagaaauucuacccaugagauguacuggguuuccugcggaacaggcaacaucgugagcgccgucaauaugaccucucgcaugcugcugaaccgguucacgauggcgcacagaaaaccgaccuaugaacgcgauguggaccucggggccggaacaagacacguggcugucgagccugaaguugccaaccuggauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuuguacccgcgaagaguucacaagaaaagugcggucuaaugcugccaucggcgcugucuuuguggacgaaaaccaguggaauagcgccaaggaggccguugaggaugaacgcuucugggaccuugugcauagagagcgggaacugcacaaacaggggaagugcgcgaccugcgucuacaacaugaugggaaaacgcgagaagaagcucggcgaauuugggaaagcuaagggcuccagagccauuugguacauguggcugggagcccgguuccuggaguucgaggcucucggcuuuaugaaugaagaucacugguucucucgcgagaacagccuguccgggguggaaggagagggccuucauaaacugggguauauccucagagacauuucuaauaucccuggaggcaacauguacgccgaugacacagcugggugggauacccggaucacagaggacgaucugcagaaugaagcccgcauuaccgacaucauggagcccgaacacgcgcuucuggccaagagcauuuuuaaacucacguaucaaaacaaggucgugagaguucagcggccuaccaaaaauggcacagugauggaugucaucucccgcagagaccagcggggaucuggccagguggggaccuacggacugaacacauucaccaacauggaggcucaacugauuagacagauggaaagcgagggcaucuuuucccccagcgagcucgaaacgccgaaucuggccgagcgcgugcuugauuggcuggaaaaguaugggguugagcggcucaagagaauggcuaucucuggagacgacuguguggucaaaccuguggaugaccgcuucgccacagcgcugaccgcccuuaacgauaugggcaagguucggaaagacauuccccagugggaaccuuccaagggguggaaugauuggcagcaagugcccuuuugcagccaucacuuccaccagcugaucaugaaagacggcagagagauugucgugccuugucgcaaccaggaugagcucgucggacgggcuagagugucucagggcgccggguggucccugcgcgaaacagcuugccugggaaagagcuacgcccaaauguggcagcucauguauuuucaucggagagaccugcgccuugcugccaaugcgaucuguuccgccguucccguggauuggauuccgaccucucggacgaccuggagcauccacgcucaucaccaguggaugacaaccgaggacaugcuguccgucuggaacagaguguggauugaagagaauccuuggauggaagauaagacacauaucagcucuuggggcgacguucccuaccucgggaaacgggaggaccaauggugcggaucccugaucggccuuaccgccagagccacaugggcuaccaacauucagguggccaucaaucagguccgccggcugauugggaacgagaauuaccucgauuauaugacgagcaugaagagauucaaaaacgaaucugaccccgagggcgcgcugugguga

SEQ ID NO: 19296 - RNA, 9879 nt, Artificial Sequence
  derived and/or modified CDS sequence (opt5) from DENV-1__EU482486__SS-prME
agcgugaccaugcugcugaugcugaugcccaccgcccuugcuuuccaccugacgaccagaggcggggaaccucauaugaucgucuccaagcaggaacggggaaagucucuccuguuuaagacgagcgccggcguuaauaugugcacccuuauugcgauggaccugggggaacucugugaagauacaaugaccuacaagugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaagagcuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggccucuucaagcuggagaaggaaguggcugagacacagcacggaaccguucuggugcagauuaaauacgagggcaccgacgccccgugcaagaucccuuucuccacacaagaugaaaaaggggucacccagaacggaagacuuaucacagcgaaucccauugugacggacaaggagaaaccugugaacaucgaagcugagccgcccuuuggcgagagcuauauuguuaucggggccggagaaaaggcccucaagcugucuugguucaaaaagggcagcuccauugggaaaauguuugaggcuaccgcccggggcgcuagacgcauggccauccugggagauacagcgugggacuucggcucuaucgggggagucuuuaccagcgugggcaagcucgugcaucagauuuucgggacagccuacggaguccuguuuuccggcgugagcuggaccaugaaaaucgggauuggcguucuucugacguggcucggacucaauucucgguccaccagccugucuaugacauguaucgcugugggccuugucacccucuaccugggggugaugguucaggccgauuccggaugcgugauuaacuggaagggcagagaacugaagugugggagcggaaucuucgucacaaaugaggugcacaccuggacagaacaauauaaauuucaggcugacuccccuaagcgccucucugccgcgauuggcaaagccugggaggaggggguuugcggcauccggagcgcuaccagacuggaaaacaucauguggcgccagauuuccaacgagcuuaaucauauccugcucgaaaacgacaugaaguucacgguggucgugggagauguggucggcauucuggcccaggggaaaaagaugauccggccgcaacccauggagcacaaauacucuuggaaaagcuggggaaaggcuaagauuaucggcgccgacguucagaauacaaccuuuaucauugaugggccuaacacccccgaauguccugacgaucagagagccuggaauaucugggagguggaggacuauggauucggcauuuuuacaaccaacaucuggcugaaacuucgcgauuccuacacacaggugugcgaccaccggcucaugagcgcugcgauuaaagauucuaaggccguccaugcugacaugggcuauuggaucgaauccgagaaaaaugaaacauggaagcuggccagagccagcuucaucgaggugaagaccuguauuuggcccaaaucucacacacugugguccaacgggguucucgaaagcgagaugaucauuccgaagaucuacggaggcccuauuucucaacauaauuaucgccccggguacuucacccagacagcuggaccuuggcaccugggcaaacuugagcuggauuuugaccucugcgaagggaccacgguggucguggaugagcacugcggaaaccggggccccagccugagaaccacaaccguuacaggcaagaucauccaugaaugguguugccgguccuguacccugccuccccuucgcuucaaaggggaggacggaugcugguacggcauggagauuagaccggugaaggaaaaggaggaaaaucucgucaaaagcauggugucugccggguccggagagguugacagcuuuucccugggccugcucuguaucucuauuaugaucgaagaggugaugcggagcagauggucccgcaagaugcugaugacggggacacuugcggucuucuuucugcucauuaugggacagcugaccuggaacgaucugauccggucuugcauuauggugggcgcuaaugccagcgacagaaugggcauggggacaaccuaucuugcccugauggcuaccuucaaaaugcgcccuauguuugccgugggacuccuguucagacggcucacaucccgcgagguccugcuucugacgaucggccucucucugguugcgagcguggaacugcccaacucccuugaggaacugggggauggacucgcuaugggcaucaugauucugaagcuccugaccgacuuucaaagcuaccagcuuugggccacacugcucucucugaccuucaucaaaacaaccuuuucccugcacuaugccuggaagacgauggcuauggugcuuagcauugucucucugcucccccugugucucuccacaaccagccagaagaccacauggcugccugugcuucuggggucucugggaugcaaaccgcucaccauguuccugaucgccgagaauaagauuuggggcagaaaauccuggccccuuaacgaaggcaucauggcuguugggaucgugagcauucugcucuccagccugcucaagaacgaugucccucuggccggaccccuuaucgcgggcgggaugcugauugccuguuacgugaucucuggaagcuccgcugaccugucucucgagaaagccgcugagguuagcugggaagaggaagccgagcauuccggcgccucucacaauauucugguggaaguccaggaugacgggacaaugaagaucaaagaugaggagcgggacgauacgcuuaccauccugcucaaggcuacacugcucgcggugagcggagucuauccucuguccauucccgccacccuuuuugugugguacuucuggcaaaagaaaaagcagcgcucuggcguucugugggacacaccuagcccucccgaaguggagagagcuguccuggaugacggcaucuaucggauuaugcagcgcgggcuccugggaagaucccaggugggcguugggguguuccaagaaaacgucuuucauaccauguggcacgugacgcggggagccgugcuuauguaccagggcaaacgccuggagcccagcugggccucuguuaagaaagaccucaucuccuacgggggaggcuggagacugcagggcagcuggaauaccggggaggaaguccaggugauugcuguggagcccggaaagaacccuaagaauguccaaacagcccccggcaccuucaaaacaccggaaggggaggugggagcgaucgcucucgauuuuaagccuggcaccucugggucccccauuguuaaccgggaaggaaaaaucgugggccuguauggcaauggggucgugacaacgagcggaaccuacguuuccgccaucgcccaggcuaaggccucucaggagggcccucuucccgagauugaagacgagguguucagaaaacgcaaccugacaaucauggaucugcaccccgggagcggaaagacccggagauaucucccugcgauuguccgcgaagcuaucaagcggaaacugagaacccuuauucuggccccgacacgcgugguugccuccgagauggcugaagcccucaagggcaugcccauccgguaccaaacgaccgcugugaaaagcgagcauacagggagagagaucgucgaccugaugugccacgccaccuuuacaaugcgccugcucucuccugugcgggugcccaauuauaacaugauuaucauggaugaagcgcauuucaccgacccuuccagcauugccgcuagaggcuacaucucuacgcgggucggaaugggcgaggccgcugccauuuuuaugacagccacacccccugggagcguugaggcuuucccgcaguccaaugcggugauccaggaugaggaacgcgacauccccgagagaucuuggaacagcggauaugaguggauuaccgauuuuccuggcaagacagugugguucguccccuccaucaaaucugggaaugacauugccaacugucuucggaagaauggaaagcgcgugauccagcugagcagaaaaaccuuugauacagaauaccaaaagaccaaaaacaacgacugggacuacguugugacgacagauauuuccgagaugggcgcuaauuuccgggccgacagagucaucgauccucgccggugccugaagcccgugauucucaaagacgggccggaaagaguuauccuggccggcccuaugcccgugaccgucgcuagcgccgcgcagcgccggggaagaaucggccgcaaccacaauaaggagggggaucaguauauuuacaugggacagccccuuaacaaugacgaggaucaugcucacuggacagaagccaagaugcugcucgacaacaucaauaccccugagggcauuauccccgcccuguucgaaccugagcgggaaaaaucugcugccauugauggggaguauagacugcgcggagaggcgagaaagacguuuguggaacucaugcggcgcggcgaccuuccggucuggcuguccuacaaaguggccagcgagggguuccaauauuccgauagacgguggugcuuugacggcgaacgcaacaaucagguucuggaggaaaacauggauguggagaucuggaccaaggagggagaacgcaagaagcuccggcccagauggcuggacgcucgcacauacucugacccucuugcccugcgggaguucaaagaauuugcugccggcagacgcagcguguccggggaucucauccuggagauuggaaagcugccccagcaccucacccagcgggcucaaaaugcccuugacaaccuggucaugcugcauaauucugaacagggcgggagagcguaucggcacgccauggaggagcucccugauacaaucgaaacccugaugcuucuggcucucauugccguucugacaggaggcgugacccuguucuuucucagcggccgcgggcuuggaaagacguccaucggccugcugugugugauggcuagcucugcccuccuguggauggccuccgucgagccccauuggauugcugcgagcaucauccuugaguucuuucugauggugcuccugauuccggagccugacagacagcggacaccccaggauaaccaacuggccuacguugugaucgggcuccuuuucaugauucugaccgucgcugccaaugagaugggacugcucgaaaccaccaagaaggaccugggcaucgggcacguggccgucgagaaccaccaucacgcuaccaugcuugauguggaccugcauccugccucugcguggacacucuacgccguugcuacgaccauuaucacacccaugaugcgccacaccauugaaaacacaaccgccaauaucucccugacggcuaucgccaaccaggcggccauucugaugggacucgauaaaggcuggccuaucagcaagauggacauuggcgugccccuucuggcucuggggugcuauucucaggucaauccgcucacccugacagccgcugugcuuaugcugguugcccauuacgcuaucauuggaccuggccuccaagccaaagcgaccagagaggcccagaagcggacagcugccgggaucaugaagaaccccaccguggauggaaucgucgcuauugaccuggaucccgugguguaugacgccaaauuugaaaagcagcugggccagaucaugcuccuuauucuguguacgagccaaauccugcucaugcgcacaaccugggcccugugcgaguccauuacacuugcgaccgggccucugaccacacucugggagggaucuccgggcaaauucuggaauacgaccaucgcuguuagcauggccaacaucuuuagaggcuccuaccuggcuggggccggacuggccuucagccucaugaagucccuuggcgggggacggcgcggcacaggggcucagggagaaacccugggcgagaaauggaagagacagcugaaucagcucucuaagagcgaguucaacacauauaaacgguccggcauuauggaggucgacagaucugaagccaaggaggggcugcgccggggagagaccacgaaacacgcggugagcagaggcacagccaaacuucgcugguuuguggaacggaaucuggucaaacccgaggggaagguuaucgaucucggauguggcagagggggaugguccuacuauugcgcuggccugaagaaagugaccgaagugaagggcuacaccaaagggggaccuggccacgaggaacccauuccuauggccacauacggguggaaccuggucaagcuccauucuggaaaagacguguucuuuauucccccugagaagugugauacccuucugugcgacaucggcgagagcuccccgaaucccacaaucgaagaggggcgcacgcugcggguucucaaaaugguggaaccuuggcugagaggaaaccaauucuguauuaagauccuuaaucccuauaugccuagcgucguggagacccuggagcagaugcagcgcaagcacggcggcaugcucguucggaacccccugucuagaaauuccacacaugaaauguacugggugagcugcgggaccggaaacaucgucucugcugugaauaugacaucccgcaugcugcucaaccgguuuaccauggcccacagaaaaccgacguaugagcgcgauguggaccugggcgcggggaccagacacgucgccguugaaccugagguggcuaaccuugauauuaucggacagcggauugaaaauaucaagcaugagcacaaaagcacauggcauuacgacgaggauaaccccuauaagaccugggccuaccacggcucuuaugaagugaaacccuccgggagcgcuuccagcauggucaauggagugguuaagcugcucacaaagccuugggacgugauucccauggucacccaaaucgccaugacagauaccacgccuuucggccagcagcgcguguuuaaagagaagguugacacaagaaccccgaaagcuaagcggggcaccgcccaaaucauggaagugacagcgagauggcuguggggguuccuuucucggaacaaaaagccccgcauuuguacgagagaggaauuuacccggaagguccgcagcaaugccgcuaucggagccguguucguugacgagaaccaguggaacuccgcuaaagaggccguggaagaugagagauuuugggaccugguccaucgggaacgcgagcuccacaagcagggcaaaugcgccacaugcguguacaacaugauggggaagagagagaagaagcugggagaguucggcaaggcgaaagggucucgggcuauuugguacauguggcugggcgcccgcuuucucgaguucgaagcccugggauucaugaaugaggaucacugguuuagcagagaaaacucccuuucuggcgucgagggggagggacugcauaagcucggcuauauccugcgggacauuagcaaaaucccugggggaaauauguacgcugaugacaccgccggcugggauacacgcaucaccgaagacgaucuucagaacgaggcuaagauuacagacaucauggaacccgagcacgcccugcucgcgaccuccauuuucaaacugacguaucaaaauaaggugguuagagugcagcggccugcccgcaacgggaccgucauggaugugaucucuagacgggaccagagaggcagcggacaggugggcacauacgggcugaauaccuuuacaaacauggaagcucaacucauucgccagauggaguccgagggaaucuucagccccucugaacuggagaccccgaaccuugccgaacggguucuggauuggcucgagaaacauggcguggaaagacugaagcgcauggcuaucuccggggacgacugugucgugaagccuauugaugaccgguuugccacggcgcuuagcgcccugaaugauaugggaaaaguuagaaaggacaucccccagugggagccuucuaaaggcuggaacgauuggcagcaagugcccuucugcucccaccacuuucaucagcucauuaugaaggacgggcgcgagaucgucgugccuugucggaaucaggaugaacuggucggcagagcucgcgugagccagggagccggcuggucccugcgggagacagcuugccucgggaaaucuuaugcccaaauguggcagcugauguacuuccacagacgcgaccuucggcuggcugccaacgcgauuuguagcgccguucccguggauugggucccgaccuccagaacaaccuggagcauccaugcucaccaucaguggaugacgaccgaagacaugcucucuguguggaaucggguuuggauugaggaaaacccuuggauggaggauaagacacacaucuccagcuggggagacgugcccuaucugggcaagagagaggaccaauggugcgggucucuuaucggacugaccgcccgcgccacaugggcuaccaauauucaggucgccaucaaccaggugcggagacucauuggcaaugaaaacuaccuggauuacaugacaagcaugaaacgcuuuaagaaugacuccgaucccgagggggcgcugugguga

SEQ ID NO: 19297 - RNA, 9879 nt, Artificial Sequence
  derived and/or modified CDS sequence (opt5) from DENV-1__EU482487__SS-prME
agcgugaccaugcugcucaugcugaugcccacagcccuugcuuuccaccugacgaccagaggcggggagccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgccaaaaaugagacauggaagcucgcuagagccagcuucauugaagugaagaccuguaucuggcccaaaucucacacacugugguccaacggggugcuggagagcgaaaugauuaucccgaagauuuacggaggcccuaucucucaacauaauuaucgccccggguacuucacccagacggcgggaccuuggcaccucggcaaacuggagcuugauuuugaccugugcgaggggaccacagucgugguugaugaacacugcggaaaccggggccccagccucagaaccacaaccgugacgggcaagaucauucaugagugguguugccgguccuguacacugccuccccugcgcuucagaggggaagacggaugcugguacggcauggagauccggccggucaaagagaaggaagagaaucuugucaagagcaugguuucugcuggguccggagaaguggacagcuuuucccucggccugcuguguauuucuaucaugauugaggaagucaugagaagccgcuggucccggaaaaugcucaugaccgggacacuggccguguucuuucuucugaucaugggacagcucaccuggaacgaucugauuagacugugcaucaugguuggcgccaaugcuucugaccgcaugggcauggggaccacauaucuugcccugauggcgacguucaagaugagaccuauguuugcugugggacuccuguuccggcgccucaccagcagagagguccugcuucugacaaucggccucucccugguggccucuguggagcugcccaacagccuugaggaacugggggauggacucgccaugggcauuaugauccugaaacuccugaccgacuuucaaucccaccagcuuugggcuacacugcucagccugaccuucauuaagacgacauuuucucugcauuacgccuggaaaaccauggcuaugguccuuuccaucguuagccuguucccccucugucugucuaccacaucccagaagaccacauggcucccugugcugcuugggagccugggaugcaagccgcugacgauguuucucauugccgaaaauaaaaucuggggccggcgcucuuggccccugaacgagggcaucauggcgguggggauugucuccauccuucugagcucccuccugaagaacgaugugccucucgccggaccccugauugcuggcgggaugcuuaucgccuguuauguuauuagcggaucuagcgcugaccugucccuggaaaaagccgccgaggugucuugggaggaagaggcugaacacagcggcgcgucccauaauauccucgucgaggugcaggaugacgggaccaugaagaucaaagaugaagagagagacgauacacugaccauucuucugaaggccacacuccuggcuguuucuggaguguacccucucagcauccccgccacccuguucgucugguauuucuggcagaagaagaagcagcgguccggcgugcuuugggacacgccuucucccccggaggucgaacgcgccgugcuggaugacggcauuuacagaaucaugcagcgggggcugcucggacgcagccagguuggcgugggggucuuucaagagaacguguuccacaccauguggcacguuacaagaggagcugugcugauguaucagggcaaacggcuugaaccuuccugggccagcgucaagaaagaccugauuucuuacgggggaggcuggagacuccagggcuccuggaauaccggggaggagguccaggugaucgcgguugaacccggaaagaacccuaaaaauguccaaacagcucccggcaccuuuaagacaccggagggggaagugggagccauugcccuggauuucaagccuggcacgagcgggucucccaucgugaaccgcgagggaaaaaucgucggccucuacggcaauggggugguuaccacauccggaaccuaugugagcgcuauugcccaggcgaaggcuucccaggaaggcccucugcccgagaucgaggacgaagucuuucggaaaagaaaccuuaccauuauggaucugcaucccgggucuggaaagacacgccgguaccugccugccaucgugagagaggccauuaaacgcaagcuccggacgcugauccuugcuccgaccagaguuguggccagcgaaauggcugaggcccugaagggcaugcccauccgcuaucaaacaaccgcggucaaauccgaacacacagggaaggagauuguggaccucaugugccaugccaccuucacgaugcggcugcugagcccuguuagagugcccaauuacaacaugaucauuauggaugaggcucacuuuacagacccuucuuccaucgccgcucggggcuauauuagcacccgcgucggaaugggcgaagccgccgcuaucuucaugaccgcgacacccccugggucuguggaggccuuuccgcagagcaaugcugugauccaggaugaagagagagacauucccgaacgguccuggaacucuggauacgaguggaucaccgauuucccuggcaaaacagucugguuuguucccagcauuaaguccgggaaugacaucgccaacugucuccgcaaaaauggaaagagagugauucagcuuucucggaagaccuucgauacggaguaucagaaaaccaagaacaacgacugggacuacguggucaccacagauaucagcgaaaugggcgccaauuucagagcugaccgcgugauugauccucggagaugccugaaacccguuauccugaaggacgggccggagcgcgugauccucgccggcccuaugcccgucaccguggcguccgcugcccagcggagaggacgcauuggccggaaccauaauaaagaaggggaucaguacaucuauaugggacagccccugaacaaugacgaggaucacgcccacuggacggaggcuaagaugcuucuggacaacauuaauaccccugaaggcaucauucccgcccucuuugagccugaaagagaaaagagcgcggccaucgauggggaauaccgccugagaggagaggcucggaaaacauucguugagcugaugcgcagaggcgaccucccgguguggcuuucuuauaaggucgccuccgaaggguuucaauacagcgaucggcgcuggugcuucgacggcgagagaaacaaucaggugcuggaagagaacauggaugucgaaaucuggaccaaagagggagagcggaagaaacugagaccccgcuggcucgacgcucggacauauuccgacccucuggcccuuagagaauuuaaggaguucgcugccggccgccggucugugagcggggaucugauucucgaaaucggaaaacugccccagcaucugacccagagagcgcaaaaugcccucgacaaccuuguuaugcugcacaauuccgagcagggcgggcgggcuuaccgccaugccauggaggaacugccugauacaauugagacccucaugcugcuugcucugaucgccgugcucacgggaggcgugacacuguuuuuccugucuggcagagggcucggaaagaccagcauuggccuucugugugucauggccuccagcguucugcucuggauggcuucuguggaaccccacuggaucgcggccuccaucauucuggaguuuuuccuuauggugcugcucaucccggaaccugaccggcagcgcacaccccaggauaaccaacuggcuuaugucgugauugggcugcucuuuaugauccuuacaguugccgccaaugagaugggacugcuggagaccacaaagaaagaccucggcauugggcacgcugccguggaaaaccaucaccaugcggccaugcuggaugucgaccuucacccugcuagcgccuggacgcuguacgcuguggccaccacaaucauuacccccaugaugagacauacaaucgagaacaccacggcgaauaucucucucaccgccauugcuaaccaggccgcuauccugaugggacuggauaagggcuggccuauuuccaaaauggacaucggcgucccccuccuugcccuggggugcuacagccaggugaauccgcugacacucaccgcugccguucugaugcuuguggcgcacuaugccauuaucggaccuggccugcaagcuaaggccacacgggaagcucagaaacgcaccgccgccgggaucaugaagaaccccacggucgauggaauuguggcgaucgaccucgaucccguuguguacgacgcuaaguucgagaaacagcugggccagauuaugcugcucauccuuuguacaucucaaauucugcugaugagaaccacaugggcccucugcgaaagcaucacccuggcuaccgggccucuuacaacgcugugggagggauccccgggcaaguuuuggaauaccacaaucgccgucucuauggccaacauuuuccggggcagcuaucucgcuggggccggacuggcguucucccugaugaaaagccucggcgggggacgcagaggcaccggggcccagggagagacacuuggcgaaaaguggaaacggcagcugaaucagcuguccaagucugaguuuaacaccuacaagagaagcggcaucauggaaguggaccgcuccgaggcuaaagaagggcucaagcggggagagacgacaaaacacgccgugucuagaggcaccgcuaagcugcgcugguucguugagcggaaucuugucaaacccgaagggaaggugauugaucugggauguggcagagggggauggagcuauuacugcgccggccucaagaaagugaccgaggucaagggcuauacaaaagggggaccuggccaugaggagcccaucccuauggcgaccuacggguggaaccugguuaagcugcacuccggaaaagacguguuuuucauucccccugaaaagugugauacacuccuuugcgacaucggcgagucuagcccgaaucccacgauugaggaagggcgcacccugcgggugcugaaaauggucgagccuuggcucagaggaaaccaauuuuguaucaagauccugaaucccuacaugccuuccgugguugaaacacuugagcagaugcagcgcaagcauggcggcaugcuggugcggaacccccucagcagaaauucuacccacgagauguauugggucuccugcgggacaggaaacauugugagcgccguuaauaugaccucucgcaugcugcugaaccgguucacgauggcucacagaaaaccgaccuacgaacgcgauguggaccucggcgccgggacaagacaugucgcuguggagccugaaguggccaaccuggauaucauuggacagcggaucgagaauauuaagcacgaacauaaauccaccuggcacuaugacgaggauaaccccuacaagacaugggcuuaucauggcagcuacgaggucaaacccucuggguccgccagcuccaugguuaauggaguggugaaacuucugaccaagccuugggacgucauccccauggugacacaaaucgcgaugaccgauacgacaccuuuuggccagcagcgcguuuucaaagaaaagguggacaccagaaccccgaaagccaagcggggcacagcucaaauuauggaggucacggccaaauggcucuggggguuucugagcagaaacaagaagccccggaucuguacccgcgaagaguucacaagaaaagugcggucuaaugcugccauuggagccguuuuuguggacgaaaaccaguggaauagcgcgaaggaggcugucgaggaugaacgcuucugggaccuugugcacagagagcgggaacugcacaaacagggcaagugcgcuaccugcguuuauaacaugauggggaaacgcgagaagaagcucggagaauuuggcaaagccaagggguccagagcuaucugguacauguggcugggcgcccgguuccuggaguucgaggcucucggauuuaugaaugaagaucauugguucucucgcgagaacagccuguccggcguggaaggggagggacuucacaaacugggcuacauucucagagacaucucuaagaucccugggggaaauauguaugccgaugacacagcgggcugggauacccggauuacagaggacgaucugcagaacgaagcccgcaucaccgacauuauggagcccgaacaugcccuucuggccaaaagcaucuuuaagcucacguaccaaaauaaagucgugagaguccagcggccugcuaagaacgggaccgugauggauguuauuucccgcagagaccagcggggcucuggacaggugggcacauaugggcugaauaccuucacaaacauggaggcccaacugaucagacagauggaaagcgagggaaucuuuucccccagcgagcucgaaaccccgaaccuggcggagcgcguccuugauuggcugaagaaauacggcguggaacggcucaagagaauggccauuucuggggacgacugugugguuaaaccuaucgaugaccgcuucgcuacggcccugacagcucuuaaugauaugggaaaggugcggaaagacauuccccagugggagccuuccaagggcuggaacgauuggcagcaaguccccuuuugcagccaccacuuccaucagcugaucaugaaggacgggagagaaauugugguuccuugucgcaaucaggaugagcucgugggccgggccagagucucucagggagcuggcuggucccugcgcgagaccgccugccuggggaaaagcuaugcgcaaauguggcagcucauguacuuucaccggagagaccugcgccuugccgcuaacgccaucuguuccgccgugcccgucgauuggauuccgacaucucggaccacguggagcauccaugcucaccaucaguggaugaccacagaagacaugcuguccguguggaauagaguuuggaucgaggaaaacccuuggauggaggauaagacccacauuagcucuuggggagacgugcccuaucucggcaaacgggaagaccaauggugcgggucccugaucggacuuacagccagagcgaccugggcuacaaauauucaggucgccaucaaccaggugcgccggcugauuggcaaugagaacuaccucgauuacaugaccagcaugaagagauucaaaaaugagggggaccccgaaggcgcccugugguga

SEQ ID NO: 19298 - RNA, 9879 nt, Artificial Sequence
  derived and/or modified CDS sequence (opt5) from DENV-1__EU482488__SS-prME
agcgugaccaugcugcucaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuauauugugaucggggccggagaaaaagcucuuaagcucagcugguucaagaaaggcuccucuauugggaagauguuugaggccaccgcuagaggcgcccgccggauggcgauccugggagauacagccugggacuucggcagcaucgggggaguuuuuaccuccgucggcaaacuggugcaucagauuuucgggacagcuuacggagugcucuuuagcggcgucucuuggaccaugaagaucgggauuggcgugcugcuuacguggcugggacucaauuccagaagcaccucucuguccaugacauguaucgccguuggccuggugacccuuuaccucggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcugagcgcggccauuggcaaggcuugggaggagggggugugcggcaucagauccgccacccgccucgaaaacaucauguggaaacagauuucuaacgagcugaaucauauccuucuggaaaacgacaugaagcucacgguuguggucggagauguggcuggcauucuggcccaggggaaaaagaugauccggccgcaacccauggaguacaaauauagcuggaaguccuggggaaaggccaaaauuaucggcgcugacgugcagaauacaaccuucaucauugaugggccuaacacccccgaauguccugacgaucagagagcguggaauaucugggaggucgaggacuacggauuuggcauuuucacaaccaacaucuggcugaaacuucgcgauagcuauacgcagguuugcgaccaccggcucaugucugccgcuauuaaagauuccaaggccgugcacgccgacaugggcuacuggaucgaaagcgagaaaaaugaaacauggaagcuggcuagagccucuuuuaucgaggugaagaccuguauuuggcccaaaucccauacacuguggagcaacgggguccucgaaucugagaugaucauuccgaagaucuauggaggcccuauuagccaacacaauuaccgccccggguacuucacccagacagcgggaccuuggcaucugggcaaacuugagcuggauuucgaccucugcgaagggaccacggugguuguggaugagcacugcggaaaccggggccccucccugagaaccacaaccgucacaggcaagaucauccacgaaugguguugccggagcuguacccugccuccccuucgcuuuaaaggggaggacggaugcugguauggcauggagauuagaccggugaaggaaaaggaggaaaaucucguuaaaucuaugguguccgcugggagcggagaggucgacuccuucucucugggccugcucuguaucagcauuaugaucgaagaggugaugcgguccagauggucucgcaagaugcugaugacggggacacuugccgucuuuuuccugcucauuaugggacagcugaccuggaacgaucugauccggcuuugcauuauggugggcgccaaugcuagcgacagaaugggcauggggacaaccuaccuggcccucauggcgaccuuuaaaaugcgcccuauguucgcugucggacugcucuuuagacggcugacaucccgcgaggugcuucugcucacgaucggccugucucugguggccagcgucgaacuucccaacucccuggaggaacucggggauggacuggccaugggcaucaugauucucaagcugcuuaccgacuuccaaagccaucagcugugggcuacacuccugucucugaccuuuaucagaacaaccuucucccuucacuaugccuggaaaacgauggcuaugguucugagcauugugucucucuuuccccugugucucuccacaaccagccagaagaccacauggcugccugugcuucuggggucucugggaugcaagccgcucaccauguuccugaucgccgagaauaaaauuuggggccggaaguccuggccccuuaacgaaggcaucauggcggucgggaucgugagcauucugcucuccagccugcucaaaaacgauguuccucuggccggaccccuuaucgcuggcgggaugcugauugccuguuacgugaucucuggaagcuccgcugaccugucucucgagaaggccgccgaggucagcugggaagaggaagcugagcauuccggcgcgucucacaauauucugguggaaguucaggaugacgggacaaugaaaaucaaggaugaggagcgcgacgauacgcuuaccauccugcucaaagccacacugcucgcugugagcggagucuauccucuguccauucccgccacccuuuuugugugguacuucuggcaaaagaagaaacagagaucuggcguccugugggacacaccuuccccucccgaaguggagcgggccguucuggaugacggcaucuaucgcauuaugcagagagggcuccugggacggucccaggugggcgucgggguguuccaagaaaacguuuuucauaccauguggcacgugacgcgcggagcuguccuuauguaccagggcaagagacuggagcccagcugggccucugugaaaaaggaccucaucuccuacgggggaggcuggcggcugcagggcagcuggaauaccggggaggaagugcagguuauugcggucgagcccggcaagaauccuaagaaugugcaaacagcucccggcaccuucaagacaucugaaggggaggugggagccaucgcccucgauuuuaaaccgggcaccuccgggagcccuauugucaacagagaaggaaagaucgugggccuguauggcaaugggguugugacaacguccggaaccuacgucucugcuaucgcccaggcgaaagcuagccaggagggcccccuuccugagauugaagacgagguguuccgcaagcggaaccugacaaucauggaucugcaccccggguccggaaaaaccagacgcuaucuccccgccauuguucgggaagccaucaagagacgccugcggacccuuauucuggcuccuacaagaguggucgccagcgagauggcugaagcccucaagggcaugccgauccgcuaccaaacgaccgcggugaaaucugagcauacagggaaggagaucguugaccugaugugccacgccaccuuuacaaugcggcugcucucccccgugagagucccuaauuauaacaugauuaucauggaugaagcucauuucaccgaccccagcucuauugccgcucggggcuacaucagcacgcgcgugggaaugggcgaggccgccgcuauuuuuaugacagcgaccccucccggguccguggaagccuucccucagucuaaugcugucauccaggaugaggaaagagacaucccggagcggagcuggaacuccggauaugaguggauuaccgauuuucccggcaaaacaguuugguucgugccuucuaucaagagcgggaaugacauugccaacugucuucgcaaaaauggaaagagagugauccagcugucccggaagaccuuugauacagaauaccagaagaccaagaacaacgacugggacuacgucgugacgacagauauuagcgagaugggcgccaauuucagagcugaccgcguuaucgauccccggagaugccugaaaccugugauucucaaggacgggcccgaacgcgucauccuggccggcccgaugccugugaccguugcgucugcugcccagcggagaggacgcaucggccggaaccacaauaaagagggggaucaguauauuuacaugggacagccccuuaacaaugacgaggaucaugcccacuggacagaagcuaagaugcugcucgacaacaucaauacccccgagggcauuaucccugcccuguucgaacccgagagagaaaaguccgcggccauugauggggaguaucgccugagaggagaggcucggaaaacguuuguggaacucaugcgcagaggcgaccuuccugucuggcugagcuacaagguggccuccgagggguuccaauauucugaucggcgcuggugcuuugacggcgaaagaaacaaucagguccuggaggaaaacauggauguggagaucuggaccaaagagggagaacggaagaaacucagaccgcgcuggcuggacgcucggacauacagcgacccccuugcccugagagaguucaaggaauuugcugccggccgccgguccguuucuggggaucucauccuggagauuggaaaacugccucagcaccucacccagagagcgcaaaaugcccuugacaaccuggugaugcugcauaauagcgaacagggcgggcgggcuuaucgccacgccauggaggagcuccccgauacaaucgaaacccugaugcuucuggcucucauugccgugcugacaggaggcgucacccuguucuuucucuccggcagagggcuuggaaagacgagcaucggccugcuguguguuauggccucuuccgugcuccuguggauggcuagcguggagccucauuggauugcggccucuaucauccuugaguucuuucugaugguccuccugauucccgagccggaccggcagcgcacaccucaggauaaccaacuggcuuacgugguuaucgggcuccuuuucaugauucugaccguggccgccaaugagaugggacugcucgaaaccacaaagaaagaccugggcaucgggcacgucgcuguggagaaccaccaucacgccgcgaugcuugaugucgaccugcaucccgccuccgcuuggacccucuacgccguggcuacaacgauuaucaccccuaugaugagacacacaauugaaaacaccacagccaauaucagccugaccgcgaucgccaaccaggcugccauucugaugggacucgauaagggcuggcccaucucuaaaauggacauuggcguuccucuucuggcucuggggugcuauagccaggugaauccccucacgcugaccgccgcuguccuuaugcugguggcccauuacgcgaucauuggaccgggccuccaagccaaggcuacacgggaggcccagaaacgcaccgcugccgggaucaugaagaacccuacaguugauggaaucguggccauugaccuggaucccgucguguaugacgcgaaguuugaaaaacagcugggccagaucaugcuccuuauucuguguaccucccaaauccugcucaugagaacgacaugggcucugugcgagucuauuacccuugccacagggccccugaccacccucugggagggaagcccuggcaaguucuggaauacaacgaucgcuguguccauggccaacaucuuucggggcagcuaccuggccggggcuggacuggccuucucccucaugaaaucucuuggcgggggacgcagaggcaccggggcgcagggagaaacacugggcgagaaguggaaacggcagcugaaucagcucagcaaguccgaguucaacaccuauaagagaucuggcauuauggagguugaccgcagcgaagccaaagaggggcugaagcggggagagacaaccaaacacgcugucuccagaggcacggccaaacuucgcugguuuguggaacggaaucuggugaaaccggaggggaaggucaucgaucucggauguggcagagggggauggucuuacuauugcgcuggccugaagaaaguuacagaagugaagggcuacaccaaagggggacccggccacgaggaaccuauucccauggccaccuacggguggaaccuggugaagcuccauagcggaaaagacgucuucuuuaucccucccgagaagugugauacacuucugugcgacauuggcgaguccagcccuaauccgaccaucgaagaggggcgcacacugcgggugcucaaaaugguugaacccuggcugagaggaaaccaauucuguauuaagauccuuaauccuuauaugcccucuguggucgagacgcuggagcagaugcagcgcaagcacggcggcaugcucgugcggaacccucuguccagaaauagcacccaugaaauguacuggguuucuugcgggacaggaaacaucguguccgcggucaauaugaccagccgcaugcugcucaaccgguuuacaauggcccacagaaaacccaccuaugagcgcgauguggaccugggcgcugggacgagacacguggccgucgaaccggagguugcuaaccuugauauuaucggacagcggauugaaaauaucaagcaugagcacaaaucuaccuggcauuacgacgaggauaacccuuauaagacaugggccuaccacggcuccuaugaagugaaacccagcggguccgcuagcucuauggugaauggagucgugaagcugcucaccaagcccugggacguuauuccuauggugacacaaaucgccaugaccgauacaacccccuucggccagcagcgcgucuuuaaagagaagguggacacgagaacaccuaaagcgaagcggggcaccgcccaaaucauggaaguuaccgcuaaauggcuguggggguuccuuagcagaaacaagaagccgcggauuuguacacgcgaggaauuuacgagaaaagugcgguccaaugccgcuaucggagccgucuucguggacgagaaccaguggaacucugccaaggaggcgguugaagaugagcgcuuuugggaccuggugcauagagaacgggagcuccacaaacagggcaagugcgcuaccugcgucuacaacaugauggggaaacgcgaaaagaagcugggagaguucggcaaagccaaggggagcagagccauuugguacauguggcugggcgcucgguuucucgaguucgaagcccugggauucaugaaugaggaucacugguuuucccgcgaaaacucucuuagcggcguggagggggagggacugcauaaacucggcuauauccugagagacauuuccaagauccccgggggaaauauguacgcugaugacacagccggcugggauacccggaucacagaagacgaucuucagaacgaggcgaaaauuaccgacaucauggaaccugagcacgcccugcucgcuaagucuauuuucaaacugacauaucaaaauaaggucgugcgcguucagagacccgccaagaacgggaccgugauggaugucaucagccggcgcgaccagagaggcuccggacaggugggcacguacgggcugaauaccuuuacaaacauggaagcucaacucauucggcagauggagagcgagggaaucuucucuccuuccgaacuggagacccccaaccuugccggcagagugcuggauuggcucgaaaaacaugggguugagcgccugaagcggauggcgaucagcggagacgacuguguggucaaaccgauugaugacagauuugccacagcucuuaccgcccugaaugauaugggcaaggugcgcaaagacaucccucagugggaacccucuaagggguggaacgauuggcagcaaguuccuuucugcucccaccacuuucaucagcucauuaugaaggacggccgggagaucgugguccccuguagaaaucaggaugagcuggugggacgcgcucgggucagccagggcgccggguggucccugagagaaacggcuugccucggaaaaucuuaugcccaaauguggcagcugauguacuuccaccgccgggaccuuagacuggcggccaacgcuauuuguagcgccgugccuguugauugggugcccacaucccgcaccacauggagcauccaugcccaccaucaguggaugaccacggaggacaugcucucugucuggaaucggguguggauugaagagaacccguggauggaagauaagacccacguuuccagcugggaggacgugccuuaucugggcaaaagagaggaccaauggugcgggucucuuaucggacugacagcucgggccaccugggcgacaaauauccaggucgcuauuaaccaggugagacgccuccugggcaaugaaaacuaccuggauuacaugaccagcaugaagcgguuuaaaaaugaguccgaccccgaaggggcccucugguga

SEQ ID NO: 19299 - RNA, 9879 nt, Artificial Sequence
  derived and/or modified CDS sequence (opt5) from DENV-1__EU482489__SS-prME
agcgugaccaugcugcuuaugcugaugcccacagcccuugcuuuccaccugacgaccagaggcggggaaccucauaugaucgucuccaagcaggaacgggggaaaucucugcuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacacuuaucgcucuguuucucgcccaugcgauugggaccucuaucacccagaagggaaucauuuucauccugcuuaugcuggugacaccuagcauggccaugagaugcgucggcauugggucccgggauuuuguggagggacucagcggcgcuacguggguugacgugguccuggagcacgggucuugugugaccacaauggccaaggauaaacccacccuggacaucgaacuccugaagacagaggugaccaacccugcuguccuucgcaaacugugcauugaagccaagaucuccaauacgacaaccgauagcagauguccgacccaaggagaggcgacacucguugaagaacaagacgccaacuucgugugccggcgcaccuuuguggauagaggcuggggcaauggguguggacuguucggcaaagggucucuuauuacaugcgcuaaguuuaagugcgucacgaaacuggagggaaagaucgugcaguacgaaaaccucaaauauuccguuaucgugaccguccacacaggcgaccagcaucaaguggggaaugagagcaccgaacacggaacaaccgccacgauuacaccccaagcuccuaccaccgagauccagcugacagacuacggcgcccugacccucgauuguucuccccggacgggccuggacuucaacgaaaugguucuucugacaaugaaggagaaauccuggcucgugcauaagcagugguuucuggaucuuccucugcccuggaccagcggggccuccacaucucaagagaccuggaaucgccaggaccuccuggucaccuucaaaacagcucacgcgaagaagcaggaaguggucgugcugggaagccaagagggcgccaugcacacggcucucaccggggccacagaaauucagaccuccggaacaaccacgaucuuugccggccaucugaaaugcagacuuaagauggauaaacugacacucaaggggaugagcuauguuauguguaccggcucuuucaaacuggagaaggaacuggcugagacccagcacggaacagugcuuguccagauuaaguacgagggcaccgacgccccgugcaaaaucccuuucuccacacaagaugaaaagggggugacgcagaacggacggcucaucaccgcgaaucccauuguuacagacaaagagaagccugugaacaucgaagcugagccgcccuuuggcgagagcuauauugucaucggggccggagaaaaagcccugaagcugucuugguucaagaaaggcagcuccauugggaagauguuugaggcuaccgccagaggcgcucgccggauggccauccucggagauacagcgugggacuucggcucuaucgggggaguguuuaccagcgugggcaaacugguucaucagauuuucgggacggccuacggaguccucuuuuccggcgugagcuggaccaugaagaucgggauuggcgugcugcucacauggcugggacucaauucuagauccaccagccuuucuaugacauguaucgcugucggccucgugacccuguaccuggggguuauggugcaggccgauuccggaugcgucauuaacuggaaaggccgcgaacucaagugugggagcggaaucuucgugacaaaugagguucacaccuggacggaacaauauaaguuucaggcugacuccccuaaacggcugucugccgcgauuggcaaggccugggaggagggggugugcggcaucagaagcgcuacacgccuugaaaacaucauguggaaacagauuuccaacgagcugaaucauauccuccuggaaaacgacaugaaguucaccgucgugguuggagauguggccggcauucuggcucaggggaaaaagaugauccggccgcaacccauggaguacaaauauucuuggaaaagcuggggaaaggccaagauuaucggcgccgacguccagaauaccacauuuaucauugaugggccuaacacccccgaauguccugacgaucagagagcuuggaauaucugggagguggaggacuacggauucggcauuuuuacgacaaacaucuggcuuaagcuccgcgauuccuauacccaggugugcgaccaccggcugaugagcgcggccauuaaagauucuaaggcuguccacgccgacaugggcuacuggaucgaauccgagaaaaaugaaacauggaagcuggccagagcuagcuucaucgagguuaagaccuguauuuggcccaaaucucauacacucugguccaacggggugcuggaaagcgagaugaucauuccgaagaucuauggaggcccuauuucucaacacaauuaccgccccggguacuucacccagacggccggaccuuggcaucuuggcaaacuggagcucgauuuugaccugugcgaagggaccacaguggucguggaugagcacugcggaaaccggggccccagccugagaaccacaaccguuacgggcaagaucauccacgaaugguguugccgguccuguacacuuccuccccuccgcuucagaggggaggacggaugcugguauggcauggagauucggccggugaaagaaaaggaggaaaaucuggucaagagcauggugucugcgggguccggagagguugacagcuuuucccugggccuccuguguaucucuauuaugaucgaagaggugaugagaagccgcuggucccggaaaaugcuuaugaccgggacacuggcugucuucuuucuccugauuaugggacagcugaccuggaacgaucuuaucagacugugcauuauggugggcgccaaugccucugaccgcaugggcauggggaccacauaccucgcucugauggccacguucaagaugagaccuauguuugcgguuggacuccuguuccggcgccuuaccagcagagaggugcugcuccugacaaucggccugucccuugucgcuucuguggaacugcccaacagccucgaggaacugggggauggacucgccaugggcaucaugauucugaaacuucugaccgacuuucaaucccaucagcucugggccacacugcugagccuuaccuucaucaagacgacauuuucucugcacuaugcuuggaaaaccauggccauggugcucuccauugucagccuguucccccucugucugucuaccacaucccagaagaccacauggcuuccuguucugcuggggagccucggaugcaagccgcugacgauguuucuuaucgcugagaauaaaauuuggggccggcgcucuuggccccugaacgaaggcaucauggccguggggaucguguccauucuccugagcucccuccugaagaacgaugucccucuugcgggaccccugaucgccggcgggaugcugauugcuuguuacgugaucagcggaucuagcgccgaccucucccuggagaaagcugccgagguuucuugggaagaggaagccgagcauagcggcgcuucccacaauauucuuguggaaguccaggaugacgggaccaugaagaucaaagaugaggagagagacgauacacugaccauccuccugaaggcgacacuccuggccgugucuggaguuuauccucuuagcauucccgcuacccuguucgugugguacuucuggcagaagaagaagcagcgguccggcguccugugggacacgccuucucccccggaaguggagcgcgccguccucgaugacggcaucuauagaauuaugcagcgggggcugcuuggacgcagccaggugggcguugggguguuucaagaaaacgucuuccauaccauguggcacgugacaagaggagccguucugauguaccagggcaaacggcucgagccuuccugggcuagcgugaagaaagaccugaucucuuacgggggaggcuggagacuccagggcuccuggaauaccggggaggaaguccaggugauugccguggagcccggaaagaacccuaaaaauguucaaacagcgcccggcaccuuuaagacaccggaaggggaggucggagcuaucgcccuggauuucaagccuggcacgagcgggucucccauugugaaccgcgaaggaaaaaucgugggccuuuauggcaauggggucgugaccacauccggaaccuacguuagcgccaucgcucaggccaaggcgucccaggagggcccucugcccgagauugaagacgagguguuucggaaaagaaaccugaccaucauggaucuccaccccgggucuggaaagacacgccgguaucugccugcuauugucagagaagccaucaaacgcaaacuucggacgcugauucucgccccgaccagagugguugcuagcgagauggccgaagcucugaagggcaugcccauccgcuaccaaacaaccgccgugaaauccgagcauacagggaaggagaucgucgaccugaugugccacgcgaccuucacgaugcggcuccuuagcccugugagaguucccaauuauaacaugauuaucauggaugaagcccauuuuacagacccuucuuccauugcugcccggggcuacaucagcacccgcgugggaaugggcgaggcugccgccauuuucaugaccgcuacacccccugggucugucgaagcguuuccgcagagcaaugccgugauccaggaugaggaaagagacauccccgagcgguccuggaacucuggauaugaguggauuaccgauuucccuggcaaaacagugugguuuguccccagcaucaaguccgggaaugacauugcuaacugucugcgcaaaaauggaaagagaguuauccagcugucucggaagaccuucgauacggaauaccagaagaccaagaacaacgacugggacuacguggugaccacagauauuagcgagaugggcgccaauuucagagccgaccgcgucaucgauccucggagaugccucaaacccgugauucugaaggacgggccggaacgcguuauccuugcuggcccuaugcccgugaccgucgccuccgcggcucagcggagaggacgcaucggccggaaccacaauaaagagggggaucaguauauuuacaugggacagccccugaacaaugacgaggaucaugcccacuggacggaagccaagaugcuccuggacaacaucaauaccccugagggcauuauccccgcucuguuugaaccugagagagaaaagagcgccgcgauugauggggaguaucgccucagaggagaggcccggaaaacauucguggaacuuaugcgcagaggcgaccugccgguuuggcugucuuacaagguggcuuccgagggguuucaauauagcgaucggcgcuggugcuucgacggcgaaagaaacaaucagguccucgaggaaaacauggauguggagaucuggaccaaagagggagaacggaagaaacugagaccccgcuggcuugacgcccggacauacuccgacccucuggcucucagagaguuuaaggaguucgccgcuggccgccggucugucagcggggaucugauccuggagauuggaaaacucccccagcaccuuacccagagagcccaaaaugcgcuggacaaccuggugaugcuccauaauuccgaacagggcgggcgggccuaucgccacgcuauggaggagcugccugauacaaucgaaacccuuaugcugcucgcccugauugcuguucugacgggaggcgugacacucuuuuuccuuucuggcagagggcugggaaagaccagcaucggccugcucugugugauggccuccagcguccugcuuuggauggccucuguugagccccauuggauugcugcguccaucauccuggaauuuuuccucauggugcugcugauuccggagccugaccggcagcgcacaccccaggauaaccaacucgccuacguggucaucgggcuucuguuuaugauucugacaguggcugccaaugagaugggacuccuggaaaccacaaagaaagaccuuggcaucgggcacguugccguggagaaccaccaucacgcugccaugcuggaugucgaccuccauccugcgagcgccuggacgcuguacgcuguggccaccacaauuaucacccccaugaugagacacacaauugaaaacaccacggcuaauaucucucugaccgccaucgcgaaccaggccgcuauucucaugggacuugauaagggcuggccuaucuccaaaauggacauuggcgucccccugcuggcccucgggugcuauagccaggugaauccgcugacacuuaccgcugccguucugaugcucguggcucauuacgccaucauuggaccuggccugcaagcgaaggccacacgggaggcucagaaacgcaccgccgcugggaucaugaagaaccccacggucgauggaaucguggccauugaccuggaucccguuguguaugacgccaaguucgaaaaacagcucggccagaucaugcuucugauucuguguacaucucaaauccuccugaugagaaccacaugggcgcuuugcgagagcauuacccuggcuaccgggccucucacaacgcugugggagggauccccgggcaaguuuuggaauaccacaaucgccgucucuauggcuaacaucuuccggggcagcuaccuggccggggccggacucgcuuucucccuuaugaaaagccugggcgggggacgcagaggcaccggggcccagggagaaacacugggcgagaaguggaaacggcagcucaaucagcuguccaagucugaauuuaacaccuauaagagaagcggcauuauggagguggaccgcuccgaagcgaaagaggggcuuaagcggggagagacgacaaaacacgccgugucuagaggcaccgcuaagcugcgcugguucguugaacggaaucucgucaaacccgaggggaaggugaucgaucugggauguggcagagggggauggagcuacuauugcgccggccugaagaaagugaccgaagucaagggcuacacaaaagggggaccuggccacgaggaacccauuccuauggcuaccuacggguggaaccucguuaaacuucauuccggaaaagacguguuuuucauucccccugagaagugugauacacugcugugcgacauuggcgagucuagcccgaaucccacgaucgaagaggggcgcacccuccgggugcugaaaauggucgaaccuuggcuuagaggaaaccaauuuuguauuaagauccugaaucccuauaugccuuccgugguugagacacucgagcagaugcagcgcaagcacggcggcaugcuggugcggaacccccugagcagaaauucuacccaugaaauguacugggucuccugcgggacaggaaacaucgugagcgccguuaauaugaccucucgcaugcuccugaaccgguucacgauggcgcacagaaaaccgaccuaugagcgcgauguggaccuuggcgccgggacaagacacgucgcuguggaaccugagguggccaaccuggauauuaucggacagcggauugaaaauaucaagcaugagcacaaauccaccuggcauuacgacgaggauaaccccuauaagacaugggcuuaccacggcagcuaugaagucaaacccucuggguccgccagcuccaugguuaauggaguggugaagcuccugaccaagccuugggacgucauucccauggugacacaaaucgcuaugaccgauacgacaccuuuuggccagcagcgcguuuucaaagagaagguggacaccagaaccccgaaagccaagcggggcacagcgcaaaucauggaagucacggccaaauggcuuuggggguuucugagcagaaacaagaagccccggauuuguacccgcgaggaguucacaagaaaagugcggucuaaugcugccaucggagcuguuuuuguggacgagaaccaguggaauagcgccaaggaggccgucgaagaugagcgcuucugggaccucgugcauagagaacgggagcugcacaaacagggcaagugcgcgaccugcguuuacaacaugauggggaaacgcgaaaagaagcugggagaguuuggcaaagcuaagggguccagagccauuugguacauguggcucggcgcccgguuccuggaguucgaagcucuuggauuuaugaaugaggaucacugguucucucgcgaaaacagccuguccggcguggagggggagggacuccauaaacugggcuauauccuuagagacauuucuaagaucccugggggaaauauguacgccgaugacacagcuggcugggauacccggaucacagaagacgaucugcagaacgaggcccgcauuaccgacaucauggaacccgagcacgcgcuccuggccaaaagcauuuuuaagcugacguaucaaaauaaagucgugagaguccagcggccugcuaagaacgggaccgugauggauguuaucucccgcagagaccagcggggcucuggacaggugggcacauacgggcucaauaccuucacaaacauggaagcccaacugauuagacagauggagagcgagggaaucuuuucccccagcgaacuugagaccccgaaccuggcugaacgcguccucgauuggcuggagaaguauggcguggaacggcuuaaaagaauggccaucucuggggacgacugugugguuaagccuauugaugaccgcuucgcgacggcccugacagcucucaaugauaugggaaaagugcggaaggacaucccccagugggagccuuccaaaggcuggaacgauuggcagcaaguccccuuuugcagccaucacuuccaccagcugauuaugaaggacgggagagagaucgugguuccuugucgcaaucaggaugaacuggugggccgggccagagucucucagggagcuggcuggucccuccgcgagaccgccugccugggaaagagcuacgcucaaauguggcagcuuauguauuuucaucggagagaccugcgccucgccgcgaacgccauuuguuccgcugugcccgucgauuggaucccgacaucucggaccacguggagcauucacgcccaucaccaguggaugaccacagaagacaugcuguccguguggaauagaguuuggaucgaggaaaacccuuggauggaggauaaaacccauaucagcucuuggggagacgugcccuaccuuggcaagcgggaggaccaauggugcgggucccugauuggacucacagccagagcuaccugggccacaaauauccaggucgcgauuaaccaggugcgccggcugaucggcaaugaaaacuaccuggauuauaugaccagcaugaaaagauucaagaaugagucugaccccgaaggggcucucugguga

SEQ ID NO: 19300 - RNA, 9879 nt, Artificial Sequence
  derived and/or modified CDS sequence (opt5) from DENV-1__EU482490__SS-prME
agcgugaccaugcugcucaugcugaugcccacagcccuugcuuuccaccugacgaccagaggcggggaaccucauaugaucguguccaagcaggaacgggggaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaccaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguguuuacgagcguuggcaaacugguccaucagauuuucgggaccgccuacggagugcucuuuuccggcgugagcuggacaaugaagaucgggauuggcguccugcuuaccuggcugggacucaauucuagauccacaagccugucuaugaccuguaucgcugugggccugguuacacuuuaccucggggugaugguccaggccgauuccggaugcgugauuaacuggaaaggccgcgaacugaagugugggagcggaaucuucguuaccaaugaggugcacacguggacagaacaauauaaguuucaggcugacuccccuaaacggcugucugccgcgauuggcaaggccugggaggagggggucugcggcaucagaagcgcuacccgccucgaaaacaucauguggaaacagauuuccaacgagcugaaucauauccuucuggaaaacgacaugaaguucaccgugguugugggagaugucgccggcauucucgcucaggggaaaaagaugauccggccgcaacccauggaguacaaauauucuuggaaaagcuggggaaaggccaagauuaucggcgccgacgugcagaauacaaccuuuaucauugaugggccuaacacgcccgaauguccugacgaucagagagcuuggaauaucugggagguggaggacuacggauucggcauuuuuacaaccaacaucuggcugaagcugcgcgauuccuauacacaggucugcgaccaccggcuuaugagcgcggccauuaaagauucuaaggcuguucacgccgacaugggcuacuggaucgaauccgagaaaaaugaaaccuggaagcucgccagagcuagcuucaucgaggugaagacauguauuuggcccaaaucucauacccugugguccaacggggugcuggaaagcgagaugaucauuccgaagaucuauggaggcccuauuucucaacacaauuaccgccccggguacuucacgcagaccgccggaccuuggcaucucggcaaacuggagcuugauuuugaccugugcgaagggacaaccgucgugguugaugagcacugcggaaaccggggccccagccucagaacaaccacggugacaggcaagaucauccacgaaugguguugccgguccuguacccugccuccccugcgcuucagaggggaggacggaugcugguauggcauggagauucggccggucaaagaaaaggaggaaaaucuugucaagagcaugguuucugcgggguccggagagguggacagcuuuucccucggccugcuguguaucucuauuaugaucgaagaggucaugagaagccgcuggucccggaaaaugcucaugacagggacccuggcuguguucuuucuucugauuaugggacagcucaccuggaacgaucugaucagacugugcauuaugguuggcgccaaugccucugaccgcaugggcauggggacaacguaccuugcucugauggccaccuucaagaugagaccuauguuugcggugggacuccuguuccggcgccucacaagcagagagguccugcuucugaccaucggccucucccugguggcuucuguggaacugcccaacagccuugaggaacugggggauggacucgccaugggcaucaugauucugaaacuccugacagacuuucaaucccaucagcuuugggccacccugcucagccugacguucaucaagacaaccuuuucucugcacuaugcuuggaaaaccauggccaugguccuuuccauuguuagccuguucccccucugucugucuacaaccucccagaagacaacguggcucccugugcugcuugggagccugggaugcaagccgcugaccauguuucucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggacaaugaagaucaaagaugaggagagagacgauacccugacaauccuucugaaggcgacccuccuggccguuucuggaguguauccucucagcauucccgcuacgcuguucgucugguacuucuggcagaagaagaagcagcgguccggcgugcuuugggacaccccuucucccccggaagucgagcgcgccgugcuggaugacggcaucuauagaauuaugcagcgggggcugcucggacgcagccagguuggcgugggggucuuucaagaaaacguguuccauacaauguggcacguuaccagaggagccgugcugauguaccagggcaaacggcuugagccuuccugggcuagcgucaagaaagaccugaucucuuacgggggaggcuggagacuccagggcuccuggaauacaggggaggaaguccaggugauugccguugagcccggaaagaacccuaaaaauguccaaaccgcgcccggcacauuuaagacgccggaaggggaggugggagcuaucgcccuggauuucaagccuggcaccagcgggucucccauugugaaccgcgaaggaaaaaucgucggccucuauggcaauggggugguuacaaccuccggaaccuacgugagcgccaucgcucaggccaaggcgucccaggagggcccucugcccgagauugaagacgaggucuuucggaaaagaaaccuuacaaucauggaucugcaccccgggucuggaaagacgcgccgguaucugccugcuauugugagagaagccaucaaacgcaagcuccggacccugauucuugccccgacaagaguuguggcuagcgagauggccgaagcucugaagggcaugcccauccgcuaccaaaccacagccgucaaauccgagcauaccgggaaggagaucguggaccucaugugccacgcgacguucacaaugcggcugcugagcccuguuagagugcccaauuauaacaugauuaucauggaugaagcccauuuuaccgacccuucuuccauugcugcccggggcuacaucagcacccgcgucggaaugggcgaggcugccgccauuuucaugacagcuacacccccugggucuguggaagcguuuccgcagagcaaugccgugauccaggaugaggaaagagacauccccgagcgguccuggaacucuggauaugaguggauuacagauuucccuggcaaaaccgucugguuuguucccagcaucaaguccgggaaugacauugcuaacugucuccgcaaaaauggaaagagagugauccagcuuucucggaagacguucgauacagaauaccagaaaaccaagaacaacgacugggacuacguggucacaaccgauauuagcgagaugggcgccaauuucagagccgaccgcgugaucgauccucggagaugccugaaacccguuauucugaaggacgggccggaacgcgugauccucgcuggcccuaugcccgucacgguggccuccgcggcucagcggagaggacgcaucggccggaaccacaauaaagagggggaucaguauauuuacaugggacagccccugaacaaugacgaggaucaugcccacuggaccgaagccaagaugcuucuggacaacaucaauacaccugagggcauuauccccgcucucuuugaaccugagagagaaaagagcgccgcgauugauggggaguaucgccugagaggagaggcccggaaaaccuucguugaacugaugcgcagaggcgaccucccgguguggcuuucuuacaaggucgcuuccgagggguuucaauauagcgaucggcgcuggugcuucgacggcgaaagaaacaaucaggugcuggaggaaaacauggaugucgagaucuggacaaaagagggagaacggaagaaacugagaccccgcuggcucgacgcccggaccuacuccgacccucuggcucuuagagaguuuaaggaguucgccgcuggccgccggucugugagcggggaucugauccucgagauuggaaaacugccccagcaccugacacagagagcccaaaaugcgcucgacaaccuuguuaugcugcauaauuccgaacagggcgggcgggccuaucgccacgcuauggaggagcugccugauaccaucgaaacgcucaugcugcuugcccugauugcugugcucacaggaggcgugacccuguuuuuccugucuggcagagggcucggaaagaccagcaucggccuucugugugucauggccuccagcguucugcucuggauggccucuguggagccccauuggauugcugcguccaucauccuggaauuuuuccuuauggugcugcucauuccggagccugaccggcagcgcacaccccaggauaaccaacuggccuacgucgugaucgggcugcucuuuaugauucuuaccguugcugccaaugagaugggacugcuggaaacaacgaagaaagaccucggcaucgggcacguggccgucgagaaccaccaucacgcugccaugcuggauguggaccuucauccugcgagcgccuggacccuguacgcugucgccacaaccauuaucacacccaugaugagacacaccauugaaaacacgaccgcuaauaucucucucacagccaucgcgaaccaggccgcuauucugaugggacuggauaagggcuggccuaucuccaaaauggacauuggcgugccccuccuugcccuggggugcuauagccagguuaauccgcugacccucacagcugccgugcugaugcuugucgcucauuacgccaucauuggaccuggccugcaagcgaaggccacccgggaggcucagaaacgcacggccgcugggaucaugaagaaccccacaguggauggaaucguugccauugaccucgaucccguggucuaugacgccaaguucgaaaaacagcugggccagaucaugcugcucauucuuuguaccucucaaauccugcugaugagaacaaccugggcgcucugcgagagcauuacccuggcuacagggccucuuacgacccugugggagggauccccgggcaaguuuuggaauacaaccaucgccgugucuauggcuaacaucuuccggggcagcuaccucgccggggccggacuggcuuucucccugaugaaaagccucggcgggggacgcagaggcacaggggcccagggagaaacccuuggcgagaaguggaaacggcagcugaaucagcuguccaagucugaauuuaacacguauaagagaagcggcauuauggagguggaccgcuccgaagcgaaagaggggcucaagcggggagagacaaccaaacacgccguuucuagaggcaccgcuaagcugcgcugguucgucgaacggaaucuugugaaacccgaggggaaggugaucgaucugggauguggcagagggggauggagcuacuauugcgccggccucaagaaagucacagaaguuaagggcuacaccaaagggggaccuggccacgaggaacccauuccuauggcuacauacggguggaaccuggugaagcugcauuccggaaaagacguguuuuucauucccccugagaagugugauacgcuccuuugcgacauuggcgagucuagcccgaaucccaccaucgaagaggggcgcacacugcggguccugaaaaugguggaaccuuggcucagaggaaaccaauuuuguauuaagauccugaaucccuauaugccuuccguuguggagacccuugagcagaugcagcgcaagcacggcggcaugcugguccggaacccccucagcagaaauucuacacaugaaauguacuggguguccugcgggaccggaaacaucguuagcgccgugaauaugacgucucgcaugcugcugaaccgguucaccauggcgcacagaaaaccgacauaugagcgcgaugucgaccucggcgccgggaccagacacguggcuguggaaccugaggucgccaaccuggauauuaucggacagcggauugaaaauaucaagcaugagcacaaauccacauggcauuacgacgaggauaaccccuauaagaccugggcuuaccacggcagcuaugaaguuaaacccucuggguccgccagcuccauggugaauggaguggucaaacuucugacaaagccuugggacgugauucccaugguuacccaaaucgcuaugacggauacaaccccuuuuggccagcagcgcguguucaaagagaaggucgacaccagaacaccgaaagccaagcggggcacggcgcaaaucauggaagugaccgccaaauggcucuggggguuucugagcagaaacaagaagccccggauuuguacacgcgaggaguucaccagaaaaguucggucuaaugcugccaucggagcuguguuugucgacgagaaccaguggaauagcgccaaggaggccguggaagaugagcgcuucugggaccuuguucauagagaacgggagcugcacaaacagggcaagugcgcgacaugcguguacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcgucgagggggagggacuucauaaacugggcuauauccucagagacauuucuaagaucccugggggaaauauguacgccgaugacaccgcuggcugggauacacggaucaccgaagacgaucugcagaacgaggcccgcauuacggacaucauggaacccgagcacgcgcuucuggccaaaagcauuuuuaagcucaccuaucaaaauaaaguggucagagugcagcggccugcuaagaacgggacaguuauggaugugaucucccgcagagaccagcggggcucuggacaggucggcaccuacgggcugaauacauucaccaacauggaagcccaacugauuagacagauggagagcgagggaaucuuuucccccagcgaacucgagacgccgaaccuggcugaacgcgugcuugauuggcuggagaaguauggcguggaacggcucaaaagaauggccaucucuggggacgacuguguugugaagccuauugaugaccgcuucgcgacagcccugaccgcucuuaaugauaugggaaaaguccggaaggacaucccccagugggagccuuccaaaggcuggaacgauuggcagcaagugcccuuuugcagccaucacuuccaccagcugauuaugaaggacgggagagagaucguugugccuugucgcaaucaggaugaacucgucggccgggccagagugucucagggagcuggcuggucccugcgcgagacagccugccugggaaagagcuacgcucaaauguggcagcucauguauuuucaucggagagaccugcgccuugccgcgaacgccauuuguuccgcuguccccguggauuggaucccgaccucucggacgaccuggagcauucacgcccaucaccaguggaugacaaccgaagacaugcuguccguuuggaauagaguguggaucgaggaaaacccuuggauggaggauaaaacacauaucagcucuuggggagacguccccuaccucggcaagcgggaggaccaauggugcgggucccugauuggacuuaccgccagagcuacaugggccaccaauauccagguggcgauuaaccagguucgccggcugaucggcaaugaaaacuaccucgauuauaugacgagcaugaaaagauucaagaaugagucugaccccgaaggggcucugugguga

SEQ ID NO: 19301 - RNA, 9879 nt, Artificial Sequence
  derived and/or modified CDS sequence (opt5) from DENV-1__EU482491__SS-prME
agcgugaccaugcugcugaugcugaugcccacagcucuugcuuuccaccugacgaccagaggcggggaaccucauaugaucguguccaagcaggaacggggaaaaucucuccuguuuaagacaagcgccggcguuaacaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguacccaaauuggcgaacacagacgggacaagcgcuccgucgcccucgcuccucauguggggcugggacuggagacaagaaccgaaacguggaugucuagcgagggcgccuggaaacagauccagcggguugaaacaugggcucuccgccaccccggcuuuaccgugauugcccuguuccuugcgcaugccaucgggacauccaucacccagaagggaauuaucuuuauucugcucaugcuggcuaccccuucuauggccaugagaugcgucggcaucgggagccgggauuucguggagggacuuuccggcgcuacauggguugacgugguccuggagcacgggagcugugugacgaccauggccaaggauaaacccacacucgacauugaacugcugaagaccgaggugacaaacccugcgguccuccgcaaacugugcaucgaagccaagauuucuaauaccacgacagauuccagauguccgacccaaggagaggcuacccuuguugaagaacaggacgccaacuuugugugccggcgcacauucguggauagaggcuggggcaauggguguggacuguuuggcaaagggagccucaucacaugcgcuaaguucaagugcgucacaaaacuggagggaaagaucgugcaguacgaaaaccuuaaauauucuguuauugugacgguccacaccggcgaccagcaucaaguggggaaugaguccacagaacacggaaccaucgccacaauuacgccccaagccccuagcaccgagauccagcugaccgacuacggcgcucucacacuggauuguucuccccggaccggccuggacuuuaacgaaaugguucuccugacaaugaaggagaaauccuggcuugugcauaagcagugguuccuggaucucccucugcccuggaccagcggggcguccacgucucaagagacauggaaucgccaggaccuucuggucaccuuuaaaacagcccacgcuaagaagcaggaaguggucgugcucggaagccaagagggcgccaugcacaccgcccugaccggggcuacagaaauucagacguccggaaccacaaccaucuucgccggccaucugaaaugcagacucaagauggauaaacugacacuucgggggaugagcuauguuauguguaccggcucuuucaagcuggagaaagaaguggcggagacgcagcacggaacaguccucgugcagaucaaguacgagggcaccgacgcuccgugcaagauuccuuuuuccacccaagaugaaaaagggguuacacagaacggaagacugaucaccgccaaucccauugugacagacaaggagaaaccugucaacaucgaagccgagccgcccuucggcgagagcuauauugugaucggggcuggagaaaaggcccugaaacuuucuugguuuaagaagggcagcuccaucgggaaaauguucgaggcuacggcccgcggcgcgcggagaauggccauucucggagauaccgcuugggacuuuggcucuaucgggggaguguucacaagcguuggcaagcugguccaucagauuuuugggaccgccuacggagugcuguucuccggcgugagcuggacaaugaaaaucgggauuggcguccuccugaccuggcuuggacucaauucucgcuccacgagccucucuaugaccuguaucgcugugggccugguuacacuguaccuuggggugaugguccaggccgauuccggaugcgugauuaacuggaagggccgggaacucaaaugugggagcggaaucuuuguuaccaaugaggugcacacauggaccgaacaauauaaguuccaggcggacuccccuaagagacugucugccgcuaucggcaaagccugggaggagggggucugcggcauucgcagcgcuacacggcuggaaaacaucauguggaagcagauuuccaacgagcucaaucauauccugcuugaaaacgacaugaaacugaccgugguugugggagaugucgccggcauucucgcccaggggaagaaaaugaucagaccgcaacccauggaguacaaguauucuuggaaaaucuggggaaaggcuaagauuaucggcgcggacgugcagaauacgacauuuauuaucgaugggccuaacacccccgaauguccugacgaucagcgcgccuggaauauuugggagguggaggacuacggauucggcaucuuuaccacaaacaucuggcugaaacugcgggauagcuauacccaggucugcgaccacagacuuauguccgcugccauuaaggauagcaaagccguucacgcugacaugggcuacuggaucgaaucugagaagaaugaaacguggaaacucgcccgcgcguccuucauugaggugaagacauguaucuggcccaagagccauacccuguggucuaacggggugcuggaauccgagaugauuaucccgaaaaucuauggaggcccuauuagccaacacaauuaccggcccggguacuucacacagaccgcuggaccuuggcaucucggcaagcuggagcuugauuuugaccugugcgaagggacaaccgucgugguugaugagcacugcggaaacagaggccccucucuccggacgaccacagugaccggcaaaaucauucacgaaugguguugccgcagcuguacacugccuccccugagauucaagggggaggacggaugcugguauggcauggagauccggccggucaaagaaaaggaggaaaaucuugugaaguccaugguuagcgccgggucuggagagguggacuccuuuagccucggccugcuguguauuuccaucaugauugaagaggucaugagaucucgcuggagccggaaaaugcucaugaccgggacgcuggccguguucuuucuucugaucaugggacagcucacauggaacgaucugaucagacugugcauuaugguuggcgcuaaugccuccgaccgcaugggcauggggaccacauaccuugcgcugauggcuaccuucaagaugagaccuauguuugccgugggacuccuguuccggcgccucaccucuagagagguccugcuucugacaaucggccucagccugguggccuccguggaacugcccaacucucuugaggaacugggggauggacucgcuaugggcauuaugauccugaaacuccugacggacuuucaaagccaucagcuuugggccacccugcucucccugacauucauucggaccacauuuagccugcacuaugcuuggaagaccauggccaugguccuuucuaucguuucccuguucccccucugucugagcacgacaucucagaaaaccaccuggcucccugugcugcuugggucccugggaugcaagccgcugacaauguuucucaucgcggagaauaagauuuggggccgcaaaagcuggccccugaacgaaggcaucauggccguggggauugucucuauccuucuguccagccuccugaagaacgaugugccucucgcuggaccccugauugccggcgggaugcuuaucgcuuguuacguuaucuccggaagcucugccgaccugagccuggagaaagccgcugagguguccugggaagaggaagcggagcauucuggcgccagccacaauauucucgucgaagugcaggaugacgggaccaugaagaucaaagaugaggagagagacgauacacugacgauucuucugaaggcuacccuccuggccguuuccggaguguauccucucucuauccccgccacacuguucgucugguacuucuggcagaagaagaagcagcggagcggcgugcuuugggacaccccuagcccucccgaagucgagcgcgcugugcuggaugacggcauuuauagaaucaugcagcgggggcugcucggacgcucucagguuggcgugggggucuuucaagaaaacguguuccauacaauguggcacguuaccagaggagccgugcugauguaccagggcaaacggcuugagcccagcugggcguccgucaagaaagaccugauuagcuacgggggaggcuggagacuccagggcucuuggaauacgggggaggaaguccaggugaucgcuguugagcccggaaagaacccuaaaaauguccaaaccgcccccggcacauuuaagaccuccgaaggggaggugggagccaucgcucuggauuucaagccgggcacaagcgggucuccuauugugaaccgcgaaggaaaaaucgucggccucuauggcaauggggugguuaccacauccggaacguacgugagcgccauugcgcaggcuaaggccucccaggagggcccccugccugagaucgaagacgaggucuuucggaaaagaaaccuuaccauuauggaucugcaccccgggucuggaaagacacgccgguaucugcccgccaucgugagagaagcuaucaaacgccggcucagaacccugauucuugccccuacccgcguuguggcuagcgagauggccgaagcgcugaagggcaugccgauccgguaccaaacaacggccgucaaguccgagcauaccgggaaagagauuguggaccucaugugccacgcuacauucaccaugagacugcugagccccguucgggugccuaauuauaacaugaucauuauggaugaagcccauuuuacagaccccucuuccaucgcugcccgcggcuacaucagcaccagagucggaaugggcgaggccgcugcgauuuucaugacggccacaccucccgggucuguggaggcuuuuccucagagcaaugccgugauccaggaugaggaacgggacauuccggagcgcuccuggaacucuggauaugaguggaucaccgauuuccccggcaagaccgucugguuuguuccuagcauuaaauccgggaaugacaucgccaacugucucagaaagaauggaaaacgggugauucagcuuucuagaaagacauucgauaccgaauaccaaaagaccaaaaacaacgacugggacuacguggucaccacggauaucagcgagaugggcgcuaauuuccgcgccgaccgggugaucgaucccagacgcugccugaagccuguuauucugaaagacgggcccgaacgggugauccucgcgggcccgaugccugucacaguggcuuccgccgcccagagacgcggacggauuggcagaaaccacaauaaggagggggaucaguauaucuacaugggacagccccugaacaaugacgaggaucaugcucacuggaccgaagccaaaaugcuucuggacaacauuaauacacccgagggcaucaucccugcgcucuuugaacccgagcgcgaaaagagcgccgcuauugauggggaguauagacugcggggagaggcccgcaagaccuucguugaacugaugagacggggcgaccucccuguguggcuuucuuacaaagucgcuuccgagggguuucaauauagcgaucgcagauggugcuucgacggcgaacggaacaaucaggugcuggaggaaaacauggaugucgagaucuggacgaaggagggagaacgcaaaaagcugcgcccgcgguggcucgacgccagaaccuacuccgacccccuggcucuuagagaguuuaaagaguucgccgcgggccggagaucugugagcggggaucugauucucgagaucggaaagcugccucagcaccugacacagcgggcccaaaaugcucucgacaaccuuguuaugcugcauaauuccgaacagggcgggcgcgccuauagacacgcuauggaggagcugcccgauaccauugaaacacucaugcugcuugcccugaucgccgugcucaccggaggcgugacacuguuuuuccugucuggccgggggcucggaaaaaccagcaucggccuucugugugucauggcuuccagcguucugcucuggauggcgucuguggagccucauuggauugccgcuuccaucauucuggaauuuuuccuuauggugcugcucauccccgagccggaccgccagagaacgccucaggauaaccaacuggccuacgucgugauugggcugcucuuuaugauccuuacaguugccgcuaaugagaugggacugcuggaaaccaccaagaaggaccucggcauugggcacguggccgucgagaaccaccaucacgcggccaugcuggauguggaccuucaucccgcuagcgccuggacacuguacgcugucgccaccacaaucaucacgccuaugaugcggcacaccauugaaaacacaaccgcgaauaucucucucacagccauugcuaaccaggccgcuauccugaugggacuggauaaaggcuggcccauuuccaagauggacaucggcgugccucuccuugcccuggggugcuauagccagguuaauccccugacccucacggcugccgugcugaugcuugucgcgcauuacgccaucauuggaccgggccugcaagcuaaagccacccgcgaggcucagaagagaacagccgccgggaucaugaaaaacccuaccguggauggaauuguugcgaucgaccucgaucccguggucuaugacgcuaaguucgaaaagcagcugggccagauuaugcugcucauccuuuguacaucucaaauccugcugaugcggaccacgugggcccucugcgagagcauuacacuggcuaccgggccccuuacaacccugugggagggauccccuggcaaauuuuggaauaccacaaucgccgugucuauggccaacauuuuccgcggcagcuaccucgcuggggccggacuggcguucucccugaugaagucccucggcgggggaagacggggcacgggggcccagggagaaacccuuggcgagaaauggaagagacagcugaaucagcuguccaaaucugaauuuaacacauauaagcgcagcggcaucauggagguggaccgguccgaagcuaaggaggggcucaaaagaggagagaccacaaagcacgccguuucucgcggcaccgcuaaacugcggugguucgucgaaagaaaucuugugaagccggaggggaaagugauugaucugggauguggccgcgggggauggagcuacuauugcgccggccucaagaaggucacggaaguuaaaggcuacacaaaagggggacccggccacgaggaaccuauccccauggcgaccuacggguggaaccuggugaaacugcauuccggaaaggacguguuuuucauuccucccgagaaaugugauacccuccuuugcgacaucggcgagucuagcccuaauccgacaaucgaagaggggcggacccugagaguccugaagaugguggaacccuggcuccgcggaaaccaauuuuguauuaaaauccugaauccuuauaugcccuccguuguggagacacuugagcagaugcagcggaagcacggcggcaugcuggucagaaacccucucagccgcaauucuacgcaugaaauguacuggguguccugcgggaccggaaacauuguuagcgccgugaauaugacaucucggaugcugcugaacagauucaccauggcucaccgcaagcccacauaugagagagaugucgaccucggcgccgggacccggcacguggcuguggaaccggaggucgccaaccuggauaucauuggacagcgcaucgaaaauaucaaacaugagcacaaguccacguggcauuacgacgaggauaacccuuauaaaaccugggcuuaccacggcagcuaugaaguuaagcccucuggguccgccagcuccauggugaauggaguggucaaacuucugacaaagcccugggacgugauuccuaugguuacccaaaucgcgaugacagauaccacacccuuuggccagcagagaguguucaaggagaaagucgacacccggacgccuaaggccaaaagaggcacagcucaaauuauggaagugaccgccaaguggcucuggggguuucugagccggaacaaaaagccgcgcaucuguaccagagaggaguucacacggaagguucgcucuaaugcugccauuggagccguguuugucgacgagaaccaguggaauagcgcgaaagaggcuguggaagaugagagauucugggaccuuguucaucgggaacgcgagcugcacaagcagggcaaaugcgccacgugcguguacaacaugauggggaagagagagaaaaagcucggagaguuuggcaaggccaaagggucccgggcuaucugguacauguggcugggcgcccgcuuccuggaguucgaagcucucggauuuaugaaugaggaucacugguucucuagagaaaacagccuguccggcgucgagggggagggacuucauaagcugggcuauauccuccgggacauuucuaaaauccccgggggaaauauguacgccgaugacaccgcgggcugggauacacgcauuaccgaagacgaucugcagaacgaggccaagaucacagacauuauggaaccugagcacgcccuucuggccaaaagcaucuuuaagcucaccuaucaaaauaaaguggucagagugcagcggcccgcuaagaacgggacaguuauggaugugaucucccgcagagaccagcggggcucuggacaggucggcaccuacgggcugaauacguucaccaacauggaagcccaacugauuagacagauggagagcgagggaaucuuuuccccuagcgaacucgagacacccaaccuggcgggccgcgugcuugauuggcuggaaaagcaugggguggagcggcucaaaagaauggccauuucuggagacgacuguguugugaagccgaucgaugaccgcuucgcuaccgcccugacagcucuuaaugauaugggcaaaguccggaaggacauuccucagugggaacccuccaaaggguggaacgauuggcagcaagugccuuuuugcagccaccacuuccaucagcugaucaugaaggacggcagagagauuguugugcccugucgcaaucaggaugagcucgucggacgggccagagugucucagggcgcuggguggucccugcgcgaaaccgccugccugggaaagagcuaugcgcaaauguggcagcucauguacuuucaccggagagaccugcgccuugccgcuaacgccaucuguuccgccgucccuguggauuggguucccacgucucggacaaccuggagcauccaugcucaccaucaguggaugacaaccgaggacaugcuguccguguggaauagagucuggauugaagagaacccguggauggaagauaaaacgcacgugagcucuuggggcgacguuccuuaucucgggaagcgggaggaccaauggugcggaucccugaucggccuuaccgccagagcgacaugggcuaccaauauucagguggccaucaaccagguccgccggcugcucgggaaugagaacuaccuggauuacaugacaagcaugaaaagauucaagaaugaaucugaccccgagggcgcccugugguga

SEQ ID NO: 19302 - RNA, 9879 nt, Artificial Sequence
  derived and/or modified CDS sequence (opt5) from DENV-1__EU482493__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaaacuucgcgauuccuacacccaggucugcgaccaccggcucaugagcgcggccauuaaagauucuaaggcuguucaugccgacaugggcuauuggaucgaauccgagaaaaaugaaacauggaagcuggccagagcuagcuucaucgaggugaagaccuguauuuggcccaaaucucacacacugugguccaacggggugcucgaaagcgagaugaucauuccgaagaucuacggaggcccuauuucucaacauaauuaucgccccggguacuucacccagacggccggaccuuggcaccugggcaaacuugagcuggauuuugaccucugcgaagggaccacagucgugguugaugagcacugcggaaaccggggccccagccugagaaccacaaccgugacgggcaagaucauccaugaaugguguugccgguccuguacacugccuccccuucgcuucagaggggaggacggaugcugguacggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuguuggacagcugaccuggaacgaucugaucagacuuugcauuauggugggcgccaaugccucugaccgcaugggcauggggaccacauaucuggcucucauggccacguucaagaugagaccuauguuugcggucggacugcuguuccggcgccugaccagcagagaggugcuucugcucacaaucggccugucccugguggcuucugucgaacuucccaacagccuggaggaacucggggauggacuggccaugggcaucaugauucucaaacugcuuaccgacuuucaaucccaccagcugugggccacacuccugagccugaccuucaucaagacgacauuuucucuucauuacgcuuggaaaaccauggccaugguucuguccguggugagccucuucccccugugucucucuaccacaucccagaagaccacauggcugccuguccuucuggggagccugggaugcaagccgcucacgauguuucugauugcugagaauaaaaucuggggccggcgcucuuggccccuuaacgaaggcauuauggccguggggaucguuuccauccugcucagcucccugcucaagaacgaugugccucuggcgggaccccuuauugccggcgggaugcugaucgcuuguuaugucauuagcggaucuagcgccgaccugucccucgagaaagcugccgaggugucuugggaagaggaagccgagcacagcggcgcuucccauaauauccugguugaagugcaggaugacgggaccaugaagauuaaagaugaggagagagacgauacacuuaccauccugcucaaggcgacacugcucgccgucucuggaguguacccucugagcauccccgcuacccuuuucgucugguauuucuggcagaagaagaagcagcgguccggcgugcugugggacacgccuucucccccggaaguugagcgcgccgugcuggaugacggcauuuacagaaucaugcagcgggggcuccugggacgcagccaggucggcguggggguuuuucaagaaaacguguuccacaccauguggcacgucacaagaggagccgugcuuauguaucagggcaaacggcuggagccuuccugggcuagcgugaagaaagaccucauuucuuacgggggaggcuggagacugcagggcuccuggaauaccggggaggaaguucaggucaucgccguggagcccggaaagaacccuaaaaaugugcaaacagcgcccggcaccuuuaagacaccggaaggggaggucggagcuauugcccucgauuucaagccuggcacgagcgggucucccaucgugaaccgcgaaggaaaaauuguuggccuguacggcaaugggguggucaccacauccggaaccuaugugagcgccaucgcucaggccaaggcgucccaggagggcccucuucccgagaucgaagacgagguuuuucggaaaagaaaccugaccauuauggaucugcaucccgggucuggaaagacacgccgguaccucccugcuaucgugagagaagccauuaaacgcaagcugcggacgcuuauccuggccccgaccagagucguggcuagcgagauggccgaagcucucaagggcaugcccauucgcuaucaaacaaccgccguuaaauccgagcacacagggaaggagaucguggaccugaugugccaugcgaccuucacgaugcggcugcucagcccugucagagugcccaauuacaacaugaucauuauggaugaagcccacuuuacagacccuucuuccaucgcugcccggggcuauauuagcacccgcgugggaaugggcgaggcugccgccaucuucaugaccgcuacacccccugggucugucgaagcguuuccgcagagcaaugccguuauucaggaugaggaaagagacauccccgagcgguccuggaacucuggauacgaguggaucaccgauuucccuggcaaaacagugugguuugugcccagcauuaaguccgggaaugacaucgcuaacugucuucgcaaaaauggaaagagagucauucagcugucucggaagaccuucgauacggaauaucagaagaccaagaacaacgacugggacuacgugguuaccacagauaucagcgagaugggcgccaauuucagagccgaccgcgugauugauccucggagaugccugaaacccgucauccucaaggacgggccggaacgcgugauucuggcuggcccuaugcccguuaccguggccuccgcggcucagcggagaggacgcaucggccggaaccauaauaaagagggggaucaguacaucuauaugggacagccccuuaacaaugacgaggaucacgcccacuggacggaagccaagaugcugcucgacaacauuaauaccccugagggcaucauucccgcucuguuugaaccugagagagaaaagagcgccgcgaucgauggggaguaccgccugagaggagaggcccggaaaacauucgucgaacucaugcgcagaggcgaccuuccgguguggcugucuuauaaggucgcuuccgagggguuucaauacagcgaucggcgcuggugcuucgacggcgaaagaaacaaucaggugcuggaggaaaacauggauguugagauuuggaccaaagagggagaacggaagaaacucagaccccgcuggcuggacgcccggacauauuccgacccucuugcucugagagaguuuaaggaguucgccgcuggccgccggucugugagcggggaucucauccuggagaucggaaaacugccccagcaucucacccagagagcccaaaaugcgcuugacaaccuggugaugcugcacaauuccgaacagggcgggcgggccuaccgccaugcuauggaggagcucccugauacaauugaaacccugaugcuucuggcccucaucgcuguccugacgggaggcguuacacuguuuuuccucucuggcagagggcuuggaaagaccagcauuggccugcugugugugauggccuccagcgugcuccuguggauggccucugucgagccccacuggaucgcugcguccauuauccuugaauuuuuccugauggugcuccugaucccggagccugaccggcagcgcacaccccaggauaaccaacuggccuauguugugauugggcuccuuuuuaugauccugacagucgcugccaaugagaugggacugcucgaaaccacaaagaaagaccugggcauugggcacguggccgucgagaaccaucaccaugcugccaugcuugauguggaccugcacccugcgagcgccuggacgcucuacgcuguugccaccacaaucauuacccccaugaugagacauacaaucgaaaacaccacggcuaauauuucucugaccgccaucgcgaaccaggccgcuauccugaugggacucgauaagggcuggccuauuuccaaaauggacaucggcgugccccuucuggcccuggggugcuacagccaggucaauccgcucacacugaccgcugccgugcuuaugcugguugcucacuaugccauuaucggaccuggccuccaagcgaaggccacacgggaggcucagaaacgcaccgccgcugggauuaugaagaaccccacgguggauggaaucgucgccaucgaccuggaucccgugguguacgacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaauugccguuucuauggcuaacaucuuccggggcagcuaucuggccggggccggacuggcuuucucccucaugaaaagccuuggcgggggacgcagaggcaccggggcccagggagaaacacugggcgagaaguggaaacggcagcugaaucagcucuccaagucugaauuuaacaccuacaagagaagcggcaucauggaggucgaccgcuccgaagcgaaagaggggcugaagcggggagagacgacaaaacacgccgugucuagaggcaccgcuaaacuucgcugguucguggaacggaaucuggucaaacccgaggggaagguuauugaucucggauguggcagagggggauggagcuauuacugcgccggccugaagaaagugaccgaagugaagggcuauacaaaagggggaccuggccaugaggaacccaucccuauggcuaccuacggguggaaccuggucaagcuccacuccggaaaagacguguuuuucauucccccugagaagugugauacacuucugugcgacaucggcgagucuagcccgaaucccacgauugaagaggggcgcacccugcggguucucaaaaugguggaaccuuggcugagaggaaaccaauuuuguaucaagauucuuaaucccuacaugccuuccgucguggagacacuggagcagaugcagcgcaagcauggcggcaugcucguucggaacccccugagcagaaauucuacccacgaaauguauuggguguccugcgggacaggaaacaucgucagcgccgugaauaugaccucucgcaugcugcucaaccgguucacgauggcgcacagaaaaccgaccuacgagcgcgauguggaccugggcgccgggacaagacaugucgcuguugaaccugagguggccaaccuugauaucauuggacagcggaucgaaaauauuaagcacgagcauaaauccaccuggcacuaugacgaggauaaccccuacaagacaugggcuuaucauggcagcuacgaagugaaacccucuggguccgccagcuccauggucaauggagugguuaagcugcucaccaagccuugggacgugauccccauggucacacaaauugcuaugaccgauacgacaccuuuuggccagcagcgcguguucaaagagaagguugacaccagaaccccgaaagccaagcggggcacagcgcaaaucauggaagugacggccaaauggcuguggggguuucuuagcagaaacaagaagccccggaucuguacccgcgaggaguucacaagaaaaguccggucuaaugcugccauuggagcuguguuuguugacgagaaccaguggaauagcgccaaggaggccguggaagaugagcgcuucugggaccugguccacagagaacgggagcuccacaaacagggcaagugcgcgaccugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcgucgagggggagggacugcacaaacucggcuacauucugagagacaucucuaagauuccugggggaaauauguaugccgaugacacagcuggcugggauacccggaucacagaagacgaucuucagaacgaggcccgcaucaccgacauuauggaacccgagcaugcgcugcucgccaaaagcaucuuuaagcugacguaccaaaauaaagugguuagagugcagcggccugcuaagaacgggaccgucauggaugugauuucccgcagagaccagcggggcucuggacaggugggcacauaugggcugaauaccuucacaaacauggaagcccaacucaucagacagauggagagcgagggaaucuuuucccccagcgaacuggagaccccgaaccuugcugaacgcguucuggauuggcucgagaaguacggcguggaacggcugaaaagaauggccaucucuggggacgacugugucgugaagccuaucgaugaccgcuucgcgacggcccuuacagcucugaaugauaugggaaaaguucggaaggacauuccccagugggagccuuccaaaggcuggaacgauuggcagcaagugcccuuuugcagccaccacuuccaucagcucaucaugaaggacgggagagagauugucgugccuugucgcaaucaggaugaacuggucggccgggccagagugucucagggagcuggcuggucccugcgcgagaccgccugccucggaaagagcuaugcucaaauguggcagcugauguacuuucaccggagagaccuucgccuggccgcgaacgccaucuguuccgcuguucccguggauuggauuccgacaucucggaccacguggagcauccaugcccaccaucaguggaugaccacagaagacaugcucuccgucuggaauagaguguggauugaggaaaacccuuggauggaggauaaaacccacaucagcucuuggggagacguucccuaucugggcaagcgggaggaccaauggugcgggucccuuaucggacugacagccagagcuaccugggccacaaauauucagguggcgaucaaccagguccgccggcucauuggcaaugaaaacuaccuggauuacaugaccagcaugaaaagauucaagaaugagucugaccccgaaggggcucugugguga

SEQ ID NO: 19303 - RNA, 9879 nt, Artificial Sequence
  derived and/or modified CDS sequence (opt5) from DENV-1__EU482494__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauacaaucaccuacaaaugccccagaauuacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauccagcggguugaaaccugggcccugcgccaccccggcuucacagugauugcucuuuuucuggcccaugcgaucgggaccucuaucacccagaagggaauuaucuucauucuccugaugcuugccacaccuagcauggcuaugagaugcgucggcaucgggucccgggauuuuguggagggacugagcggcgccacguggguugacgugguccucgagcacgggucuugugugaccacaauggcuaaggauaaacccacccuggacauugaacugcucaagacagaggugaccaacccugccguccugcgcaaacuuugcaucgaagcgaagauuuccaauacgacaaccgauagcagauguccgacccaaggagaggccacacugguugaagaacaggacgcuaacuucgugugccggcgcaccuuuguggauagaggcuggggcaauggguguggacucuucggcaaagggucucugaucacaugcgccaaguuuaagugcgucacgaaacuugagggaaagaucgugcaguacgaaaaccugaaauauuccguuauugugaccguccacacaggcgaccagcaucaaguggggaaugagagcaccgaacacggaacaaccgcuacgaucacaccccaggccccuacaaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggcuuccacaucucaagagaccuggaaucgccaggaccugcucgucaccuucaaaacagcgcacgccaagaagcaggaaguggucgugcugggaagccaagagggcgcuaugcacacggcccugaccggggccacagaaauccagaccuccggaacaaccacgauuuuugcuggccaucucaaaugcagacugaagauggauaaacuuacacugcgggggaugagcuauguuauguguaccggcucuuucaagcucgagaaagaaguggccgagacccagcacggaacaguccuggugcagaucaaguacgagggcaccgacgcgccgugcaagaucccuuucuccacacaagaugaaaaagggguuacgcagaacggaagacugauuaccgcuaaucccaucgugacagacaaggagaaaccugucaacauugaagccgagccgcccuuuggcgagagcuauaucgugauuggggccggagaaaaggcucuuaaacucucuugguucaagaagggcagcuccaucgggaaaauguuugaggccaccgcucgcggcgcccggagaauggcgauccugggagauacagccugggacuucggcucuauugggggaguguuuaccagcguuggcaagcugguccaucagaucuucgggacggcuuacggagugcucuuuuccggcgugagcuggaccaugaaaauugggaucggcguccugcuuacauggcugggacucaauucucgcuccaccagccugucuaugacauguauugccgugggccugguuacccuuuaccucggggugaugguccaggcugauuccggaugcgugaucaacuggaagggccgggaacugaaaugugggagcggaauuuucguuacaaaugaggugcacaccuggacggaacaauauaaguuucaggccgacuccccuaagagacugucugcggccaucggcaaggcuugggaggagggggucugcggcauccgcagcgccacacggcucgaaaacauuauguggaagcagaucuccaacgagcugaaucauauucuucuggaaaacgacaugaaauucaccgugguugugggagaugucgcuggcauccucgcccaggggaagaaaaugauuagaccgcaacccauggagcacaaguacucuuggaaaagcuggggaaaggccaagaucaucggcgcugacgugcagaauaccacauuuauuaucgaugggccuaacacccccgaauguccugacgaucagcgcgcguggaauauuugggagguggaggacuauggauucggcaucuuuacgacaaacauuuggcugaaacugcgggauuccuacacccaggucugcgaccacagacuuaugagcgccgcuaucaaggauucuaaagccguucaugccgacaugggcuauuggaucgaauccgagaagaaugaaacauggaaacucgcucgcgccagcuucauugaggugaagaccuguaucuggcccaagucucacacacugugguccaacggggugcuggaaagcgagaugauuaucccgaaaauuuacggaggcccuaucucucaacauaauuaucggcccggguacuucacccagacggcgggaccuuggcaccucggcaagcuggagcuugauuuugaccugugcgaagggaccacagucgugguugaugagcacugcggaaacagaggccccagccuccggaccacaaccgugacgggcaaaaucauucaugaaugguguugccgcuccuguacacugccuccccugagauucagaggggaagacggaugcugguacggcauggagauccggccggucaaggaaaaagaggaaaaucuugugaaaagcaugguuucugcuggguccggagagguggacagcuuuucccucggccugcuguguauuucuaucaugauugaagaggucaugcgcagccggugguccagaaagaugcucaugaccgggacacuggccguguucuuucuucugaucaugggacagcucaccuggaacgaucugauucgccugugcaucaugguuggcgccaaugcuucugacagaaugggcauggggaccacauaucuugcccugauggcgacguucaaaaugcggccuauguuugcugugggacuccuguuccgcagacucaccagccgggagguccugcuucugacaaucggccucucccugguggccucuguggaacugcccaacagccuugaggaacugggggauggacucgccaugggcauuaugauccugaagcuccugaccgacuuucaaucccaccagcuuugggcuacacugcucagccugaccuucauuaaaacgacauuuucucugcauuacgccuggaagaccauggcuaugguccuuuccaucguuagccuguucccccucugucugucuaccacaucccagaaaaccacauggcucccugugcugcuugggagccugggaugcaagccgcugacgauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuauguuauuagcggaucuagcgcugaccugucccuggagaaggccgccgaggugucuugggaagaggaagcugagcacagcggcgcgucccauaauauccucgucgaagugcaggaugacgggaccaugaaaaucaaggaugaggagcgggacgauacacugaccauucuucugaaagccacacuccuggcuguuucuggaguguacccucucagcauccccgccacccuguucgucugguauuucuggcaaaagaaaaagcagcgcuccggcgugcuuugggacacgccuucucccccggaagucgagagagccgugcuggaugacggcauuuaccggaucaugcagcgcgggcugcucggaagaagccagguuggcgugggggucuuucaagaaaacguguuccacaccauguggcacguuacacggggagcugugcugauguaucagggcaagagacuugagccuuccugggccagcgucaaaaaggaccugauuucuuacgggggaggcuggcgccuccagggcuccuggaauaccggggaggaaguccaggugaucgcgguugagcccggcaagaacccuaagaauguccaaacagcucccggcaccuuuaaaacaccggaaggggaggugggagccauugcccuggauuucaagccuggcacgagcgggucucccaucgugaaccgggaaggaaagaucgucggccucuacggcaauggggugguuaccacauccggaaccuaugugagcgcuauugcccaggcgaaggcuucccaggagggcccucugcccgagaucgaagacgaggucuuuagaaagcgcaaccuuaccauuauggaucugcaucccgggucuggaaaaacacggagauaccugccugccaucgugcgcgaagccauuaagcggaaacucagaacgcugauccuugcuccgacccgcguuguggccagcgagauggcugaagcccugaagggcaugcccauccgguaucaaacaaccgcggucaaguccgagcacacagggaaagagauuguggaccucaugugccaugccaccuucacgaugagacugcugagcccuguucgggugcccaauuacaacaugaucauuauggaugaagcucacuuuacagacccuucuuccaucgccgcucgcggcuauauuagcaccagagucggaaugggcgaggccgccgcuaucuucaugaccgcgacacccccugggucuguggaagccuuuccgcagagcaaugcugugauccaggaugaggaacgggacauucccgagcgcuccuggaacucuggauacgaguggaucaccgauuucccuggcaagacagucugguuuguucccagcauuaaauccgggaaugacaucgccaacugucucagaaagaauggaaaacgggugauucagcuuucuagaaagaccuucgauacggaauaucaaaagaccaaaaacaacgacugggacuacguggucaccacagauaucagcgagaugggcgccaauuuccgcgcugaccgggugauugauccuagacgcugccugaagcccguuauccugaaagacgggccggaacgggugauccucgccggcccuaugcccgucaccguggcguccgcugcccagagacgcggacggauuggcagaaaccauaauaaggagggggaucaguacaucuauaugggacagccccugaacaaugacgaggaucacgcccacuggacggaagcuaaaaugcuucuggacaacauuaauaccccugagggcaucauucccgcccucuuugaaccugagcgcgaaaagagcgcggccaucgauggggaguacagacugcggggagaggcucgcaagacauucguugaacugaugagacggggcgaccucccgguguggcuuucuuauaaagucgccuccgagggguuucaauacagcgaucgcagauggugcuucgacggcgaacggaacaaucaggugcuggaggaaaacauggaugucgagaucuggaccaaggagggagaacgcaaaaagcugcgcccccgguggcucgacgcuagaacauauuccgacccucuggcccuucgcgaguuuaaagaguucgcugccggccggagaucugugagcggggaucugauucucgagaucggaaagcugccccagcaucugacccagcgggcgcaaaaugcccucgacaaccuuguuaugcugcacaauuccgaacagggcgggcgcgcuuacagacaugccauggaggagcugccugauacaauugaaacccucaugcugcuugcucugaucgccgugcucacgggaggcgugacacuguuuuuccugucuggccgggggcucggaaaaaccagcauuggccuucugugugucauggccuccagcguucugcucuggauggcuucuguggagccccacuggaucgcggccuccaucauucuggaauuuuuccuuauggugcugcucaucccggagccugaccgccagagaacaccccaggauaaccaacuggcuuaugucgugauugggcugcucuuuaugauccuuacaguugccgccaaugagaugggacugcuggaaaccacaaagaaggaccucggcauugggcacguggcugucgagaaccaucaccaugccgcgaugcuggauguggaccuucacccugccagcgcuuggacgcuguacgccgucgcuaccacaaucauuacccccaugaugcggcauacaaucgaaaacaccacggccaauaucucucucaccgcgauugccaaccaggcugccauccugaugggacuggauaaaggcuggccuauuuccaagauggacaucggcgugccccuccuugcucuggggugcuacagccagguuaauccgcugacacucaccgccgcugugcugaugcuugucgcccacuaugcgauuaucggaccuggccugcaagccaaagcuacacgcgaggcccagaagagaaccgcugccgggaucaugaaaaaccccacgguggauggaauuguugccaucgaccucgaucccguggucuacgacgcgaaguucgaaaagcagcugggccagauuaugcugcucauccuuuguacaucucaaauucugcugaugcggaccacaugggcucucugcgagagcaucacccuggccaccgggccucuuacaacgcugugggagggauccccgggcaaauuuuggaauaccacaaucgcugugucuauggccaacauuuuccgcggcagcuaucucgccggggcuggacuggccuucucccugaugaaaagccucggcgggggaagacggggcaccggggcgcagggagaaacacuuggcgagaaauggaagagacagcugaaucagcuguccaaaucugaauuuaacaccuacaagcgcagcggcaucauggagguggaccgguccgaagccaaggaggggcucaaaagaggagagacgacaaagcacgcuguuucucgcggcaccgccaaacugcggugguucgucgaaagaaaucuugugaagcccgaggggaaagugauugaucugggauguggccgcgggggauggagcuauuacugcgcuggccucaagaaggucaccgaaguuaaaggcuauacaaaaggcgggccugggcaugaggaacccaucccuauggccaccuacggguggaaccuggugaaacugcacuccggaaaggacguguuuuucauucccccugagaaaugugauacacuccuuugcgacaucggcgagucuagcccgaaucccacgauugaagaggggcggacccugagaguccugaagaugguggaaccuuggcuccgcggaaaccaauuuuguaucaaaauccugaaucccuacaugccuuccguuguggagacacuugagcagaugcagcggaagcauggcggcaugcuggucagaaacccccucagccgcaauucuacccacgaaauguauuggguguccugcgggacaggaaacauuguuagcgcggugaauaugaccucucggaugcugcugaacagauucacgauggcccaccgcaagccgaccuacgagagagaugucgaccucggcgcugggacacggcauguggccguggaaccugaggucgcuaaccuggauaucauuggacagcgcaucgaaaauauuaaacacgagcauaaguccaccuggcacuaugacgaggauaaccccuacaaaacaugggccuaucauggcagcuacgaaguuaagcccucuggguccgcuagcuccauggugaauggaguggucaaacuucugaccaagccuugggacgugauccccaugguuacacaaaucgccaugaccgauacgacaccuuuuggccagcagagaguguucaaggagaaagucgacacccggaccccgaaggcgaaaagaggcacagcccaaauuauggaagugacggcuaaguggcucuggggguuucugagccggaacaaaaagccccgcaucuguaccagagaggaguucacacggaagguucgcucuaaugccgcuauuggagccguguuugucgacgagaaccaguggaauagcgccaaagaggcgguggaagaugagagauucugggaccuuguucaccgggaacgcgagcugcacaagcagggcaaaugcgcuaccugcguguauaacaugauggggaagagagagaaaaagcucggagaguuuggcaaggccaaagggucccgggccaucugguacauguggcugggcgcucgcuuccuggaguucgaagcccucggauuuaugaaugaggaucauugguucucuagagaaaacagccuguccggcgucgagggggagggacuucacaagcugggcuacauucuccgggacaucucuaaaaucccugggggaaauauguaugcugaugacacagccggcugggauacccgcauuacagaagacgaucugcagaacgaggcgagaaucaccgacauuauggaacccgagcaugcccuucuggcuaagagcaucuuuaaacucacguaccaaaauaaggugguccgggugcagcgcccugccaaaaacgggaccguuauggaugugauuuccagacgggaccagagaggcucuggacaggucggcacauaugggcugaauaccuucacaaacauggaagcucaacugauccgccagauggagagcgagggaaucuuuucccccagcgaacucgagaccccgaaccuggccgaacgggugcuugauuggcuggagaaguacggcguggaaagacucaagcgcauggcgauuucuggggacgacuguguugugaaaccuaucgaugaccgguucgccacggcucugacagcccuuaaugauaugggaaaggucagaaaagacauuccccagugggagccuuccaagggcuggaacgauuggcagcaagugcccuuuugcagccaccacuuccaucagcugaucaugaaagacgggcgcgagauuguugugccuugucggaaucaggaugaacucgucggcagagcucgcgugucucagggagccggcuggucccugcgggagaccgcuugccugggaaagagcuaugcccaaauguggcagcucauguacuuucacagacgcgaccugcggcuugcggccaacgcuaucuguuccgccguccccguggauuggauuccgacaucuagaaccacguggagcauccaugcccaccaucaguggaugaccacagaagacaugcuguccguuuggaaucggguguggaucgaggaaaacccuuggauggaggauaagacccacauuagcucuuggggagacguccccuaucucggcaaaagagaggaccaauggugcgggucccugaucggacuuacagcucgcgccaccugggcgacaaauauucagguggcuaucaaccagguucggagacugauuggcaaugaaaacuaccucgauuacaugaccagcaugaagcgcuucaaaaaugagucugaccccgaaggggcccugugguga

SEQ ID NO: 19304 - RNA, 9879 nt, Artificial Sequence
  derived and/or modified CDS sequence (opt5) from DENV-1__EU482495__SS-prME
agcgugaccaugcugcugaugcugaugcccaccgcccuugcuuuccaccugacgaccagaggcggggaaccucauaugaucgucuccaagcaggaacggggaaagucucuccuguuuaagacgagcgccggcguuaauaugugcacccuuauugcgauggaccugggggaacucugugaagauacaaugaccuacaagugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaagagcuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggccucuucaagcuggagaaggaaguggcugagacacagcacggaaccguucuggugcagauuaaauacgagggcaccgacgccccgugcaagaucccuuucuccacacaagaugaaaaaggggucacccagaacggaagacuuaucacagcgaaucccauugugacggacaaggagaaaccugugaacaucgaagcugagccgcccuuuggcgagagcuauauuguuaucggggccggagaaaaggcccucaagcugucuugguucaaaaagggcagcuccauugggaaaauguuugaggcuaccgcccggggcgcuagacgcauggccauccugggagauacagcgugggacuucggcucuaucgggggagucuuuaccagcgugggcaagcucgugcaucagauuuucgggacagccuacggaguccuguuuuccggcgugagcuggaccaugaaaaucgggauuggcguucuucugacguggcucggacucaauucucgguccaccagccugucuaugacauguaucgcugugggccuugucacccucuaccugggggugaugguucaggccgauuccggaugcgugauuaacuggaagggcagagaacugaagugugggagcggaaucuucgucacaaaugaggugcacaccuggacagaacaauauaaauuucaggcugacuccccuaagcgccucucugccgcgauuggcaaagccugggaggaggggguuugcggcauccggagcgcuaccagacuggaaaacaucauguggcgccagauuuccaacgagcuuaaucauauccugcucgaaaacgacaugaaguucacgguggucgugggagauguggucggcauucuggcccaggggaaaaagaugauccggccgcaacccauggagcacaaauacucuuggaaaagcuggggaaaggcuaagauuaucggcgccgacguucagaauacaaccuuuaucauugaugggccuaacacccccgaauguccugacgaucagagagccuggaauaucugggagguggaggacuauggauucggcauuuuuacaaccaacaucuggcugaaacuucgcgauuccuacacacaggugugcgaccaccggcucaugagcgcugcgauuaaagauucuaaggccguccaugcugacaugggcuauuggaucgaauccgagaaaaaugaaacauggaagcuggccagagccagcuucaucgaggugaagaccuguauuuggcccaaaucucacacacugugguccaacgggguucucgaaagcgagaugaucauuccgaagaucuacggaggcccuauuucucaacauaauuaucgccccggguacuucacccagacagcuggaccuuggcaccugggcaaacuugagcuggauuuugaccucugcgaagggaccacgguggucguggaugagcacugcggaaaccggggccccagccugagaaccacaaccguuacaggcaagaucauccaugaaugguguugccgguccuguacccugccuccccuucgcuucaaaggggaggacggaugcugguacggcauggagauuagaccggugaaggaaaaggaggaaaaucucgucaaaagcauggugucugccggguccggagagguugacagcuuuucccugggccugcucuguaucucuauuaugaucgaagaggugaugcggagcagauggucccgcaagaugcugaugacggggacacuugcggucuucuuucugcucauuaugggacagcugaccuggaacgaucugauccggucuugcauuauggugggcgcuaaugccagcgacagaaugggcauggggacaaccuaucuugcccugauggcuaccuucaaaaugcgcccuauguuugccgugggacuccuguucagacggcucacaucccgcgagguccugcuucugacgaucggccucucucugguugcgagcguggaacugcccaacucccuugaggaacugggggauggacucgcuaugggcaucaugauucugaagcuccugaccgacuuucaaagcuaccagcuuugggccacacugcucucucugaccuucaucaaaacaaccuuuucccugcacuaugccuggaagacgauggcuauggugcuuagcauugucucucugcucccccugugucucuccacaaccagccagaagaccacauggcugccugugcuucuggggucucugggaugcaaaccgcucaccauguuccugaucgccgagaauaagauuuggggcagaaaauccuggccccuuaacgaaggcaucauggcuguugggaucgugagcauucugcucuccagccugcucaagaacgaugucccucuggccggaccccuuaucgcgggcgggaugcugauugccuguuacgugaucucuggaagcuccgcugaccugucucucgagaaagccgcugagguuagcugggaagaggaagccgagcauuccggcgccucucacaauauucugguggaaguccaggaugacgggacaaugaagaucaaagaugaggagcgggacgauacgcuuaccauccugcucaaggcuacacugcucgcggugagcggagucuauccucuguccauucccgccacccuuuuugugugguacuucuggcaaaagaaaaagcagcgcucuggcguucugugggacacaccuagcccucccgaaguggagagagcuguccuggaugacggcaucuaucggauuaugcagcgcgggcuccugggaagaucccaggugggcguugggguguuccaagaaaacgucuuucauaccauguggcacgugacgcggggagccgugcuuauguaccagggcaaacgccuggagcccagcugggccucuguuaagaaagaccucaucuccuacgggggaggcuggagacugcagggcagcuggaauaccggggaggaaguccaggugauugcuguggagcccggaaagaacccuaagaauguccaaacagcccccggcaccuucaaaacaccggaaggggaggugggagcgaucgcucucgauuuuaagccuggcaccucugggucccccauuguuaaccgggaaggaaaaaucgugggccuguauggcaauggggucgugacaacgagcggaaccuacguuuccgccaucgcccaggcuaaggccucucaggagggcccucuucccgagauugaagacgagguguucagaaaacgcaaccugacaaucauggaucugcaccccgggagcggaaagacccggagauaucucccugcgauuguccgcgaagcuaucaagcggaaacugagaacccuuauucuggccccgacacgcgugguugccuccgagauggcugaagcccucaagggcaugcccauccgguaccaaacgaccgcugugaaaagcgagcauacagggagagagaucgucgaccugaugugccacgccaccuuuacaaugcgccugcucucuccugugcgggugcccaauuauaacaugauuaucauggaugaagcgcauuucaccgacccuuccagcauugccgcuagaggcuacaucucuacgcgggucggaaugggcgaggccgcugccauuuuuaugacagccacacccccugggagcguugaggcuuucccgcaguccaaugcggugauccaggaugaggaacgcgacauccccgagagaucuuggaacagcggauaugaguggauuaccgauuuuccuggcaagacagugugguucguccccuccaucaaaucugggaaugacauugccaacugucuucggaagaauggaaagcgcgugauccagcugagcagaaaaaccuuugauacagaauaccaaaagaccaaaaacaacgacugggacuacguugugacgacagauauuuccgagaugggcgcuaauuuccgggccgacagagucaucgauccucgccggugccugaagcccgugauucucaaagacgggccggaaagaguuauccuggccggcccuaugcccgugaccgucgcuagcgccgcgcagcgccggggaagaaucggccgcaaccacaauaaggagggggaucaguauauuuacaugggacagccccuuaacaaugacgaggaucaugcucacuggacagaagccaagaugcugcucgacaacaucaauaccccugagggcauuauccccgcccuguucgaaccugagcgggaaaaaucugcugccauugauggggaguauagacugcgcggagaggcgagaaagacguuuguggaacucaugcggcgcggcgaccuuccggucuggcuguccuacaaaguggccagcgagggguuccaauauuccgauagacgguggugcuuugacggcgaacgcaacaaucagguucuggaggaaaacauggauguggagaucuggaccaaggagggagaacgcaagaagcuccggcccagauggcuggacgcucgcacauacucugacccucuugcccugcgggaguucaaagaauuugcugccggcagacgcagcguguccggggaucucauccuggagauuggaaagcugccccagcaccucacccagcgggcucaaaaugcccuugacaaccuggucaugcugcauaauucugaacagggcgggagagcguaucggcacgccauggaggagcucccugauacaaucgaaacccugaugcuucuggcucucauugccguucugacaggaggcgugacccuguucuuucucagcggccgcgggcuuggaaagacguccaucggccugcugugugugauggcuagcucugcccuccuguggauggccuccgucgagccccauuggauugcugcgagcaucauccuugaguucuuucugauggugcuccugauuccggagccugacagacagcggacaccccaggauaaccaacuggccuacguugugaucgggcuccuuuucaugauucugaccgucgcugccaaugagaugggacugcucgaaaccaccaagaaggaccugggcaucgggcacguggccgucgagaaccaccaucacgcuaccaugcuugauauugaccugcauccugccucugcguggacacucuacgccguggcuacgaccaucauuacacccaugaugcgccacaccaucgaaaacacaaccgccaauaucucccugacggcuauugccaaccaggcggccauccugaugggacucgauaaaggcuggccuauuagcaagauggacaucggcguuccccuucuggcucuggggugcuauucucaggugaauccgcucacccugacagccgcuguccuuaugcugguggcccauuacgcuauuaucggaccuggccuccaagccaaagcgaccagagaggcccagaagcggacagcugccgggaucaugaagaaccccaccguugauggaauuguggcuaucgaccuggaucccgucguguaugacgccaaauuugaaaagcagcugggccagauuaugcuccuuauccuguguacgagccaaauucugcucaugcgcacaaccugggcccugugcgaguccaucacacuugcgaccgggccucugaccacacucugggagggaucuccgggcaaauucuggaauacgaccaucgcugugagcauggccaacauuuuuagaggcuccuaccuggcuggggccggacuggccuucagccucaugaagucccuuggcgggggacggcgcggcacaggggcucagggagaaacccugggcgagaaauggaagagacagcugaaucagcucucuaagagcgaguucaacacauauaaacgguccggcaucauggagguugacagaucugaagccaaggaggggcugcgccggggagagaccacgaaacacgcggucagcagaggcacagccaaacuucgcugguuuguggaacggaaucuggugaaacccgaggggaaggucauugaucucggauguggcagagggggaugguccuacuauugcgcuggccugaagaaaguuaccgaagugaagggcuacaccaaagggggaccuggccacgaggaacccaucccuauggccacauacggguggaaccuggugaagcuccauucuggaaaagacgucuucuuuauucccccugagaagugugauacccuucugugcgacaucggcgagagcuccccgaaucccacaauugaagaggggcgcacgcugcgggugcucaaaaugguugaaccuuggcugagaggaaaccaauucuguaucaagauccuuaaucccuauaugccuagcguggucgagacccuggagcagaugcagcgcaagcacggcggcaugcucgugcggaacccccugucuagaaauuccacacaugaaauguacuggguuagcugcgggaccggaaacauugugucugcugucaauaugacaucccgcaugcugcucaaccgguuuaccauggcccacagaaaaccgacguaugagcgcgauguggaccugggcgcggggaccagacacguggccgucgaaccugagguugcuaaccuugauaucauuggacagcggaucgaaaauauuaagcaugagcacaaaagcacauggcauuacgacgaggauaaccccuauaagaccugggccuaccacggcucuuaugaagugaaacccuccgggagcgcuuccagcauggugaauggagucgugaagcugcucacaaagccuugggacguuauccccauggugacccaaaucgccaugacagauaccacgccuuucggccagcagcgcgucuuuaaagagaagguggacacaagaaccccgaaagcuaagcggggcaccgcccaaauuauggaaguuacagcgagauggcuguggggguuccuuucucggaacaaaaagccccgcaucuguacgagagaggaauuuacccggaaggugcgcagcaaugccgcuauuggagccgucuucguggacgagaaccaguggaacuccgcuaaagaggccguugaagaugagagauuuugggaccuggugcaucgggaacgcgagcuccacaagcagggcaaaugcgccacaugcgucuacaacaugauggggaagagagagaagaagcugggagaguucggcaaggcgaaagggucucgggcuaucugguacauguggcugggcgcccgcuuucucgaguucgaagcccugggauucaugaaugaggaucacugguuuagcagagaaaacucccuuucuggcguggagggggagggacugcauaagcucggcuauauucugcgggacaucagcaaaaucccugggggaaauauguacgcugaugacaccgccggcugggauacacgcauuaccgaagacgaucuucagaacgaggcuaagaucacagacauuauggaacccgagcacgcccugcucgcgaccuccaucuucaaacugacguaucaaaauaaggucgugagaguucagcggccugcccgcaacgggaccgugauggaugucauuucuagacgggaccagagaggcagcggacaggugggcacauacgggcugaauaccuuuacaaacauggaagcucaacucauccgccagauggaguccgagggaaucuucagccccucugaacuggagaccccgaaccuugccgaacgggugcuggauuggcucgagaaacauggcguugaaagacugaagcgcauggcuauuuccggggacgacuguguggucaagccuaucgaugaccgguuugccacggcgcuuagcgcccugaaugauaugggaaaagugagaaaggacauuccccagugggagccuucuaaaggcuggaacgauuggcagcaaguucccuucugcucccaccacuuucaucagcucaucaugaaggacgggcgcgagauuguggucccuugucggaaucaggaugaacuggugggcagagcucgcgucagccagggagccggcuggucccugcgggagacagcuugccucgggaaaucuuaugcccaaauguggcagcugauguacuuccacagacgcgaccuucggcuggcugccaacgcgaucuguagcgccgugcccguugauugggugccgaccuccagaacaaccuggagcauucaugcucaccaucaguggaugacgaccgaagacaugcucucugucuggaaucggguguggaucgaggaaaacccuuggauggaggauaagacacacaucuccagcuggggagacguucccuaucugggcaagagagaggaccaauggugcgggucucuuauuggacugaccgcccgcgccacaugggcuaccaauauccagguggccauuaaccagguccggagacucaucggcaaugaaaacuaccuggauuacaugacaagcaugaaacgcuuuaagaaugacuccgaucccgagggggcgcugugguga

SEQ ID NO: 19305 - RNA, 9879 nt, Artificial Sequence
  derived and/or modified CDS sequence (opt5) from DENV-1__EU482496__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaccuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaucagcuuugggccacacugcucagccugaccuucauuaagacgacauuuucucugcacuaugcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuacguuauuagcggaucuagcgccgaccugucccuggagaaagcugccgaggugucuugggaagaggaagccgagcauagcggcgcuucccacaauauccucgucgaagugcaggaugacgggaccaugaagaucaaagaugaggagagagacgauacacugaccauucuucugaaggcgacacuccuggccguuucuggaguguauccucucagcauccccgcuacccuguucgucugguacuucuggcagaagaagaagcagcgguccggcgugcuuugggacacgccuucucccccggaagucgagcgcgccgugcuggaugacggcauuuauagaaucaugcagcgggggcugcucggacgcagccagguuggcgugggggucuuucaagaaaacguguuccauaccauguggcacguuacaagaggagccgugcugauguaccagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuauggcaauggggugguuaccacauccggaaccuacgugagcgccauugcucaggccaaggcgucccaggagggcccucugcccgagaucgaagacgaggucuuucggaaaagaaaccuuaccauuauggaucugcaccccgggucuggaaagacacgccgguaucugccugcuaucgugagagaagccauuaaacgcaagcuccggacgcugauccuugccccgaccagaguuguggcuagcgagauggccgaagcucugaagggcaugcccauccgcuaccaaacaaccgccgucaaauccgagcauacagggaaggagauuguggaccucaugugccacgcgaccuucacgaugcggcugcugagcccuguuagagugcccaauuauaacaugaucauuauggaugaagcccauuuuacagacccuucuuccaucgcugcccggggcuacauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauaugaguggaucaccgauuucccuggcaaaacagucugguuuguucccagcauuaaguccgggaaugacaucgcuaacugucuccgcaaaaauggaaagagagugauucagcuuucucggaagaccuucgauacggaauaccagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccacaauaaagagggggaucaguauaucuacaugggacagccccugaacaaugacgaggaucaugcccacuggacggaagccaagaugcuucuggacaacauuaauaccccugagggcaucauucccgcucucuuugaaccugagagagaaaagagcgccgcgaucgauggggaguaucgccugagaggagaggcccggaaaacauucguugaacugaugcgcagaggcgaccucccgguguggcuuucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacugagaccccgcuggcucgacgcccggacauacuccgacccucuggcucuuagagaguuuaaggaguucgccgcuggccgccggucugugagcggggaucugauucucgagaucggaaaacugccccagcaccugacccagagagcccaaaaugcgcucgacaaccuuguuaugcugcauaauuccgaacagggcgggcgggccuaucgccacgcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccauuggaucgcugcguccaucauucuggaauuuuuccuuauggugcugcucaucccggagccugaccggcagcgcacaccccaggauaaccaacuggccuacgucgugauugggcugcucuuuaugauccuuacaguugcugccaaugagaugggacugcuggaaaccacaaagaaagaccucggcauugggcacguggccgucgagaaccaccaucacgcugccaugcuggauguggaccuucauccugcgagcgccuggacgcuguacgcugucgccaccacaaucauuacccccaugaugagacacacaaucgaaaacaccacggcuaauaucucucucaccgccauugcgaaccaggccgcuauccugaugggacuggauaagggcuggccuauuuccaaaauggacaucggcgugccccuccuugcccuggggugcuauagccagguuaauccgcugacacucaccgcugccgugcugaugcuugucgcucauuacgccauuaucggaccuggccugcaagcgaaggccacacgggaggcucagaaacgcaccgccgcugggaucaugaagaaccccacgguggauggaauuguugccaucgaccucgaucccguggucuaugacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuacuauugcgccggccucaagaaagucaccgaaguuaagggcuacacaaaagggggaccuggccacgaggaacccaucccuauggcuaccuacggguggaaccuggugaagcugcauuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuauaugccuuccguuguggagacacuugagcagaugcagcgcaagcacggcggcaugcugguccggaacccccucagcagaaauucuacccaugaaauguacuggguguccugcgggacaggaaacauuguuagcgccgugaauaugaccucucgcaugcugcugaaccgguucacgauggcgcacagaaaaccgaccuaugagcgcgaugucgaccucggcgccgggacaagacacguggcuguggaaccugaggucgccaaccuggauaucauuggacagcggaucgaaaauauuaagcaugagcacaaauccaccuggcauuacgacgaggauaaccccuauaagacaugggcuuaccacggcagcuaugaaguuaaacccucuggguccgccagcuccauggugaauggaguggucaaacuucugaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcucuggggguuucugagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccuuguucauagagaacgggagcugcacaaacagggcaagugcgcgaccugcguguacaacaugauggggaaacgcgaaaagaagcucggagaguuuggcaaagcuaagggguccagagccaucugguacauguggcugggcgcccgguuccuggaguucgaagcucucggauuuaugaaugaggaucacugguucucucgcgaaaacagccuguccggcgucgagggggagggacuucauaaacugggcuauauucucagagacaucucuaagaucccugggggaaauauguacgccgaugacacagcuggcugggauacccggauuacagaagacgaucugcagaacgaggcccgcaucaccgacauuauggaacccgagcacgcgcuucuggccaaaagcaucuuuaagcucacguaucaaaauaaaguggucagagugcagcggccugcuaagaacgggaccguuauggaugugauuucccgcagagaccagcggggcucuggacaggucggcacauacgggcugaauaccuucacaaacauggaagcccaacugaucagacagauggagagcgagggaaucuuuucccccagcgaacucgagaccccgaaccuggcugaacgcgugcuugauuggcugaagaaauauggcguggagcggcucaagagaauggccauuucuggggacgacuguguugugaaaccuaucgaugaccgcuucgcgacggcccugacagcucuuaaugauaugggaaagguccggaaagacauuccccagugggaaccuuccaagggcuggaacgauuggcagcaagugcccuuuugcagccaucacuuccaccagcugaucaugaaggacgggagagagauuguugugccuugucgcaaucaggaugagcucgucggccgggccagagugucucagggagcuggcuggucccugcgcgaaaccgccugccuggggaaaagcuacgcucaaauguggcagcucauguauuuucaucggagagaccugcgccuugccgcgaacgccaucuguuccgcuguccccguggauuggauuccgacaucucggaccacguggagcauccacgcccaucaccaguggaugaccacagaggacaugcuguccguuuggaauagaguguggaucgaagagaacccuuggauggaagauaagacccauauuagcucuuggggagacguccccuaccucggcaaacgggaggaccaauggugcgggucccugaucggacuuacagccagagcuaccugggccacaaauauucagguggcgaucaaccagguucgccggcugauuggcaaugagaacuaccucgauuauaugaccagcaugaagagauucaaaaaugaaucugaccccgagggggcucugugguga

SEQ ID NO: 19306 - RNA, 9879 nt, Artificial Sequence
  derived and/or modified CDS sequence (opt5) from DENV-1__EU482497__SS-prME
agcgugaccaugcugcucaugcugaugcccacagcccuugcuuuccaccugacgaccagaggaggggagccucauaugaucgucuccaagcaggaacggggaaaaucucuccuguuuaagacaagcgccggaguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaaggaaccuggaaucgccaggaccugcucgugaccuucaaaacagcucacgcgaagaagcaggaggucgugguucugggcagccaagaaggggccaugcacacggcucugaccggagccacagagauucagaccuccggcacaaccacgaucuuugccgggcaucucaaaugcagacugaagauggauaaacuuacacugaagggcaugagcuaugugauguguaccggaucuuucaaacucgaaaaggaggucgcugaaacccagcacggcacagugcugguucagauuaaguacgaggggaccgacgccccgugcaaaaucccuuucuccacacaagaugagaagggagugacgcagaacggccggcugaucaccgcgaaucccauugucacagacaaagaaaagccugugaacaucgaggcugaaccgcccuuuggggagagcuauauugugaucggagccggcgagaaagcccuuaagcucucuugguucaagaaagggagcuccauuggcaagauguuugaagcuaccgccagaggagcucgccggauggccauccugggcgauacagcgugggacuucgggucuaucggaggcguuuuuaccagcgucgggaaacuggugcaucagauuuucggaacggccuacggcgugcucuuuuccggggucagcuggaccaugaagaucggcauuggagugcugcuuacauggcugggccucaauucuagauccaccagccugucuaugacauguaucgcuguugggcuggugacccuuuaccucggagucauggugcaggccgauuccggcugcguuauuaacuggaaagggcgcgagcugaaguguggaagcggcaucuucgugacaaaugaaguccacaccuggacggagcaauauaaguuucaggcugacuccccuaaacggcugucugccgcgauugggaaggccugggaagagggcgugugcggaaucagaagcgcuacacgccucgagaacaucauguggaaacagauuuccaacgaacugaaucauauccuucuggagaacgacaugaaguucaccguuguggucggcgauguggccgggauucucgcucagggcaagaagaugauccggccgcaacccauggaauacaaauauucuuggaaaagcuggggcaaggccaagauuaucggggccgacgugcagaauaccacauuuaucauugauggaccuaacacccccgaguguccugacgaucagagagcuuggaauaucugggaagucgaggacuacggcuucggcauuuuuacgacaaacaucuggcugaagcugcgcgauuccuauacccagguuugcgaccaccggcuuaugagcgcggccauuaaagauucuaaggcugugcacgccgacaugggguacuggaucgaguccgagaaaaaugagacauggaagcucgccagagcuagcuucaucgaagugaagaccuguauuuggcccaaaucucauacacugugguccaacggaguccuggagagcgaaaugaucauuccgaagaucuauggcgggccuauuucucaacacaauuaccgccccggauacuucacccagacggccggcccuuggcaucucgggaaacuggagcuugauuuugaccugugcgagggaaccacagugguuguggaugaacacugcggcaaccggggccccagccucagaaccacaaccgucacggggaagaucauccacgagugguguugccgguccuguacacugccuccccugcgcuucagaggagaagacggcugcugguaugggauggagauucggccggugaaagagaaggaagagaaucuuguuaagagcauggugucugcgggauccggcgaagucgacagcuuuucccucgggcugcuguguaucucuauuaugaucgaggaagugaugagaagccgcuggucccggaaaaugcucaugaccggaacacuggcuguuuucuuucuucugauuaugggccagcucaccuggaacgaucugaucagacugugcauuauggugggcgccaaugccucugaccgcauggggaugggaaccacauaccuugcucugauggccacguucaagaugagaccuauguuugcggucggccuccuguuccggcgccucaccagcagagaggugcugcuucugacaaucgggcucucccugguggcuucugucgagcugcccaacagccuugaagaacugggagauggccucgccauggggaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuuggaagccugggcugcaagccgcugacgauguuucucaucgcugaaaauaaaauuuggggccggcgcucuuggccccugaacgaggggaucauggccgucggaaucguguccauucuucugagcucccuccugaagaacgauguuccucucgcgggcccccugaucgccgggggaaugcuuauugcuuguuacgugaucagcggcucuagcgccgaccugucccuggaaaaagcugccgaggucucuugggaggaagaggccgaacauagcggggcuucccacaauauucucguggagguucaggaugacggaaccaugaagaucaaagaugaagagagagacgauacacugaccauccuucugaaggcgacacuccuggccgugucuggcgucuauccucucagcauucccgcuacccuguucgugugguacuucuggcagaaaaagaagcagcgguccggcguccuuugggacacgccuucucccccggagguggaacgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugugggagaggaggcuggagcuacuauugcgccggccucaagaaaguuaccgaggugaagggguacacaaaaggaggcccugggcacgaggagcccauuccuauggcuaccuacggauggaaccuggugaagcugcauuccggcaaagacgucuuuuucauucccccugaaaagugugauacacuccuuugcgacauuggggagucuagcccgaaucccacgaucgaggaaggacgcacccugcgggugcugaaaaugguugagccuuggcucagaggcaaccaauuuuguauuaagauccugaaucccuauaugccuuccguggucgaaacacuugagcagaugcagcgcaagcacggcgggaugcuggugcggaacccccucagcagaaauucuacccaugagauguacuggguuuccugcggaacaggcaacaucgugagcgccgucaauaugaccucucgcaugcugcugaaccgguucacgauggcgcacagaaaaccgaccuaugaacgcgauguggaccucggggccggaacaagacacguggcugucgagccugaaguugccaaccuggauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuuguacccgcgaagaguucacaagaaaagugcggucuaaugcugccaucggcgcugucuuuguggacgaaaaccaguggaauagcgccaaggaggccguugaggaugaacgcuucugggaccuugugcauagagagcgggaacugcacaaacaggggaagugcgcgaccugcgucuacaacaugaugggaaaacgcgagaagaagcucggcgaauuugggaaagcuaagggcuccagagccauuugguacauguggcugggagcccgguuccuggaguucgaggcucucggcuuuaugaaugaagaucacugguucucucgcgagaacagccuguccgggguggaaggagagggccuucauaaacugggguauauccucagagacauuucuaagaucccuggaggcaauauguacgccgaugacacagcugggugggauacccggaucacagaggacgaucugcagaacgaagcccgcauuaccgacacgauggagcccgaacacgcgcuucuggccagaagcaucuuuaaacucaccuaucaaaauaaggucgugcggguucagcgcccugcuaaaaacggcacagugauggaugucauuuccagacgggaccagagaggaucuggccagguggggaccuacggacugaauacauucaccaacauggaggcccaacugauccgccagauggaaagcgagggcaucuuuucccccagcgagcucgaaacgccgaaccuggcugagcgggugcuugauuggcuggaaaaguaugggguugagagacucaagcgcauggccaucucuggagacgacuguguggucaaaccuaucgaugaccgguucgcgacagcccugaccgcucuuaaugauaugggcaaggugagaaaagacauuccccagugggaaccuuccaagggguggaacgauuggcagcaaguucccuuuugcagccaucacuuccaccagcugaucaugaaagacggccgcgagauuguggucccuugucggaaucaggaugagcucgugggcagagcccgcgucucucagggcgcuggguggucccugcgggaaacagccugccugggaaagagcuacgcucaaauguggcagcucauguauuuucauagacgcgaccugcggcuugccgcgaacgccaucuguuccgcugugcccguugauuggauuccgaccucuagaacgaccuggagcauccacgcccaucaccaguggaugacaaccgaggacaugcuguccguguggaaucgggucuggauugaagagaacccuuggauggaagauaagacacauaucagcucuuggggcgacgugcccuaccucgggaaaagagaggaccaauggugcggaucccugaucggccuuaccgcccgcgcuacaugggccaccaauauucagguugcgaucaaccaggugcggagacugauugggaaugagaacuaccucgauuauaugacgagcaugaagcgcuucaaaaaugaaucugaccccgagggcgcucugugguga

SEQ ID NO: 19307 - RNA, 9879 nt, Artificial Sequence
  derived and/or modified CDS sequence (opt5) from DENV-1__EU482499__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugaggucgccaaccuggauaucauuggacagcggaucgaaaauauuaagcacgagcauaaauccaccuggcacuaugacgaggauaaccccuacaagacaugggcuuaucauggcagcuacgaaguuaaacccucuggguccgccagcuccauggugaauggaguggucaaacuucugaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcucuggggguuucugagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccuuguucacagagaacgggagcugcacaaacagggcaagugcgcgaccugcguguauaacaugauggggaaacgcgaaaagaagcucggagaguuuggcaaagcuaagggguccagagccaucugguacauguggcugggcgcccgguuccuggaguucgaagcucucggauuuaugaaugaggaucauugguucucucgcgaaaacagccuguccggcgucgagggggagggacuucacaaacugggcuacauucucagagacaucucuaagaucccugggggaaauauguaugccgaugacacagcuggcugggauacccggauuacagaagacgaucugcagaacgaggcccgcaucaccgacauuauggaacccgagcaugcgcuucuggccaaaagcaucuuuaagcucacguaccaaaauaaaguggucagagugcagcggccugcuaagaacgggaccguuauggaugugauuucccgcagagaccagcggggcucuggacaggucggcacauaugggcugaauaccuucacaaacauggaagcccaacugaucagacagauggagagcgagggaaucuuuucccccagcgaacucgagaccccgaaccuggcugaacgcgugcuugauuggcugaagaaauacggcguggagcggcucaagagaauggccauuucuggggacgacuguguugugaaaccuaucgaugaccgcuucgcgacggcccugacagcucuuaaugauaugggaaagguccggaaagacauuccccagugggaaccuuccaagggcuggaacgauuggcagcaagugcccuuuugcagccaccacuuccaucagcugaucaugaaggacgggagagagauuguugugccuugucgcaaucaggaugagcucgucggccgggccagagugucucagggagcuggcuggucccugcgcgaaaccgccugccuggggaaaagcuaugcucaaauguggcagcucauguacuuucaccggagagaccugcgccuugccgcgaacgccaucuguuccgcuguccccguggauuggauuccgacaucucggaccacguggagcauccaugcccaccaucaguggaugaccacagaggacaugcuguccguuuggaauagaguguggaucgaagagaacccuuggauggaagauaagacccacauuagcucuugggaggacguccccuaucucggaaaacgggaggaccaauggugcggcucccugaucgggcuuacagccagagcuaccugggccacaaauauucagguggcgaucaaccagguucgccggcugauuggaaaugaaaacuaccucgauuacaugaccagcaugaagagauucaaaaaugagggcgaccccgaaggggcucugugguga

SEQ ID NO: 19308 - RNA, 9879 nt, Artificial Sequence
  derived and/or modified CDS sequence (opt5) from DENV-1__EU482500__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugagaucgccaaccuggauauuaucggacagcggauugaaaauaucaagcacgagcauaaauccaccuggcacuaugacgaggauaaccccuacaagacaugggcuuaucauggcagcuacgaagucaaacccucuggguccgccagcuccaugguuaauggaguggugaaacuucugaccaagccuugggacgucauccccauggugacacaaauugcuaugaccgauacgacaccuuuuggccagcagcgcguuuucaaagagaagguggacaccagaaccccgaaagccaagcggggcacagcgcaaaucauggaagucacggccaaauggcucuggggguuucugagcagaaacaagaagccccggauuuguacccgcgaggaguucacaagaaaagugcggucuaaugcugccaucggagcuguuuuuguggacgagaaccaguggaauagcgccaaggaggccgucgaagaugagcgcuucugggaccuugugcacagagaacgggagcugcacaaacagggcaagugcgcgaccugcguuuauaacaugauggggaaacgcgaaaagaagcucggagaguuuggcaaagcuaagggguccagagccauuugguacauguggcugggcgcccgguuccuggaguucgaagcucucggauuuaugaaugaggaucauugguucucucgcgaaaacagccuguccggcguggagggggagggacuucacaaacugggcuacauccucagagacaucucuaagauuccugggggaaauauguaugccgaugacacagcuggcugggauacccggaucacagaagacgaucugcagaacgaggcccgcauuaccgacaucauggaagcggagcaugcccuucuggcuaaaagcauuuuuaagcucacguaccaaaauaaagucgugagaguccagcggcccgccaagaacgggaccgugauggauguuaucucccgcagagaccagcggggcucuggacaggugggcacauaugggcugaauaccuucacaaacauggaagcucaacugaucagacagauggagagcgagggaaucuuuuccccuagcgaacucgagacccccaaccuggccgaacgcguccuugauuggcuggagaaguacggcguggaacggcucaaaagaauggcgaucucuggggacgacugugugguuaagccgauugaugaccgcuucgccacggcucugacagcccuuaaugauaugggaaaagugcggaaggacaucccucagugggagcccuccaaaggcuggaacgauuggcagcaagucccuuuuugcagccaccacuuccaucagcugauuaugaaggacgggagagagaucgugguucccugucgcaaucaggaugaacucgugggccgggcuagagucucucagggagccggcuggucccugcgcgagaccgcuugccugggaaagagcuaugcccaaauguggcagcucauguacuuucaccggagagaccugcgccuugcggccaacgcuauuuguuccgccgugccugucgauuggauccccacaucucggaccacguggagcauccaugcccaccaucaguggaugaccacagaagacaugcuguccguguggaauagaguuuggauugaggaaaacccguggauggaggauaaaacccacaucagcucuuggggagacgugccuuaucucggcaagcgggaggaccaauggugcgggucccugauuggacuuacagcuagagccaccugggcgacaaauauccaggucgcuauuaaccaggugcgccggcugaucggcaaugaaaacuaccucgauuacaugaccagcaugaaaagauucaagaaugagggggaccccgaaggcgcccugugguga

SEQ ID NO: 19309 - RNA, 9879 nt, Artificial Sequence
  derived and/or modified CDS sequence (opt5) from DENV-1__EU482501__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugugggagaggaggcuggagcuacuauugcgccggccucaagaaaguuaccgaggugaagggguacacaaaaggaggcccugggcacgaggagcccauuccuauggcuaccuacggauggaaccuggugaagcugcauuccggcaaagacgucuuuuucauucccccugaaaagugugauacacuccuuugcgacauuggggagucuagcccgaaucccacgaucgaggaaggacgcacccugcgggugcugaaaaugguugagccuuggcucagaggcaaccaauuuuguauuaagauccugaaucccuauaugccuuccguggucgaaacacuugagcagaugcagcgcaagcacggcgggaugcuggugcggaacccccucagcagaaauucuacccaugagauguacuggguuuccugcggaacaggcaacaucgugagcgccgucaauaugaccucucgcaugcugcugaaccgguucacgauggcgcacagaaaaccgaccuaugaacgcgauguggaccucggggccggaacaagacacguggcugucgagccugaaguugccaaccuggauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuuguacccgcgaagaguucacaagaaaagugcggucuaaugcugccaucggcgcugucuuuguggacgaaaaccaguggaauagcgccaaggaggccguugaggaugaacgcuucugggaccuugugcauagagagcgggaacugcacaaacaggggaagugcgcgaccugcgucuacaacaugaugggaaaacgcgagaagaagcucggcgaauuugggaaagcuaagggcuccagagccauuugguacauguggcugggagcccgguuccuggaguucgaggcucucggcuuuaugaaugaagaucacugguucucucgcgagaacagccuguccgggguggaaggagagggccuucauaaacugggguauauccucagagacauuucuaagaucccuggaggcaauauguacgccgaugacacagcugggugggauacccggaucacagaggacgaucugcagaacgaagcccgcauuaccgacaucauggagcccgaacacgcgcuucuggccaaaagcauuuuuaagcucacguaucaaaauaaagucgugagaguucagcggccugcuaagaacggcaccgugauggaugucaucucccgcagagaccagcggggaucuggccagguggggacauacggacugaauaccuucacaaacauggaggcccaacugauuagacagauggaaagcgagggcaucuuuucccccagcgagcucgaaaccccgaaccuggcugagcgcgugcuugauuggcuggaaaaguaugggguugagcggcucaaaagaauggccaucucuggagacgacuguguggucaagccuauugaugaccgcuucgcgacggcccugacagcucuuaaugauaugggcaaagugcggaaggacaucccccagugggaaccuuccaaaggguggaacgauuggcagcaaguucccuuuugcagccaucacuuccaccagcugauuaugaaggacggcagagagaucguggucccuugucgcaaucaggaugagcucgugggacgggccagagucucucagggcgcuggguggucccugcgcgaaaccgccugccugggaaagagcuacgcucaaauguggcagcucauguauuuucaucggagagaccugcgccuugccgcgaacgccauuuguuccgcugugcccguugauuggaucccgacaucucggaccacguggagcauucacgcccaucaccaguggaugaccacagaggacaugcuguccguguggaauagagucuggaucgaagagaacccuuggauggaagauaaaacccauaucagcucuuggggcgacgugcccuaccucgggaagcgggaggaccaauggugcggaucccugauuggccuuacagccagagcuaccugggccacaaauauccagguugcgauuaaccaggugcgccggcugaucgggaaugagaacuaccucgauuauaugaccagcaugaaaagauucaagaaugaaucugaccccgagggcgcucugugguga

SEQ ID NO: 19310 - RNA, 9879 nt, Artificial Sequence
  derived and/or modified CDS sequence (opt5) from DENV-1__EU482504__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuaucgccauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuuggguuacacugcucagccugaccuucaucaagacgacauuuucucugcacuaugccuggaaaaccauggcuauggugcuuuccauugugagccuguucccccucugucugucuaccacaucccagaagaccacauggcucccuguccugcuugggagccugggaugcaagccgcugacgauguuucucaucgccgagaauaaaauuuggggccggcgcucuuggccccugaacgaaggcaucauggcuguggggaucguuuccauucuucugagcucccuccugaagaacgaugugccucucgccggaccccugaucgcgggcgggaugcuuauugccuguuacgucaucagcggaucuagcgcugaccugucccuggagaaagccgcugaggugucuugggaagaggaagccgagcauagcggcgccucccacaauauucucguugaagugcaggaugacgggaccaugaagaucaaagaugaggagagagacgauacacugaccauccuucugaaggcuacacuccuggcggucucuggaguguauccucucagcauucccgccacccuguucgucugguacuucuggcagaaaaagaagcagcgguccggcgugcuuugggacacgccuucucccccggaaguugagcgcgcugugcuggaugacggcaucuauagaauuaugcagcgggggcugcucggacgcagccaggucggcguggggguuuuucaagaaaacguguuccauaccauguggcacgucacaagaggagccgugcugauguaccagggcaaacggcuugagccuuccugggccagcgugaagaaagaccugaucucuuacgggggaggcuggagacuccagggcuccuggaauaccggggaggaaguucaggucauugcuguggagcccggaaagaacccuaaaaaugugcaaacagcccccggcaccuuuaagacaccggaaggggaggucggagcgaucgcucuggauuucaagccuggcacgagcgggucucccauugugaaccgcgaaggaaaaaucguuggccucuauggcaaugggguggucaccacauccggaaccuacgugagcgccaucgcccaggcuaaggccucccaggagggcccucugcccgagauugaagacgagguuuuucggaaaagaaaccuuaccaucauggaucugcaccccgggucuggaaagacacgccgguaucugccugcgauugugagagaagcuaucaaacgcaagcuccggacgcugauucuugccccgaccagagucguggccagcgagauggcugaagcccugaagggcaugcccauccgcuaccaaacaaccgcuguuaaauccgagcauacagggaaggagaucguggaccucaugugccacgccaccuucacgaugcggcugcugagcccugucagagugcccaauuauaacaugauuaucauggaugaagcgcauuuuacagacccuucuuccauugccgcucggggcuacaucagcacccgcgugggaaugggcgaggccgcugccauuuucaugaccgccacacccccugggucugucgaggcuuuuccgcagagcaaugcgguuauccaggaugaggaaagagacauccccgagcgguccuggaacucuggauaugaguggauuaccgauuucccuggcaaaacagugugguuugugcccagcaucaaguccgggaaugacauugccaacugucuccgcaaaaauggaaagagagucauccagcuuucucggaagaccuucgauacggaauaccagaaaaccaagaacaacgacugggacuacgugguuaccacagauauuagcgagaugggcgcuaauuucagagccgaccgcgugaucgauccucggagaugccugaaacccgucauucugaaggacgggccggaacgcgugauccucgccggcccuaugcccguuaccguggcuuccgccgcgcagcggagaggacgcaucggccggaaccacaauaaagagggggaucaguauauuuacaugggacagccccugaacaaugacgaggaucaugcucacuggacggaagccaagaugcuucuggacaacaucaauaccccugagggcauuauccccgcccucuuugaaccugagagagaaaagagcgcugccauugauggggaguaucgccugagaggagaggcgcggaaaacauucgucgaacugaugcgcagaggcgaccucccgguguggcuuucuuacaaggucgccuccgagggguuucaauauagcgaucggcgcuggugcuucgacggcgaaagaaacaaucaggugcuggaggaaaacauggauguugagaucuggaccaaagagggagaacggaagaaacugagaccccgcuggcucgacgcucggacauacuccgacccucuggcccuuagagaguuuaaggaguucgcugccggccgccggucugugagcggggaucugaucuccgagauuggaaaacucccccagcaccugacccagagagcucaaaaugcccuggacaaccucgugaugcuucauaauucugaacagggcgggcgggcguaucgccacgccauggaggagcugccugauacaaucgaaacccugaugcuccuggcucuuauugccguccugacgggaggcguuacacucuuuuuccugagcggcagagggcugggaaagaccuccaucggccuccuuugugugauggcuagcucugugcugcuguggauggccuccgucgagccccauuggauugccgcuagcaucauccucgaauuuuuccugauggugcuucugauuccggagccugaccggcagcgcacaccccaggauaaccaacucgcguacguugugaucgggcugcuguuuaugauucucacagucgccgcuaaugagaugggacuucuggaaaccacaaagaaagaccugggcaucgggcacguggccgucgagaaccaccaucacgccgcuaugcucgauguggaccugcauccugccucugcguggacgcuuuacgccguugcuaccacaauuaucacccccaugaugagacacacaauugaaaacaccacggccaauaucucccugaccgcuaucgccaaccaggcggccauucucaugggacuggauaagggcuggccuaucagcaaaauggacauuggcgugccccugcucgcucuugggugcuauucucaggucaauccgcugacacugaccgccgcugugcucaugcugguugcccauuacgcuaucauuggaccuggccuucaagccaaggcgacacgggaggcccagaaacgcaccgcugccgggaucaugaagaaccccacgguggauggaaucgucgcuauugaccuggaucccgugguguaugacgccaaguucgaaaaacagcucggccagaucaugcugcugauucucuguacaagccaaauccuucugaugagaaccacaugggcccugugcgaguccauuacccucgcgaccgggccucugacaacgcuuugggagggaucuccgggcaaguuuuggaauaccacaaucgcuguuagcauggccaacaucuuccggggcuccuaccuggcuggggccggacucgccuucagccugaugaaaucccugggcgggggacgcagaggcaccggggcucagggagaaacacucggcgagaaguggaaacggcagcuuaaucagcugucuaagagcgaauuuaacaccuauaagagauccggcauuauggaggucgaccgcucugaagccaaagaggggcugaagcggggagagacgacaaaacacgcggugagcagaggcaccgccaagcuccgcugguucguggaacggaaucuggucaaacccgaggggaagguuaucgaucuuggauguggcagagggggaugguccuacuauugcgcuggccugaagaaagugaccgaagugaagggcuacacaaaagggggaccuggccacgaggaacccauuccuauggccaccuacggguggaaccucgucaagcugcauucuggaaaagacguguuuuucauucccccugagaagugugauacacugcucugcgacauuggcgagagcuccccgaaucccacgaucgaagaggggcgcacccuucggguucugaaaaugguggaaccuuggcugagaggaaaccaauuuuguauuaagauccucaaucccuauaugccuagcgucguggagacacuggagcagaugcagcgcaagcacggcggcaugcuuguucggaacccccugucuagaaauuccacccaugaaauguacugggugagcugcgggacaggaaacaucgucucugcugugaauaugaccucccgcaugcuccugaaccgguucacgauggcccacagaaaaccgaccuaugagcgcgauguggaccugggcgcggggacaagacacgucgccguugaaccugagguggcuaaccucgauauuaucggacagcggauugaaaauaucaagcaugagcacaaaagcaccuggcauuacgacgaggauaaccccuauaagacaugggccuaccacggcucuuaugaagugaaacccuccgggagcgcuuccagcauggucaauggagugguuaagcugcuuaccaagccuugggacgugauucccauggucacacaaaucgccaugaccgauacgacaccuuuuggccagcagcgcguguucaaagagaagguugacaccagaaccccgaaagcuaagcggggcacagcccaaaucauggaagugacggcgaaauggcuguggggguuucucucuagaaacaagaagccccggauuuguacccgcgaggaguucacaagaaaaguccggagcaaugccgcuaucggagccguguuuguugacgagaaccaguggaacuccgcuaaggaggccguggaagaugagcgcuucugggaccugguccauagagaacgggagcuucacaaacagggcaagugcgcgaccugcguguacaacaugauggggaaacgcgaaaagaagcugggagaguuuggcaaagcgaaggggucuagagcuauuugguacauguggcucggcgcccgguuccuggaguucgaagcccugggauuuaugaaugaggaucacugguucagccgcgaaaacucccucucuggcgucgagggggagggacugcauaaacuuggcuauauccugagagacauuagcaagaucccugggggaaauauguacgcugaugacacagccggcugggauacccggaucacagaagacgaucuccagaacgaggcucgcauuaccgacaucauggaacccgagcacgcccugcuugcgaaauccauuuuuaagcugacguaucaaaauaaagugguuagagugcagcggccugccaagaacgggaccgucauggaugugaucucucgcagagaccagcggggcagcggacaggugggcacauacgggcucaauaccuucacaaacauggaagcucaacugauuagacagauggaguccgagggaaucuuuagccccucugaacuggagaccccgaaccucgccgaacgcguucuggauuggcuugagaaguauggcaucgaacggcugaaaagaauggcuauuuccggggacgacuguguggucaagccuaucgaugaccgcuucgccacggcgcucacagcccugaaugauaugggaaaagugcggaaggacauuccccagugggagccuagcaaaggcuggaacgauuggcagcaaguucccuuuugcucucaucacuuccaccagcuuaucaugaaggacgggagagagauuguggucccuugucgcaaucaggaugaacuggugggccgggcuagagucucccagggagccggcuggagccuccgcgagaccgcuugccuggggaaguccuacgcccaaauguggcagcugauguauuuucaucggagagaccuccgccuggcugccaacgcgaucuguucugccgugcccguugauuggauuccgacaagccggaccacgugguccauccacgcucaucaccaguggaugaccacagaagacaugcuuagcguguggaauagagucuggaucgaggaaaacccuuggauggaggauaaaacccauauuucuuccuggggagacgugcccuaccugggcaagcgggaggaccaauggugcgggagccucaucggacugacagccagagccaccugggcuacaaauauucagguugccaucaaccaggugcgccggcuuauuggcaaugaaaacuaccuggauuauaugaccucuaugaaaagauucaagaaugagagcgaccccgaaggggcgcucugguga

SEQ ID NO: 19311 - RNA, 9879 nt, Artificial Sequence
  derived and/or modified CDS sequence (opt5) from DENV-1__EU482505__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuuaaagggaugagcuaugugauguguacaggcucuuucaagcuggagaaggaagucgcggagacccagcacggaaccgugcucguucagaucaaauacgagggcacagacgcuccgugcaagauuccuuuuuccacccaggaugaaaaaggggugacacaaaacggacggcugaucacggccaaucccaucgucaccgacaaggagaaaccugugaacauugaagccgagccgcccuucggcgagagcuauaucgugauuggggcuggagaaaaggcccugaaacuuucuugguuuaaaaagggcagcuccaucgggaaaauguucgaggcuacagccagaggcgcgcgccggauggccauucucggagauaccgcuugggacuuuggcucuaucgggggaguuuucacaagcgucggcaagcuggugcaucagaucuuugggaccgccuacggagugcuguucuccggcgucagcuggacgaugaaaauugggaucggcgugcuccugaccuggcuuggacucaauucuagauccacaagccucucuaugaccuguauugcuguuggccuggugacacuguaccuuggggucauggugcaggccgauuccggaugcguuaucaacuggaagggccgcgaacucaagugugggagcggaauuuuugugaccaaugagguccacacauggaccgaacaguauaaauuccaagcggacuccccuaagcggcugucugccgcuaucggcaaagccugggaggagggggugugcggcauuagaagcgcuacgcgccuggaaaacaucauguggaagcagaucuccaacgagcucaaucauauucugcuugaaaacgacaugaaauuuacaguuguggucggagauguggccggcauccuggcccaggggaagaaaaugauucggccgcagcccauggagcacaaguacucuuggaaaagcuggggaaaggcuaagaucauuggcgcggacgugcaaaaugccaccuucaucaucgaugggccuaacacccccgaauguccugacgaucagagagcuuggaauauuugggaggucgaggacuauggauuuggcaucuucacaaccaacauuuggcucaaacugcgcgauuccuacacgcagguuugcgaccaccggcugaugagcgccgccaucaaggauucuaaagcugugcaugccgacaugggcuauuggauugaauccgagaagaaugaaacauggaaacuugcgagagcuagcuucaucgaggugaaaaccuguaucuggcccaagucucacacacucugguccaacgggguccuggaaagcgagaugauuaucccgaaaauuuacggaggcccuaucucucagcauaauuaucgccccggguacuuuacccaaacagccggaccuuggcaccugggcaagcucgagcuggauuucgaccuuugcgaagggaccacggugguuguggaugagcacugcggaaaccggggccccagccugagaaccacaaccgucacaggcaaaauuauccaugaaugguguugccgguccuguacccucccuccccugcgcuuuaagggggaggacggaugcugguacggcauggagaucagaccggugaaggaaaaagaggaaaaucugguuaagagcauggugucugccggguccggagaggucgacagcuucucccuuggccuccuguguauuucuaucaugauugaagaggugaugcggagcagauggucccgcaaaaugcugaugacggggacacucgcugucuuuuuccugcuuaucaugggacagcugaccuggaacgaucucauucggcugugcaucauggugggcgccaaugcgucugacagaaugggcauggggacaaccuaucuggcucuuauggccaccuuuaagaugcgcccuauguucgccgucggacugcucuuuagacggcugacaagccgcgaggugcuccugcuuacgauuggccugucccucguggcuucugucgaacugcccaacagccuggaggaacuuggggauggacuggccaugggcaucaugauccucaaacugcucaccgacuuccagucccaccaacugugggcuacacuucugagccucaccuuuauuaagacaaccuucucucugcauuacgccuggaagacgauggcgaugguucuguccaucgugagccuuuuuccccugugucucucuacaaccucccagaaaaccacauggcugccugugcuccuggggagccuuggaugcaagccgcugaccauguuccugauugccgagaauaaaaucuggggcagaaagucuuggccccucaacgaaggcauuauggcugucgggaucguguccauccugcuuagcucccugcucaaaaacgauguuccucuggccggaccccucauugcuggcgggaugcugaucgccuguuaugugauuagcggaucuagcgccgaccuuucccuggagaaggcugcggaggucucuugggaagaggaagccgagcacagcggcgcuucccauaauauccugguggaaguucaggaugacgggacaaugaaaauuaaggaugaggagcgggacgauacgcucaccauccugcuuaaggccacacugcucgccgugucuggagucuacccucugagcauccccgcuacccucuucgugugguauuuuuggcagaaaaagaaacaacgcuccggcguccugugggacacaccuucucccccggaaguggagagagccguucuugaugacggcauuuaccggaucaugcagcgcgggcugcugggaagaagccaggugggcgucgggguguuccaggaaaacguuuuucacaccauguggcacgugacgcggggagcgguccucauguaucaaggcaagcgccuggagccuuccugggcuagcgugaaaaaggaccuuauuucuuacgggggaggcuggagacugcagggcuccuggaauaccggggaggaagugcagguuaucgccgucgagcccggaaagaacccuaaaaaugugcagacagcccccggcaccuucaagacaagcgaaggggaggugggagcuauugcccucgauuuuaaaccgggcaccucuggguccccuaucgucaaccgggaaggaaagauugugggccuguacggcaaugggguugugacaacgagcggaaccuaugucuccgcgaucgcucaagccaaagccucucaggagggcccccucccugagaucgaagacgagguguucagaaagcgcaaccugacaauuauggaucuucaucccgggagcggaaagacccggagauaccugcccgcuaucguucgcgaagccauuaaacggaagcugagaacccucauccuggcuccuacacgcguggucgccuccgagauggcggaagcccuuaaaggcaugccgauucgguaucagacgaccgcugugaaguccgagcacacagggaaagagaucguugaccugaugugccaugccaccuuuacaaugagacuccugucucccgugcgcgucccuaauuacaacaugaucauuauggaugaagcucacuucaccgaccccuccagcaucgccgcccggggcuauauuucuacgagagugggaaugggcgaggcugcggccaucuuuaugacagcuaccccucccgggagcguggaagccuucccucaauccaaugccgucauucaggaugaggaacgggacaucccggagcgcucuuggaacagcggauacgaguggaucaccgauuuucccggcaagacaguuugguucgugccuuccauuaagucugggaaugacaucgcuaacugucugcgcaagaauggaaagcgggugauucagcucagccgcaaaaccuucgauacagaauaucagaagaccaaaaacaacgacugggacuacgucgugacgacagauaucuccgagaugggcgccaauuuuagagcggaccggguuauugaucccagacgcugccuuaagccugugauccugaaggacgggcccgaacgggucauucuggcuggcccgaugccugugaccguugccagcgccgcucaaagacgcggacggaucggcagaaaccauaauaaagagggggaucaguacaucuauaugggacagccccucaacaaugacgaggaucacgcccacuggacagaagcgaagaugcugcuugacaacauuaauacccccgagggcaucauuccugcccuguucgaacccgagcgcgaaaaaucugcugccaucgauggggaguaccggcucagaggagaggcucgcaagacguuuguggaacugaugagacggggcgaccugccugucuggcucuccuauaaaguggccagcgagggguuccaguacuccgaucgcagauggugcuuugacggcgaacggaacaaucaaguccuugaggaaaacauggauguggagauuuggaccaaggagggagaacgcaaaaagcugagaccgcgguggcuggacgcuagaacauauucugacccccucgcccugcgcgaguucaaggaauuugcggccggccggagaagcguuuccggggaucuuauccuggagaucggaaaacucccucagcaucugacccagcgcgcucagaaugcccuggacaaccucgugaugcuucacaauucugaacaaggcgggcgggcuuacagacaugccauggaggagcugcccgauacaauugaaacccugaugcuccuggcccuuaucgcugugcugacaggaggcgucacccucuucuuucugagcggccgggggcugggaaagacguccauuggccuccuuuguguuauggcgagcucugugcugcuguggauggccuccguggagccucacuggaucgcugccagcauuauccucgaguucuuucugaugguccuucugauccccgagccggaccgccagagaacaccucaggauaaccagcucgccuaugugguuauugggcugcuguucaugauccucaccguggcugccaaugagaugggacuucuggaaaccaccaagaaggaccugggcauugggcacgucgcgguggagaaccaucaccaugccgcuaugcucgaugucgaccugcaccccgccucugcuuggacccuuuacgccguggcgacaacgaucauuaccccuaugaugcggcauacaaucgaaaacaccacagccaauauuucccugaccgcuaucgccaaccaagcugccauccucaugggacuggauaaaggcuggcccauuagcaagauggacaucggcguuccucugcucgcucuugggugcuacucucaggugaauccccugacgcugaccgccgcgguccucaugcugguggcccacuaugcuauuaucggaccgggccuucaggccaaggcuacacgcgaggcccagaagagaaccgccgcggggauuaugaagaacccuacaguugauggaaucguggcuaucgaccuggaucccgucguguacgacaccaaauuugaaaagcagcucggccagauuaugcugcugauccucuguacgagccagauucuucugaugcggacaaccugggcccugugcgaguccaucacacucgcuaccgggccccugaccacacuuugggagggaucuccuggcaaauucuggaauacgaccauugccgugagcauggccaacaucuuccgcggcuccuaucuggcuggggccggacucgcguuuagccugaugaagucccugggcgggggaagacggggcacaggggcccaaggagaaacccucggcgagaaguggaaacgccagcuuaaucagcugucuaagagcgaguucaacacauacaaaagauccggcaucauggagguugaccggucugaagcuaaggaggggcugaaaagaggagagaccacgaagcacgccgucagccgcggcacagcuaagcuccggugguuuguggaaagaaaucuggugaaaccggaggggaaggucauugaucuuggauguggccgcgggggaugguccuauuacugcgccggccugaaaaagguuaccgaagugaaaggcuauaccaaagggggacccggccaugaggaaccuauccccauggcgacauacggguggaaccucgugaaacugcacucuggaaaggacgucuucuuuauuccucccgagaagugugauacccugcucugcgacaucggcgagagcuccccuaauccgacaauugaagaggggcggacgcuuagagugcugaaaaugguugaacccuggcugcgcggaaaccaguucuguaucaagauucucaauccuuacaugcccagcguggucgagacccuggagcaaaugcagcggaaacauggcggcaugcuugugagaaacccucugucucgcaauuccacacacgaaauguauuggguuagcugcgggaccggaaacaucgugucugccgucaauaugacaucccggaugcuccugaacagauuuaccauggcucaccgcaagcccacguacgagcgggauguggaccugggcgccgggaccagacauguggcugucgaaccggagguugccaaccucgauaucauuggacagcgcaucgaaaauauuaaacacgagcauaagagcacauggcacuaugacgaggauaacccuuacaagaccugggcuuaucauggcucuuacgaagugaaacccuccgggagcgccuccagcauggugaauggagucgugaagcugcuuacaaaacccugggacguuaucccuauggugacccagauugcgaugacagauaccacgcccuucggccaacagagagucuuuaaggagaaaguggacacacggaccccuaaggccaagcgcggcaccgcucagaucauggaaguuacagccaaauggcuguggggguuccucucuagaaacaagaaaccgcggaucuguacgagagaggaauuuacccggaaggugcgcagcaaugcugccauuggagccgucuucguggacgagaaccaauggaacuccgcgaaagaggcuguugaagaugagagauuuugggaccuggugcaccgggaacgcgagcuucacaagcagggcaagugcgccacaugcgucuauaacaugauggggaaaagagaaaagaaacugggagaguucggcaaggccaaagggucucgggcuaucugguacauguggcucggcgcccgcuuccuggaguuugaagcucugggauucaugaaugaggaucauugguuuaacagagaaaauagccucuccggcguggagggggagggacugcacaaacuuggcuacauucugcgggacaucucuaaaauucccgggggaaacauguaugccgaugacaccgcgggcugggauacacgcaucaccgaagacgaucuccagaaugaggccaagaucacagacauuauggaaccugagcaugcucugcuugccaagagcaucuucaaacugaccuaccagaacaaggucgugagaguucaacggcccgcuaaaaaugggacggugauggaugucauuucccgcagagaccagcggggcucuggacaggugggcaccuaugggcucaacacauuuaccaacauggaagcccagcugauccgccaaauggagagcgagggaauuuucuccccuagcgaacuggagacacccaaucucgcgggcagagugcuggauuggcuugaaaagcacgggguugagcggcugaaaagaauggccaucucuggagacgacuguguggucaagccgaucgaugaccgcuuugcuaccgcccucacggcucugaacgauaugggcaaggugcggaaagacauuccucagugggaacccuccaagggguggaaugauuggcagcagguuccuuucugcagccaccauuuucaccaacuuaucaugaaagacggcagagagauugugguccccugucgcaaccaggaugagcuggugggacgggccagagucucucagggcgcuggguggucccuccgcgaaacagccugccugggaaagagcuacgcgcagauguggcaacugauguauuuccaucggagagaccuccgccuggccgcuaaugccaucuguuccgccgugccuguugauugggugcccaccucucggacaaccuggagcauucacgcucaucaccaguggaugacgaccgaggacaugcuuuccgucuggaacagaguguggaucgaagagaauccguggauggaagauaaaacacacauuagcucuuggggcgacguuccuuaccuggggaagcgcgaggaccaguggugcggaucccucaucggccugaccgcccgggcgacaugggcuaccaacauccaaguggccauuaaucaggucagacggcuuaucgggaacgagaauuaucuggauuacaugacaagcaugaagagauuuaaaaacgaaauugaccccgagggcgcccucugguga

SEQ ID NO: 19312 - RNA, 9879 nt, Artificial Sequence
  derived and/or modified CDS sequence (opt5) from DENV-1__EU482506__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcauucuucugacauggcucggacugaauagcagaucuaccucccugagcaugacauguaucgcugucggccuugugacccucuaccuggggguuauggugcaggccgauucuggaugcgucauuaacuggaaaggccgcgaacugaaguguggguccggaaucuucgugacaaaugagguucacaccuggacggaacaauauaaguuucaggcugacagcccuaaacggcucuccgccgcgaucggcaaggccugggaggagggggugugcggcauuagaucugcuacacgccuggaaaacaucauguggaaacagauuagcaacgagcuuaaucauauccugcucgaaaacgacaugaaguucaccgucgugguuggagauguggccggcauucuggcucaggggaaaaagaugauccggccgcaacccauggaguacaaauauuccuggaagucuuggggaaaggccaaaaucauuggcgccgacguccagaauaccacauuuaucauugaugggccuaacacccccgaauguccugacgaucagagagcuuggaauaucugggagguggaggacuacggauucggcauuuuuacgacaaacaucuggcugaaacuucgcgauagcuauacccaggugugcgaccaccggcucauguccgcggccaucaaagauagcaaggcuguccacgccgacaugggcuacuggauugaaucugagaaaaaugaaacauggaagcuggccagagcuuccuucaucgagguuaagaccuguauuuggcccaaaagccauacacuguggucuaacggggugcucgaauccgagaugaucauuccgaagaucuauggaggcccuaucagccaacacaauuaccgccccggguacuucacccagacggccggaccuuggcaucugggcaaacuugagcuggauuuugaccucugcgaagggaccacaguggucguggaugagcacugcggaaaccggggccccucucugagaaccacaaccguuacgggcaagauuauccacgaaugguguugccggagcuguacacugccuccccuucgcuucagaggggaggacggaugcugguauggcauggagauucggccggugaaagaaaaggaggaaaaucucgucaaguccauggugagcgcggggucuggagagguugacuccuuuagccugggccugcucuguaucuccauuaucauugaagaggugaugagaucucgcuggagccggaaaaugcugaugaccgggacacuugcugucuucuuucugcucaucaugggacagcugaccuggaacgaucugaucagacuuugcauuauggugggcgccaaugccuccgaccgcaugggcauggggaccacauaccuggcucucauggccacguucaagaugagaccuauguuugcgguuggacuccuguuccggcgccugaccucuagagaggugcuucugcucacaaucggccugagccuggucgcuuccguggaacuucccaacucucuggaggaacucggggauggacuggccaugggcauuaugauccucaaacugcuuaccgacuuucaaagccaucagcugugggccacacuccugucccugaccuucauuaagacgacauuuagccuucacuaugcuuggaaaaccauggccauggugcugucuaucgucucccucuucccccugugucucagcaccacaucucagaagaccacauggcugccuguucuucuggggucccugggaugcaagccgcucacgauguuucugaucgcugagaauaaaauuuggggccggcgcagcuggccccuuaacgaaggcaucauggccguggggauugugucuauccugcucuccagccugcucaagaacgaugucccucuggcgggaccccuuauugccggcgggaugcugaucgcuuguuacgugaucuccggaagcucugccgaccugagccucgagaaagcugccgagguuuccugggaagaggaagccgagcauucuggcgcuagccacaauauucugguggaaguccaggaugacgggaccaugaagaucaaagaugaggagagagacgauacacuuaccauucugcucaaggcgacacugcucgccguguccggaguuuauccucugucuauccccgcuacccuuuucgugugguacuucuggcagaagaagaagcagcggagcggcguccugugggacacgccuagcccucccgaaguggagcgcgccguccuggaugacggcauuuauagaaucaugcagcgggggcuccugggacgcucucaggugggcguugggguguuucaagaaaacgucuuccauaccauguggcacgugacaagaggagccguucuuauguaccagggcaaacggcuggagcccagcugggcuuccgugaagaaagaccucauuagcuacgggggaggcuggagacugcagggcucuuggaauaccggggaggaaguccaggugaucgccguggagcccggaaagaacccuaaaaauguucaaacagcgcccggcaccuuuaagacaccggaaggggaggucggagcuaucgcccucgauuucaagccuggcacguccgggagccccauugugaaccgcgaaggaaaaaucgugggccuguauggcaauggggucgugaccacaucuggaaccuacguuuccgccauugcucaggccaaggcgagccaggagggcccucuucccgagaucgaagacgagguguuucggaaaagaaaccugaccauuauggaucugcaccccggguccggaaagacacgccgguaucucccugcuaucgucagagaagccaucaaacgcaagcugcggacgcuuauucuggccccgaccagagugguugcuucugagauggccgaagcucucaagggcaugcccauccgcuaccaaacaaccgccgugaaaagcgagcauacagggaaggagauugucgaccugaugugccacgcgaccuucacgaugcggcugcucuccccugugagaguucccaauuauaacaugaucauuauggaugaagcccauuuuacagacccuagcucuaucgcugcccggggcuacaucuccacccgcgugggaaugggcgaggcugccgccauuuucaugaccgcuacacccccugggagcgucgaagcguuuccgcagucuaaugccgugauccaggaugaggaaagagacauucccgagcggagcuggaacuccggauaugaguggaucaccgauuucccuggcaaaacagugugguuuguccccucuauuaagagcgggaaugacaucgcuaacugucuucgcaaaaauggaaagagaguuauucagcugucccggaagaccuucgauacggaauaccagaagaccaagaacaacgacugggacuacguggugaccacagauaucucugagaugggcgccaauuucagagccgaccgcgucaucgauccucggagaugccugaaacccgugauucucaaggacgggccggaacgcguuauccuggcuggcccuaugcccgugaccgucgccagcgcggcucagcggagaggacgcauuggccggaaccacaauaaagagggggaucaguauaucuacaugggacagccccuuaacaaugacgaggaucaugcccacuggacggaagccaagaugcugcucgacaacauuaauaccccugagggcaucauccccgcucuguuugaaccugagagagaaaaguccgccgcgauugauggggaguaucgccugagaggagaggcccggaaaacauucguggaacucaugcgcagaggcgaccuuccgguuuggcugagcuacaagguggcuucugagggguuucaauauuccgaucggcgcuggugcuucgacggcgaaagaaacaaucagguccuggaggaaaacauggauguggagaucuggaccaaagagggagaacggaagaaacucagaccccgcuggcuggacgcccggacauacagcgacccucuugcucugagagaguuuaaggaguucgccgcuggccgccgguccgucucuggggaucucauucuggagaucggaaaacugccccagcaccucacccagagagcccaaaaugcgcuugacaaccuggugaugcugcauaauagcgaacagggcgggcgggccuaucgccacgcuauggaggagcucccugauacaauugaaacccugaugcuucuggcccucaucgcuguucugacgggaggcgugacacuguuuuuccucuccggcagagggcuuggaaagaccucuaucggccugcugugugugauggccagcuccguccuccuguggauggccagcguugagccccauuggauugcugcgucuaucauucuugaauuuuuccugauggugcuccugaucccggagccugaccggcagcgcacaccccaggauaaccaacuggccuacguggucauugggcuccuuuuuaugauccugacaguggcugccaaugagaugggacugcucgaaaccacaaagaaagaccugggcauugggcacguugccguggagaaccaccaucacgcugccaugcuugaugucgaccugcauccugcguccgccuggacgcucuacgcuguggccaccacaaucaucacccccaugaugagacacacaauugaaaacaccacggcuaauaucagccugaccgccauugcgaaccaggccgcuauccugaugggacucgauaagggcuggccuauuucuaaaauggacaucggcgucccccuucuggcccuggggugcuauucccaggugaauccgcucacacugaccgcugccguucuuaugcugguggcucauuacgccaucauuggaccuggccuccaagcgaaggccacacgggaggcucagaaacgcaccgccgcugggaucaugaagaaccccacggucgauggaauuguggccaucgaccuggaucccguuguguaugacgccaaguucgaaaaacagcugggccagauuaugcuccuuauccuguguacaagccaaauccugcucaugagaaccacaugggcgcugugcgagucuauuacccuugcuaccgggccucugacaacgcucugggagggaagcccgggcaaguuuuggaauaccacaaucgccgucuccauggcuaacauuuuccggggcucuuaccuggccggggccggacuggcuuucagccucaugaaaucccuuggcgggggacgcagaggcaccggggcccagggagaaacacugggcgagaaguggaaacggcagcugaaucagcucagcaaguccgaauuuaacaccuauaagagaucuggcaucauggagguggaccgcagcgaagcgaaagaggggcugaagcggggagagacgacaaaacacgccguguccagaggcaccgcuaaacuucgcugguucguugaacggaaucuggucaaacccgaggggaaggugauugaucucggauguggcagagggggauggucuuacuauugcgccggccugaagaaagugaccgaagucaagggcuacacaaaagggggaccuggccacgaggaacccaucccuauggcuaccuacggguggaaccugguuaagcuccauagcggaaaagacguguuuuucauucccccugagaagugugauacacuucugugcgacaucggcgaguccucuccgaaucccacgaucgaagaggggcgcacccugcgggugcucaaaauggucgaaccuuggcugagaggaaaccaauuuuguauuaagauccuuaaucccuauaugccuagcgugguugagacacuggagcagaugcagcgcaagcacggcggcaugcucgugcggaacccccuguccagaaauagcacccaugaaauguacugggucucuugcgggacaggaaacauuguguccgccguuaauaugaccagccgcaugcugcucaaccgguucacgauggcgcacagaaaaccgaccuaugagcgcgauguggaccugggcgccgggacaagacacgucgcuguggaaccugagguggccaaccuugauaucauuggacagcggaucgaaaauaucaagcaugagcacaaaucuaccuggcauuacgacgaggauaaccccuauaagacaugggcuuaccacggcuccuaugaagucaaacccagcgggucugccuccagcaugguuaauggaguggugaagcugcucaccaagccuugggacgucauucccauggugacacaaaucgcuaugaccgauacgacaccuuuuggccagcagcgcguuuucaaagagaagguggacaccagaaccccgaaagccaagcggggcacagcgcaaauuauggaagucacggccaaauggcuguggggguuucuuuccagaaacaagaagccccggaucuguacccgcgaggaguucacaagaaaagugcggagcaaugcugccauuggagcuguuuuuguggacgagaaccaguggaacucugccaaggaggccgucgaagaugagcgcuucugggaccuggugcauagagaacgggagcuccacaaacagggcaagugcgcgaccugcguuuacaacaugauggggaaacgcgaaaagaagcugggagaguuuggcaaagcuaaggggagcagagccaucugguacauguggcugggcgcccgguuccucgaguucgaagcucugggauuuaugaaugaggaucacugguucucccgcgaaaacucucuuagcggcguggagggggagggacugcauaaacucggcuauauccugagagacauuuccaagaucccugggggaaauauguacgccgaugacacagcuggcugggauacccggauuacagaagacgaucuucagaacgaggcccgcaucaccgacauuauggaacccgagcacgcgcugcucgccaaaucuaucuuuaagcugacguaucaaaauaaagucgugagaguccagcggccugcuaagaacgggaccgugauggauguuaucagccgcagagaccagcggggcuccggacaggugggcacauacgggcugaauaccuucacaaacauggaagcccaacucauuagacagauggagucugagggaaucuuuagccccuccgaacuggagaccccgaaccuugcugaacgcguccuggauuggcucgagaaguauggcguggaacggcugaaaagaauggccauuagcggggacgacugugugguuaagccuaucgaugaccgcuucgcgacggcccuuacagcucugaaugauaugggaaaagugcggaaggacauuccccagugggagccuucuaaaggcuggaacgauuggcagcaaguccccuuuugcucccaucacuuccaccagcucaucaugaaggacgggagagagauugugguuccuugucgcaaucaggaugaacuggugggccgggccagagucagccagggagcuggcuggucucugcgcgagaccgccugccucgggaaguccuacgcucaaauguggcagcugauguauuuucaucggagagaccuucgccuggccgcgaacgccaucuguagcgcugugcccgucgauuggaucccgacaucccggaccacguggucuauucacgcccaucaccaguggaugaccacagaagacaugcucagcguguggaauagaguuuggaucgaggaaaacccuuggauggaggauaaaacccauauuuccagcuggggagacgugcccuaccugggcaagcgggaggaccaauggugcgggucucuuaucggacugacagccagagcuaccugggccacaaauauucaggucgcgaucaaccaggugcgccggcucaucggcaaugaaaacuaccuggauuauaugaccuccaugaaaagauucaagaaugagggggaccccgaaggcgcucugugguga

SEQ ID NO: 19313 - RNA, 9879 nt, Artificial Sequence
  derived and/or modified CDS sequence (opt5) from DENV-1__EU482509__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucugccggcaaacucguucaucagaucuucgggacggcuuacggaguccuguuuagcggcguguccuggaccaugaagauugggaucggcgugcuucugacauggcucggacugaauagcagaucuaccucccugagcaugacauguauugccgucggccuugugacccucuaccuggggguuauggugcaggcugauucuggaugcgucaucaacuggaaaggccgcgaacugaaguguggguccggaauuuucgugacaaaugagguucacaccuggacggaacaauauaaguuucaggccgacagcccuaaacggcucuccgcggccaucggcaaggcuugggaggagggggugugcggcaucagaucugccacacgccuggaaaacauuauguggaaacagaucagcaacgagcuuaaucauauucugcucgaaaacgacaugaaguucaccgucgugguuggagauguggcuggcauccuggcccaggggaaaaagaugauucggccgcaacccauggaguacaaauauuccuggaagucuuggggaaaggccaaaaucaucggcgcugacguccagaauaccacauuuauuaucgaugggccuaacacccccgaauguccugacgaucagagagcguggaauauuugggagguggaggacuacggauucggcaucuuuacgacaaacauuuggcugaaacuucgcgauagcuauacccaggugugcgaccaccggcucauguccgccgcuaucaaagauagcaaggccguccacgccgacaugggcuacuggaucgaaucugagaaaaaugaaacauggaagcuggcuagagccuccuucauugagguuaagaccuguaucuggcccaaaagccauacacuguggucuaacggggugcucgaauccgagaugauugugccgaagaucuauggaggcccuauuagccaacacaauuaccgccccggguacuucacccagacggcgggaccuuggcaucugggcaaacuugagcuggauuuugaccucugcgaagggaccacagucgugguugaugagcacugcggaaaccggggccccucucugagaaccacaaccgugacgggcaagaucauccacgaaugguguugccggagcuguacacugccuccccuucgcuucagaggggaggacggaugcugguauggcauggagauucggccggucaaagaaaaggaggaaaaucucgugaaguccaugguuagcgcugggucuggagagguggacuccuuuagccugggccugcucuguaucuccauuaucauugaagaggucaugagaucucgcuggagccggaaaaugcugaugaccgggacacuugccguguucuuucugcucaucaugggacagcugaccuggaacgaucugauuagacuuugcaucaugguuggcgccaaugcuuccgaccgcaugggcauggggaccacauaccuggcccucauggcgacguucaagaugagaccuauguuugcugugggacuccuguuccggcgccugaccucuagagagguccuucugcucacaaucggccugagccugguggccuccguggaacuucccaacucucuggaggaacucggggauggacuggccaugggcauuaugauccucaaacugcuuaccgacuuucaaagccaucagcugugggcuacacuccugucccugaccuucauuaagacgacauuuagccuucacuaugccuggaaaaccauggcuaugguccugucuaucguuucccucuucccccugugucucagcaccacaucucagaagaccacauggcugccugugcuucuggggucccugggaugcaagccgcucacgauguuucugauugccgagaauaaaaucuggggccggcgcagcuggccccuuaacgaaggcaucauggcgguggggauugucucuauccugcucuccagccugcucaagaacgaugugccucuggccggaccccuuauugcuggcgggaugcugaucgccuguuacguuauuuccggaagcucugcugaccugagccucgagaaagccgccgagguguccugggaagaggaagcugagcauucuggcgcgagccacaauauccuggucgaagugcaggaugacgggaccaugaagaucaaagaugaggagagagacgauacacuuaccauucugcucaaggccacacugcucgcuguuuccggaguguauccucugucuauccccgccacccuuuucgucugguacuucuggcagaagaagaagcagcggagcggcgugcugugggacacgccuagcccucccgaagucgagcgcgccgugcuggaugacggcauuuauagaaucaugcagcgggggcuccugggacgcucucagguuggcgugggggucuuucaagaaaacguguuccauaccauguggcacguuacaagaggagcugugcuuauguaccagggcaaacggcuggagcccagcugggccuccgucaagaaagaccucauuagcuacgggggaggcuggagacugcagggcucuuggaauaccggggaggaaguccaggugaucgcgguugagcccggaaagaacccuaaaaauguccaaacagcucccggcaccuuuaagacaccggaaggggaggugggagccauugcccucgauuucaagccuggcacguccgggagccccaucgugaaccgcgaaggaaaaaucgucggccuguauggcaauggggugguuaccacaucuggaaccuacguguccgcuauugcccaggcgaaggcuagccaggagggcccucuucccgagaucgaagacgaggucuuucggaaaagaaaccugaccauuauggaucugcaccccggguccggaaagacacgccgguaucucccugccaucgugagagaagccauuaaacgcaagcugcggacgcuuauccuggcuccgaccagaguuguggccucugagauggcugaagcccucaagggcaugcccauccgcuaccaaacaaccgcggucaaaagcgagcauacagggaaggagauuguggaccugaugugccacgccaccuucacgaugcggcugcucuccccuguuagagugcccaauuauaacaugaucauuauggaugaagcucauuuuacagacccuagcucuaucgccgcucggggcuacauuuccacccgcgucggaaugggcgaggccgccgcuaucuucaugaccgcgacacccccugggagcguggaagccuuuccgcagucuaaugcugugauccaggaugaggaaagagacauucccgagcggagcuggaacuccggauaugaguggaucaccgauuucccuggcaaaacagucugguuuguucccucuauuaagagcgggaaugacaucgccaacugucuucgcaaaaauggaaagagagugauucagcugucccggaagaccuucgauacggaauaccagaagaccaagaacaacgacugggacuacguggucaccacagauaucucugagaugggcgccaauuucagagcugaccgcgugauugauccucggagaugccugaaacccguuauccucaaggacgggccggaacgcgugauccuggccggcccuaugcccgucaccguggcgagcgcugcccagcggagaggacgcauuggccggaaccacaauaaagagggggaucaguauaucuacaugggacagccccuuaacaaugacgaggaucaugcccacuggacggaagcuaagaugcugcucgacaacauuaauaccccugagggcaucauucccgcccuguuugaaccugagagagaaaaguccgcggccaucgauggggaguaucgccugagaggagaggcucggaaaacauucguugaacucaugcgcagaggcgaccuuccgguguggcugagcuacaaggucgccucugagggguuucaauauuccgaucggcgcuggugcuucgacggcgaaagaaacaaucaggugcuggaggaaaacauggaugucgagaucuggaccaaagagggagaacggaagaaacucagaccccgcuggcuggacgcucggacauacagcgacccucuugcccugagagaguuuaaggaguucgcugccggccgccgguccgugucuggggaucucauucuggagaucggaaaacugccccagcaccucacccagagagcgcaaaaugcccuugacaaccugguuaugcugcauaauagcgaacagggcgggcgggcuuaucgccacgccauggaggagcucccugauacaauugaaacccugaugcuucuggcucucaucgccgugcugacgggaggcgugacacuguuuuuccucuccggcagagggcuuggaaagaccucuauuggccugcugugugucauggccagcuccguucuccuguggauggcuagcguggagccccauuggaucgcggccucuaucauucuugaauuuuuccugauggugcuccugaucccggagccugaccggcagcgcacaccccaggauaaccaacuggcuuacgucgugauugggcuccuuuuuaugauccugacaguugccgccaaugagaugggacugcucgaaaccacaaagaaagaccugggcauugggcacguggcugucgagaaccaccaucacgccgcgaugcuugauguggaccugcauccugccuccgcuuggacgcucuacgccgucgcuaccacaaucauuacccccaugaugagacacacaaucgaaaacaccacggccaauaucagccugaccgcgauugccaaccaggcugccauccugaugggacucgauaagggcuggccuauuucuaaaauggacaucggcgugccccuucuggcucuggggugcuauucccagguuaauccgcucacacugaccgccgcugugcuuaugcuggucgcccauuacgcgauuaucggaccuggccuccaagccaaggcuacacgggaggcccagaaacgcaccgcugccgggaucaugaagaaccccacgguggauggaauuguugccaucgaccuggaucccguggucuaugacgcgaaguucgaaaaacagcugggccagauuaugcuccuuauccuguguacaagccaaauucugcucaugagaaccacaugggcucugugcgagucuaucacccuugccaccgggccucugacaacgcucugggagggaagcccgggcaaguuuuggaauaccacaaucgcuguguccauggccaacauuuuccggggcucuuaccuggccggggcuggacuggccuucagccucaugaaaucccuuggcgggggacgcagaggcaccggggcgcagggagaaacacugggcgagaaguggaaacggcagcugaaucagcucagcaaguccgaauuuaacaccuauaagagaucuggcaucauggagguggaccgcagcgaagccaaagaggggcugaagcggggagagacgacaaaacacgcuguuuccagaggcaccgccaaacuucgcugguucgucgaacggaaucuggugaaacccgaggggaaggugauugaucucggauguggcagagggggauggucuuacuauugcgcuggccugaagaaagucaccgaaguuaagggcuacacaaaagggggaccuggccacgaggaacccaucccuauggccaccuacggguggaaccuggugaagcuccauagcggaaaagacguguuuuucauucccccugagaagugugauacacuucugugcgacaucggcgaguccucuccgaaucccacgauugaagaggggcgcacccugcggguccucaaaaugguggaaccuuggcugagaggaaaccaauuuuguaucaagauccuuaaucccuauaugccuagcguuguggagacacuggagcagaugcagcgcaagcacggcggcaugcucguccggaacccccuguccagaaauagcacccaugaaauguacugggugucuugcgggacaggaaacauuguuuccgcggugaauaugaccagccgcaugcugcucaaccgguucacgauggcccacagaaaaccgaccuaugagcgcgaugucgaccugggcgcugggacaagacacguggccguggaaccugaggucgcuaaccuugauaucauuggacagcggaucgaaaauauuaagcaugagcacaaaucuaccuggcauuacgacgaggauaaccccuauaagacaugggccuaccacggcuccuaugaaguuaaacccagcgggucugcuuccagcauggugaauggaguggucaagcugcucaccaagccuugggacgugauccccaugguuacacaaaucgccaugaccgauacgacaccuuuuggccagcagcgcguguucaaagagaaggucgacaccagaaccccgaaagcgaagcggggcacagcccaaauuauggaagugacggcuaaauggcuguggggguuucuuuccagaaacaagaagccccggaucuguacccgcgaggaguucacaagaaaaguucggagcaaugccgcuauuggagccguguuugucgacgagaaccaguggaacucugccaaggaggcgguggaagaugagcgcuucugggaccugguucauagagaacgggagcuccacaaacagggcaagugcgcuaccugcguguacaacaugauggggaaacgcgaaaagaagcugggagaguuuggcaaagccaaggggagcagagccaucugguacauguggcugggcgcucgguuccucgaguucgaagcccugggauuuaugaaugaggaucacugguucucccgcgaaaacucucuuagcggcgucgagggggagggacugcauaaacucggcuauauucugagagacaucuccaagaucccugggggaaauauguacgcugaugacacagccggcugggauacccggauuacagaagacgaucuucagaacgaggcgcgcaucaccgacauuauggaacccgagcacgcccugcucgcuaaaucuaucuuuaagcugacguaucaaaauaaaguggucagagugcagcggccugccaagaacgggaccguuauggaugugauuagccgcagagaccagcggggcuccggacaggucggcacauacgggcugaauaccuucacaaacauggaagcucaacucaucagacagauggagucugagggaaucuuuagccccuccgaacuggagaccccgaaccuugccgaacgcgugcuggauuggcucgagaaguauggcguggaacggcugaaaagaauggcgauuagcggggacgacuguguugugaagccuaucgaugaccgcuucgccacggcucuuacagcccugaaugauaugggaaaaguccggaaggacauuccccagugggagccuucuaaaggcuggaacgauuggcagcaagugcccuuuugcucccaucacuuccaccagcucaucaugaaggacgggagagagauuguugugccuugucgcaaucaggaugaacuggucggccgggcuagagugagccagggagccggcuggucucugcgcgagaccgcuugccucgggaaguccuacgcccaaauguggcagcugauguauuuucaucggagagaccuucgccuggcggccaacgcuaucuguagcgccguccccguggauuggauuccgacaucccggaccacguggucuauccacgcccaucaccaguggaugaccacagaagacaugcucagcguuuggaauagaguguggaucgaggaaaacccuuggauggaggauaaaacccauauuuccagcuggggagacguccccuaccugggcaagcgggaggaccaauggugcgggucucuuaucggacugacagcuagagccaccugggcgacaaauauucagguggcuaucaaccagguucgccggcucauuggcaaugaaaacuaccuggauuauaugaccuccaugaaaagauucaagaaugagggggaacccgagggcgcccugugguga

SEQ ID NO: 19314 - RNA, 9879 nt, Artificial Sequence
  derived and/or modified CDS sequence (opt5) from DENV-1__EU482510__SS-prME
uccgugaccaugcugcucaugcugaugcccacggcgcuugcuuuccaccugacgaccagaggaggggagccucauaugaucgucuccaagcaggaacggggaaaaucucuccuguuuaagaccagcgccggcguuaauaugugcacccuuauugcgauggaccugggggagcucugugaagauacaaugaccuacaaaugcccgcgcaucacagagguggaacccgacgauguggacuguuggugcaauaccacggauaccugggucacauauggaaccuguucccagacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcuccggaccgagguuacaaacccugcugugcugcgcaaacuuugcauugaagccaagaucuccaauaccacgacagauagcagauguccgacccaaggagaggcgacccugguggaagaacaagacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguagcccccggacaggccucgacuucaacgaaaugguccugcuuaccaugaaggagaaaagcuggcuggugcauaagcagugguuucucgaucugccucuucccuggacguccggggccucuacaagccaagagaccuggaaucgccaggaccugcucgucacauucaaaaccgcucacgcgaagaagcaggaagugguugugcugggaucccaagagggcgccaugcacaccgcucugacaggggccacggaaauucagaccagcggaacaaccacaaucuuugccggccaucucaaaugcagacugaagauggauaaacuuacccugaaggggaugucuuaugucauguguacgggcuccuucaaacucgagaaggaaguggcugagacacagcacggaaccguucuggugcagauuaaguacgagggcaccgacgccccgugcaaaaucccuuucagcacacaagaugggaagggagucacccagaacggccggcugaucacagcgaaucccauugugacggacaaagaaaagccugugaacaucgaggcugaaccgcccuuuggggagucuuauauuguuaucggagccggcgagaaagcccuuaagcucagcugguucaagaaaggguccucuauuggcaagauguuugaagcuaccgccagaggagcucgccggauggccauccugggcgauacagcgugggacuucgggagcaucggaggcgucuuuaccuccguggggaaacuggugcaucagauuuucggaacagccuacggcguccucuuuagcggggugucuuggaccaugaagaucggcauuggaguucugcuuacguggcugggccucaauuccagaagcaccucucuguccaugacauguaucgcuguggggcuggucacccuuuaccucggagugaugguucaggccgauagcggcugcgugauuaacuggaaagggcgcgagcugaaguguggauccggcaucuucgucacaaaugaagugcacaccuggacagagcaauauaaguuucaggcugacucuccuaaacggcugagcgccgcgauugggaaggccugggaagagggcguuugcggaaucagauccgcuacccgccucgagaacaucauguggcggcagauuucuaacgaacugaaucauauccuucuggagaacgacaugaaauucacgguggucgugggcgauguggucgggauucucgcccagggaaagaaaaugaucagaccgcaacccauggaacacaaguacagcuggaaauccuggggcaaggcuaagauuaucggggccgacguucagaauacaaccuuuaucauugauggaccuaacacccccgaguguccugacgaucagcgcgccuggaauaucugggaaguggaggacuauggcuucggcauuuuuacaaccaacaucuggcugaaacugcgggauagcuacacacaggugugcgaccacagacuuaugucugcugcgauuaaggauuccaaagccguccaugcugacaugggguauuggaucgagagcgaaaagaaugagacauggaaacucgcccgcgccucuuucaucgaagugaagaccuguauuuggcccaagucccacacacuguggagcaacggaguucuggagucugaaaugaucauuccgaaaaucuacggcgggccuauuagccaacauaauuaucggcccggauacuucacccagacagcuggcccuuggcaccucgggaagcuggagcuugauuuugaccugugcgagggaaccacgguggucguggaugaacacugcggcaacagaggccccucccuccggaccacaaccguuacagggaaaaucauccaugagugguguugccgcagcuguacccugccuccccugagauucaagggagaagacggcugcugguacgggauggagauucggccggugaaagagaaggaagagaaucuugucaagucuaugguguccgccggaagcggcgaaguugacuccuuuucucucgggcugcuguguaucagcauuaugaucgaggaagugaugagaucccgcuggucucggaaaaugcucaugacgggaacacuggcggucuucuuucuucugauuaugggccagcucaccuggaacgaucugaucagaagcugcauuauggugggcgcuaaugccuccgaccgcauggggaugggaacaaccuaucuggcccuuauggcuaccuucaagaugagaccuauguuugccgugggccuccuguuccggcgccugacaucuagagagguccuccugcuuacgaucgggcugagccucguugcguccguggagcugcccaacagccuggaagaacuuggagauggccuggcuauggggaucaugauucucaaacugcucaccgacuuucaaucuuaccagcugugggccacacuucugucccucaccuucaucaagacaaccuuuagccugcacuaugccuggaaaacgauggcuauggugcugucuauugucucccuucugccccucugucugagcacaaccucucagaagaccacauggcucccugugcugcuuggaucccugggcugcaagccgcugaccauguuccucaucgccgaaaauaaaauuuggggccggaaguccuggccccugaacgaggggaucauggcuguuggaaucguguccauucuucugagcucucuccugaaaaacgaugucccucucgccggcccccugaucgccgggggaaugcuuauugccuguuacgugaucagcggcuccucugcugaccugagccuggaaaaggccgcugagguuuccugggaggaagaggccgaacauucuggggccagccacaauauucucguggagguccaggaugacggaacaaugaaaaucaaggaugaggaacgcgacgauacgcugaccauccuucugaaagcuacacuccuggcgguguccggcgucuauccucucucuauucccgccacccuguuugugugguacuucuggcaaaagaagaaacagagaagcggcguucuuugggacacaccuagcccucccgagguggaacgggcuguccuggaugacgggaucuaucgcauuaugcagagaggacugcucggccggagccagguggggguuggaguguuccaagagaacgucuuucauaccauguggcacgugacgcgcggcgccgugcugauguaccaggggaagagacuugaacccucuugggccuccguuaaaaaggaccugaucagcuacggaggcggcuggcggcuccaggggucuuggaauaccggagaggagguccaggugauugcuguggaacccggcaaaaacccuaagaauguccaaacagcccccgggaccuucaagacaccggagggagaagugggcgcgaucgcucuggauuuuaaaccugggaccuccggaagccccauuguuaacagagagggcaagaucgugggccucuaugggaauggagucgugacaacguccggcaccuacguuucugccaucgcccaggcuaaagccagccaggaagggccucugcccgagauugaggacgaaguguuccgcaagcggaaccuuacaaucauggaucugcaccccggauccggcaaaaccagacgcuaucugccugcgauuguccgggaggcuaucaagagaaagcuccgcacccugauucuugccccgacacgggugguugccagcgaaauggcugaggcccugaaagggaugcccaucagauaccaaacgaccgcugugaagucugaacauacaggccgcgagaucgucgaccucaugugccacgccaccuuuacaaugcggcugcuguccccugugagagugcccaauuauaacaugauuaucauggaugaggcgcauuucaccgacccuagcucuauugccgcucggggauacaucagcacgcgcgucggcaugggggaagccgcugccauuuuuaugacagccacacccccuggauccguugaggcuuucccgcagucuaaugcggugauccaggaugaagagagagacauccccgaacggagcuggaacuccggcuaugaguggauuaccgauuuuccugggaaaacagugugguucguccccucuaucaagagcggaaaugacauugccaacugucuccgcaaaaauggcaagagagugauccagcuuucccggaagaccuuugauacagaguaccagaaaaccaagaacaacgacugggacuacguugugacgacagauauuagcgaaaugggggcuaauuucagagccgaccgcgucaucgauccucggagaugccugaaacccgugauucugaaggacggcccggagcgcguuauccucgccggaccuaugcccgugaccgucgcuucugccgcgcagcggagaggccgcaucgggcggaaccacaauaaagaaggagaucaguauauuuacaugggccagccccugaacaaugacgaggaucaugcucacuggacagaggccaagaugcuucuggacaacaucaauaccccugaagggauuauccccgcccucuucgagccugaaagagagaaguccgcugccauugauggagaauaucgccugagaggcgaggcgcggaaaacguuuguggagcugaugcgcagaggggaccucccggucuggcuuagcuacaagguggccuccgaaggcuuccaauauucugaucggcgcuggugcuuugacggagagagaaacaaucagguucuggaagagaacauggauguggaaaucuggaccaaagagggcgagcggaagaaacugagaccccgcuggcucgacgcucggacauacagcgacccucuggcccuuagagaguucaaggaguuugcugccgggcgccgguccgugucuggagaucugauccucgaaauuggcaaacugccccagcaccugacccagagagcucaaaaugcccucgacaaccuugucaugcugcauaauagcgagcaagggggacgggcguaucgccacgccauggaggaacugccugauacaaucgagacccucaugcugcuugcucugauugccguucucacaggcggcgugacccuguucuuucuguccgggagaggacucggcaagacgagcaucgggcuucugugugugauggcuucuuccgcccugcucuggauugccagcgucgaaccccauuggaucgcugcgucuaucauucuggaguucuuucuuauggugcugcucaucccggaaccugaccggcagcgcacaccccaggauaaccaacuggccuacguugugauuggacuccuguucaugauccuuaccgucgcugccaaugagaugggccugcuggagaccacaaagaaagaccucgggauuggacacguggccgucgaaaaccaccaucacgcuaccaugcuggauguggaccuucauccugccuccgcguggacacuguacgccguugcuacgaccaucauuacacccaugaugagacacaccaucgagaacacaaccgccaauaucagccucacggcuauugccaaccaggcggccauccugaugggccuggauaagggcuggccuauuucuaaaauggacaucggggugccccuccuugcucugggaugcuauagccaggucaauccgcugacccucacagccgcugugcugaugcuuguugcccauuacgcuauuaucggcccugggcugcaagccaaggcgacccgggaagcccagaaacgcacagcugccggaaucaugaagaaccccaccguggauggcauugucgcuaucgaccucgaucccgugguguaugacgccaaguuugagaaacagcuggggcagauuaugcugcucauccuuuguacgucccaaauucugcugaugagaacaaccugggcccucugcgaaucuaucacacuggcgaccggaccucuuaccacacugugggagggcagcccgggcaaguucuggaauacgaccaucgcuguuuccauggccaacauuuuucgggggagcuaccucgcuggagccggccuggccuucucccugaugaaaucucucgggggaggccgcagagggacaggagcucagggcgagacccuuggcgaaaaguggaaacggcagcugaaucagcugagcaaguccgaguucaacacauauaagagaucugggaucauggaagucgaccgcagcgaggccaaagaaggacuccggagaggcgagaccacgaagcacgcggugucccgcgggacagccaaacugcggugguuuguggagagaaaucuugucaagcccgaaggaaaaguuauugaucugggcugugggcgcggaggcuggucuuacuauugcgcuggccucaagaaggugaccgaggugaaaggguacaccaagggaggcccugggcacgaggaacccaucccuauggccacauacggauggaaccuggucaaacugcauagcggcaaggacguguucuuuauucccccugaaaaaugugauacccuccuuugcgacaucggggaguccagcccgaaucccacaauugaggaaggacggacgcugagaguucugaagaugguggagccuuggcuccgcggcaaccaauucuguaucaaaauccugaaucccuauaugccuucugucguggaaacccuugagcagaugcagcggaaguacggcgggaugcugguuagaaacccccucucccgcaauagcacacacgagauguauugggugucuugcggaaccggcaacauugucuccgcugugaauaugacaagccggaugcugcugaacagauuuaccauggcccaucgcaagccgacguacgaaagagauguggaccucggggcgggaacccggcacgucgccguugagccugaaguggcuaaccuggauaucauuggccagcgcaucgagaauauuaaacacgaacauaagucuacauggcacuaugacgaggauaaccccuacaaaaccugggccuaucauggguccuacgaggugaagcccagcggauccgcuagcucuauggucaauggcgugguuaaacuucugacaaagccuugggacgugauccccauggucacccaaaucgccaugacagauaccacgccuuucggccagcagagaguguuuaaggaaaaaguugacacacggaccccgaaggcuaaaagagggaccgcccaaauuauggaggugacagcgcgguggcucuggggauuccugagccgcaacaagaaacccagaaucuguacgcgggaagaguuuacccgcaaggucagauccaaugccgcuauuggcgccguguucguugacgaaaaccaguggaacucugcuaaggaggccguggaggaugaacgguuuugggaccuuguccaccgcgagagagaacugcauaaacaggggaagugcgccacaugcguguacaacaugaugggaaaacgggagaagaaacucggcgaguucgggaaggcgaagggcagccgcgcuaucugguauauguggcugggagccagauuucuggaguucgaggcccucggcuucaugaaugaagaucacugguuuucccgggagaacucucugagcggggucgaaggagagggccuucacaaacugggguacauucuccgcgacaucuccaagaucccuggaggcaauauguaugcugaugacaccgccgggugggauacaagaauuaccgaggacgaucugcagaacgaagcuaaaaucacagacauuauggagcccgaacaugcccuucuggcgaccucuaucuucaagcucacguaccaaaauaaagugguucgggugcagcgcccugccaagaacggcaccgucauggaugugauuagcagacgggaccagagaggauccggccagguggggacauauggacugaauaccuuuacaaacauggaggcucaacugauccgccagauggaaagcgagggcaucuucucucccuccgagcucgaaaccccgaaccuggccgagcggguucuugauuggcuggaaaaauacgggguggagagacucaagcgcauggcuauuagcggagacgacugugucgugaagccuaucgaugaccgguuugccacggcgcugacagcccuuaaugauaugggcaaaguuagaaaggacauuccccagugggaaccuucuaaaggguggaacgauuggcagcaagugcccuucugcucccaccauuuucaccagcugaucaugaaggacggccgcgagauugucgugccuugucggaaucaggaugagcucgucggcagagcucgcgugagccagggcgccggguggucccugcgggaaaccgcuugccugggaaaaucuuaugcccaaauguggcagcucauguacuuccacagacgcgaccugcggcuugcugccaacgcgaucuguagcgccguucccguggauugggucccgacauccagaaccacguggagcauucaugcucaccaucaguggaugaccacagaggacaugcugucuguguggaaucggguuuggaucgaagagaacccuuggauggaagauaagacccacaucuccagcuggggcgacgugcccuaccucgggaagagagaggaccaauggugcggaucucugauuggccuuacagcccgcgccaccugggcuacaaauauccaggucgccauuaaccaggugcggagacugaucgggaaugagaacuaucucgauuacaugaccagcaugaaacgcuuuaagaaugaauccgaccccgagggcgcgcugugguga

SEQ ID NO: 19315 - RNA, 9879 nt, Artificial Sequence
  derived and/or modified CDS sequence (opt5) from DENV-1__EU482511__SS-prME
agcgugaccaugcugcucaugcugaugcccacagcccuugcuuuccaccugacgaccagaggcggggaaccucauaugauuguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuaugucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagauuauccacgaaugguguugccgguccuguacacugccuccccuucgcuucagaggggaggacggaugcugguauggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugaccgggacacuugcuguguucuuucugcucaucaugggacagcugaccuggaacgaucugauuagacuuugcaucaugguuggcgccaaugccucugaccgcaugggcauggggaccacauaccuggcucucauggccacguucaagaugagaccuauguuugcggugggacugcuguuccggcgccugaccagcagagagguccuucugcucacaauuggccugucccugguggcuucuguggaacuucccaacagccuggaggaacucggggauggacuggccaugggcaucaugauccucaaacugcuuaccgacuuucaaucccaucagcugugggccacacuccugagccugaccuucauuaagacgacauuuucucuucacuaugcuuggaaaaccauggccaugguccuguccaucguuagccucuucccccugugucucucuaccacaucccagaagaccacauggcugccugugcuucuggggagccugggaugcaagccgcucacgauguuucugauugcugagaauaaaaucuggggccggcgcucuuggccccuuaacgaaggcauuauggccguggggaucgucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagauuaaagaugaggagagagacgauacacuuaccauccugcucaaggcgacacugcucgccguuucuggaguguauccucugagcauccccgcuacccuuuucgucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuucaagaaaacguguuccauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacagcgcccggcaccuuuaagacaccggaaggggaggugggagcuauugcccucgauuucaagccuggcacgagcgggucucccaucgugaaccgcgaaggaaaaauugucggccuguauggcaauggggugguuaccacauccggaaccuacgugagcgccaucgcucaggccaaggcgucccaggagggcccucuucccgagaucgaagacgaggucuuucggaaaagaaaccugaccauuauggaucugcaccccgggucuggaaagacacgccgguaucucccugcuaucgugagagaagccauuaaacgcaagcugcggacgcuuauccuggccccgaccagaguuguggcuagcgagauggccgaagcucucaagggcaugcccauucgcuaccaaacaaccgccgucaaauccgagcauacagggaaggagaucguggaccugaugugccacgcgaccuucacgaugcggcugcucagcccuguuagagugcccaauuauaacaugaucauuauggaugaagcccauuuuacagacccuucuuccaucgcugcccggggcuacauuagcacccgcgucggaaugggcgaggcugccgccaucuucaugaccgcuacacccccugggucuguggaagcguuuccgcagagcaaugccgugauucaggaugaggaaagagacauccccgagcgguccuggaacucuggauaugaguggaucaccgauuucccuggcaaaacagucugguuuguucccagcauuaaguccgggaaugacaucgcuaacugucuucgcaaaaauggaaagagagugauucagcugucucggaagaccuucgauacggaauaccagaagaccaagaacaacgacugggacuacguggucaccacagauaucagcgagaugggcgccaauuucagagccgaccgcgugauugauccucggagaugccugaaacccguuauccucaaggacgggccggaacgcgugauucuggcuggcccuaugcccgucaccguggccuccgcggcucagcggagaggacgcaucggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucguugaacucaugcgcagaggcgaccuuccgguguggcugucuuacaaggucgcuuccgagggguuucaauauagcgaucggcgcuggugcuucgacggcgaaagaaacaaucaggugcuggaggaaaacauggaugucgagauuuggaccaaagagggagaacggaagaaacucagaccccgcuggcuggacgcccggacauacuccgacccucuugcucugagagaguuuaaggaguucgccgcuggccgccggucugugagcggggaucucauccuggagaucggaaaacugccccagcaccucacccagagagcccaaaaugcgcuugacaaccugguuaugcugcauaauuccgaacagggcgggcgggccuaucgccacgcuauggaggagcucccugauacaauugaaacccugaugcuucuggcccucaucgcugugcugacgggaggcgugacacuguuuuuccucucuggcagagggcuuggaaagaccagcauuggccugcugugugucauggccuccagcguucuccuguggauggccucuguggagccccauuggaucgcugcguccauuauccuugaauuuuuccugauggugcuccugaucccggagccugaccggcagcgcacaccccaggauaaccaacuggccuacgucgugauugggcuccuuuuuaugauccugacaguugcugccaaugagaugggacugcucgaaaccacaaagaaagaccugggcauugggcacguggccgucgagaaccaccaucacgcugccaugcuugauguggaccugcauccugcgagcgccuggacgcucuacgcugucgccaccacaaucauuacccccaugaugagacacacaaucgaaaacaccacggcuaauauuucucugaccgccaucgcgaaccaggccgcuauccugaugggacucgauaagggcuggccuauuuccaaaauggacaucggcgugccccuucuggcccuggggugcuauagccagguuaauccgcucacacugaccgcugccgugcuuaugcuggucgcucauuacgccauuaucggaccuggccuccaagcgaaggccacacgggaggcucagaaacgcaccgccgcugggauuaugaagaaccccacgguggauggaaucguugccaucgaccuggaucccguggucuaugacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaauugccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcaucauggagguggaccgcuccgaagcgaaagaggggcugaagcggggagagacgacaaaacacgccguuucuagaggcaccgcuaaacuucgcugguucgucgaacggaaucuggugaaacccgaggggaaggugauugaucucggauguggcagagggggauggagcuacuauugcgccggccugaagaaagucaccgaaguuaagggcuacacaaaagggggaccuggccacgaggaacccaucccuauggcuaccuacggguggaaccuggugaagcuccauuccggaaaagacguguuuuucauucccccugagaagugugauacacuucugugcgacaucggcgagucuagcccgaaucccacgauugaagaggggcgcacccugcggguccucaaaaugguggaaccuuggcugagaggaaaccaauuuuguaucaagauucuuaaucccuauaugccuuccguuguggagacacuggagcagaugcagcgcaagcacggcggcaugcucguccggaacccccugagcagaaauucuacccaugaaauguacuggguguccugcgggacaggaaacaucguuagcgccgugaauaugaccucucgcaugcugcucaaccgguucacgauggcgcacagaaaaccgaccuaugagcgcgaugucgaccugggcgccgggacaagacacguggcuguggaaccugaggucgccaaccuugauaucauuggacagcggaucgaaaauauuaagcaugagcacaaauccaccuggcauuacgacgaggauaaccccuauaagacaugggcuuaccacggcagcuaugaaguuaaacccucuggguccgccagcuccauggugaauggaguggucaagcugcucaccaagccuugggacgugauccccaugguuacacaaauugcuaugaccgauacgacaccuuuuggccagcagcgcguguucaaagagaaggucgacaccagaaccccgaaagccaagcggggcacagcgcaaaucauggaagugacggccaaauggcuguggggguuucuuagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaagggguccagagccaucugguacauguggcugggcgcccgguuccucgaguucgaagcucugggauuuaugaaugaggaucacugguucucucgcgaaaacagccuuuccggcgucgagggggagggacugcauaaacucggcuauauucugagagacaucucuaagauuccugggggaaauauguacgccgaugacacagcuggcugggauacccggaucacagaagacgaucuucagaacgaggcccgcaucaccgacauuauggaacccgagcacgcgcugcucgccaaaagcaucuuuaagcugacguaucaaaauaaaguggucagagugcagcggccugcuaagaacgggaccguuauggaugugauuucccgcagagaccagcggggcucuggacaggucggcacauacgggcugaauaccuucacaaacauggaagcccaacucaucagacagauggagagcgagggaaucuuuucccccagcgaacuggagaccccgaaccuugcuaagcgcgugcuggauuggcucgaaaaauauggcguggagcggcugaagagaauggccaucucuggggacgacuguguugugaaaccuaucgaugaccgcuucgcgacggcccuuacagcucugaaugauaugggaaagguccggaaagacauuccccagugggaaccuuccaagggcuggaacgauuggcagcaagugcccuuuugcagccaucacuuccaccagcucaucaugaaggacgggagagagauuguugugccuugucgcaaucaggaugagcuggucggccgggccagagugucucagggagcuggcuggucccugcgcgaaaccgccugccucgggaaaagcuacgcucaaauguggcagcugauguauuuucaucggagagaccuucgccuggccgcgaacgccaucuguuccgcuguccccguggauuggauuccgacaucucggaccacguggagcauccacgcccaucaccaguggaugaccacagaggacaugcucuccguuuggaauagaguguggauugaagagaacccuuggauggaagauaagacccauaucagcucuuggggagacguccccuaccugggcaaacgggaggaccaauggugcgggucccuuaucggacugacagccagagcuaccugggccacaaauauucagguggcgaucaaccagguucgccggcucauuggcaaugagaacuaccuggauuauaugaccagcaugaagagauucaaaaaugaaucugaccccgagggggcucugugguga

SEQ ID NO: 19316 - RNA, 9879 nt, Artificial Sequence
  derived and/or modified CDS sequence (opt5) from DENV-1__EU482513__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaauaaaauuuggggccggcgcucuuggccccuuaacgaaggcaucauggccguggggaucgucuccauucugcucagcucccugcucaagaacgaugugccucuggcgggaccccuuaucgccggcgggaugcugauugcuuguuacguuaucagcggaucuagcgccgaccugucccucgagaaagcugccgaggugucuugggaagaggaagccgagcauagcggcgcuucccacaauauucuggucgaagugcaggaugacgggaccaugaagaucaaagaugaggagagagacgauacacuuaccauccugcucaaggcgacacugcucgccguuucuggaguguauccucugagcauucccgcuacccuuuucgucugguacuucuggcagaagaagaagcagcgguccggcgugcugugggacacgccuucucccccggaagucgagcgcgccgugcuggaugacggcaucuauagaauuaugcagcgggggcuccugggacgcagccagguuggcgugggggucuuucaagaaaacguguuccauaccauguggcacguuacaagaggagccgugcuuauguaccagggcaaacggcuggagccuuccugggcuagcgucaagaaagaccucaucucuuacgggggaggcuggagacugcagggcuccuggaauaccggggaggaaguccaggugauugccguugagcccggaaagaacccuaaaaauguccaaacagcgcccggcaccuuuaagacaccggaaggggaggugggagcuaucgcccucgauuucaagccuggcacgagcgggucucccauugugaaccgcgaaggaaaaaucgucggccuguauggcaauggggugguuaccacauccggaaccuacgugagcgccaucgcucaggccaaggcgucccaggagggcccucuucccgagauugaagacgaggucuuucggaaaagaaaccugaccaucauggaucugcaccccgggucuggaaagacacgccgguaucucccugcuauugugagagaagccaucaaacgcaagcugcggacgcuuauucuggccccgaccagaguuguggcuagcgagauggccgaagcucucaagggcaugcccauccgcuaccaaacaaccgccgucaaauccgagcauacagggaaggagaucguggaccugaugugccacgcgaccuucacgaugcggcugcucagcccuguuagagugcccaauuauaacaugauuaucauggaugaagcccauuuuacagacccuucuuccauugcugcccggggcuacaucagcacccgcgucggaaugggcgaggcugccgccauuuucaugaccgcuacacccccugggucuguggaagcguuuccgcagagcaaugccgugauccaggaugaggaaagagacauccccgagcgguccuggaacucuggauaugaguggauuaccgauuucccuggcaaaacagucugguuuguucccagcaucaaguccgggaaugacauugcuaacugucuucgcaaaaauggaaagagagugauccagcugucucggaagaccuucgauacggaauaccagaagaccaagaacaacgacugggacuacguggucaccacagauauuagcgagaugggcgccaauuucagagccgaccgcgugaucgauccucggagaugccugaaacccguuauucucaaggacgggccggaacgcgugauccuggcuggcccuaugcccgucaccguggccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaagagcgccgcgauugauggggaguaucgccugagaggagaggcccggaaaacauucguugaacucaugcgcagaggcgaccuuccgguguggcugucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacucagaccccgcuggcuggacgcccggacauacuccgacccucuugcucugagagaguuuaaggaguucgccgcuggccgccggucugugagcggggaucucauccuggagauuggaaaacugccccagcaccucacccagagagcccaaaaugcgcuugacaaccugguuaugcugcauaauuccgaacagggcgggcgggccuaucgccacgcuauggaggagcucccugauacaaucgaaacccugaugcuucuggcccucauugcugugcugacgggaggcgugacacuguuuuuccucucuggcagagggcuuggaaagaccagcaucggccugcugugugucauggccuccagcguucuccuguggauggccucuguggagccccauuggauugcugcguccaucauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcgagcgccuggacgcucuacgcugucgccaccacaauuaucacccccaugaugagacacacaauugaaaacaccacggcuaauaucucucugaccgccaucgcgaaccaggccgcuauucugaugggacucgauaagggcuggccuaucuccaaaauggacauuggcgugccccuucuggcccuggggugcuauagccagguuaauccgcucacacugaccgcugccgugcuuaugcuggucgcucauuacgccaucauuggaccuggccuccaagcgaaggccacacgggaggcucagaaacgcaccgccgcugggaucaugaagaaccccacgguggauggaaucguugccauugaccuggaucccguggucuaugacgccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaauaccacaaucgccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaacacgccguuucuagaggcaccgcuaaacuucgcugguucgucgaacggaaucuggugaaacccgaggggaaggugaucgaucucggauguggcagagggggauggagcuacuauugcgccggccugaagaaagucaccgaaguuaagggcuacacaaaagggggaccuggccacgaggaacccauuccuauggcuaccuacggguggaaccuggugaagcuccauuccggaaaagacguguuuuucauucccccugagaagugugauacacuucugugcgacaucggcgagucuagcccgaaucccacgaucgaagaggggcgcacccugcggguccucaaaaugguggaaccuuggcugagaggaaaccaauuuuguauuaagauccuuaaucccuauaugccuuccguuguggagacacuggagcagaugcagcgcaagcacggcggcaugcucguccggaacccccugagcagaaauucuacccaugaaauguacuggguguccugcgggacaggaaacaucguuagcgccgugaauaugaccucucgcaugcugcucaaccgguucacgauggcgcacagaaaaccgaccuaugagcgcgaugucgaccugggcgccgggacaagacacguggcuguggaaccugaggucgccaaccuugauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcugcucaccaagccuugggacgugauucccaugguuacacaaaucgcuaugaccgauacgacaccuuuuggccagcagcgcguguucaaagagaaggucgacaccagaaccccgaaagccaagcggggcacagcgcaaaucauggaagugacggccaaauggcuguggggguuucuuagcagaaacaagaagccccggauuuguacccgcgaggaguucacaagaaaaguucggucuaaugcugccaucggagcuguguuugucgacgagaaccaguggaauagcgccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcgucgagggggagggacugcauaaacucggcuauauccugagagacauuucuaagaucccugggggaaauauguacgccgaugacacagcuggcugggauacccggaucacagaagacgaucuucagaacgaggcccgcauuaccgacaucauggaacccgagcacgcgcugcucgccaaaagcauuuuuaagcugacguaucaaaauaaaguggucagagugcagcggccugcuaagaacgggaccguuauggaugugaucucccgcagagaccagcggggcucuggacaggucggcacauacgggcugaauaccuucacaaacauggaagcccaacucauuagacagauggagagcgagggaaucuuuucccccagcgaacuggagaccccgaaccuugcugaacgcgugcuggauuggcucgagaaguauggcguggaacggcugaaaagaauggccaucucuggggacgacuguguugugaagccuauugaugaccgcuucgcgacggcccuuacagcucugaaugauaugggaaaaguccggaaggacaucccccagugggagccuuccaaaggcuggaacgauuggcagcaagugcccuuuugcagccaucacuuccaccagcucauuaugaaggacgggagagagaucguugugccuugucgcaaucaggaugaacuggucggccgggccagagugucucagggagcuggcuggucccugcgcgagaccgccugccucggaaagagcuacgcucaaauguggcagcugauguauuuucaucggagagaccuucgccuggccgcgaacgccauuuguuccgcuguccccguggauuggaucccgacaucucggaccacguggagcauucacgcccaucaccaguggaugaccacagaagacaugcucuccguuuggaauagaguguggaucgaggaaaacccuuggauggaggauaaaacccauaucagcucuuggggagacguccccuaccugggcaagcgggaggaccaauggugcgggucccuuauuggacugacagccagagcuaccugggccacaaauauccagguggcgauuaaccagguucgccggcucaucggcaaugaaaacuaccuggauuauaugaccagcaugaaaagauucaagaaugagucugaccccgaaggggcucugugguga

SEQ ID NO: 19317 - RNA, 9879 nt, Artificial Sequence
  derived and/or modified CDS sequence (opt5) from DENV-1__EU482515__SS-prME
agcgugaccacacugcucaugcugaugcccacggcccuugcuuuccaccugaccacccggggaggggaaccucauaugauuguguccaagcaggaacggggaaaaucucuccuguuuaagaccagcgccggcguuaacaugugcacacuuauugcgauggaccugggggaacucugugaagauaccaugacauacaaaugccccagaaucaccgagacggaacccgacgauguggacuguuggugcaaugcuaccgauacaugggugaccuauggaacauguucccaaaccggcgagcaccggcgggacaagcgcucuguggcccuggccccucauguggggcugggacucgagacgagaacagaaaccuggaugagcuccgagggcgcuuggaaacagauucagcggguugaaacaugggcccugcgccaccccggcuucaccgugaucgcucuuuuucuggcccaugcgauugggaccucuaucacacagaagggaaucauuuucauccuccugaugcuugucacgccuagcauggccaugagaugcgugggcauugggucccgggauuuuguugagggacugagcggcgcuaccuggguggacgucgugcucgagcacgggucuugugugacaaccauggccaaggauaaacccacacuggacaucgaacugcucaagaccgaggucacgaacccugcuguucugcgcaaacuuugcauugaagccaagaucuccaauacaaccaccgauagcagauguccgacacaaggagaggcgacccugguggaagaacaggacgccaacuucgugugccggcgcacauuugucgauagaggcuggggcaauggguguggacucuucggcaaagggucucugauuacgugcgcuaaguuuaagugcgugaccaaacuugagggaaagaucguucaguacgaaaaccugaaauauuccgugaucgucacagugcacaccggcgaccagcaucaaguugggaaugagagcacagaacacggaaccacggccaccauuacaccccaggcuccuaccacagagauccagcucaccgacuacggcgcccugacgcuggauuguucuccccggacaggccucgacuucaacgaaauggugcugcuuaccaugaaggagaaauccuggcugguccauaagcagugguuucucgaucugccucuucccuggacaagcggggccuccaccucucaagagaccuggaaucgccaggaccugcucgugacauucaaaacggcucacgcgaagaagcaggaagucgugguucugggaagccaagagggcgccaugcacaccgcucugacaggggccaccgaaauucagacauccggaaccacgacaaucuuugccggccaucucaaaugcagacugaagauggauaaacuuacccugaaggggaugagcuaugugauguguaccggcucuuucaaacucgagaaggaacuggcugagacacagcacggaaccguccuggugcagauuaaguacgagggcacagacgccccgugcaaaaucccuuucuccacgcaagaugaaaaggggguuacccagaacggacggcuuaucacagcgaaucccauugugaccgacaaagagaagccugucaacaucgaagcugagccgcccuuuggcgagagcuauauugugaucggggccggagaaaaagcccucaagcugucuugguucaagaaaggcagcuccauugggaagauguuugaggcuacagccagaggcgcucgccggauggccauccugggagauaccgcgugggacuucggcucuaucgggggaguguuuacgagcguuggcaaacucguccaucagauuuucgggaccgccuacggagugcuguuuuccggcgugagcuggacaaugaagaucgggauuggcguccuucugaccuggcucggacucaauucuagauccacaagccugucuaugaccuguaucgcugugggccuuguuacacucuaccugggggugaugguccaggccgauuccggaugcgugauuaacuggaaaggccgcgaacugaagugugggagcggaaucuucguuaccaaugaggugcacacguggacagaacaauauaaguuucaggcugacuccccuaaacggcucucugccgcgauuggcaaggccugggaggagggggucugcggcaucagaagcgcuacccgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauacaaccuuuaucauugaugggccuaacacgcccgaauguccugacgaucagagagcuuggaauaucugggagguggaggacuacggauucggcauuuuuacaaccaacaucuggcugaaacuucgcgauuccuauacacaggucugcgaccaccggcucaugagcgcggccauuaaagauucuaaggcuguucacgccgacaugggcuacuggaucgaauccgagaaaaaugaaaccuggaagcuggccagagcuagcuucaucgaggugaagacauguauuuggcccaaaucucauacccugugguccaacggggugcucgaaagcgagaugaucauuccgaagaucuauggaggcccuaugucucaacacaauuaccgccccggguacuucacgcagaccgccggaccuuggcaucugggcaaacuugagcuggauuuugaccucugcgaagggacaaccgucgugguugaugagcacugcggaaaccggggccccagccugagaacaaccacggugacaggcaagauuauccacgaaugguguugccgguccuguacccugccuccccuucgcuucagaggggaggacggaugcugguauggcauggagauccggccggucaaagaaaaggaggaaaaucucgucaagagcaugguuucugcgggguccggagagguggacagcuuuucccugggccugcucuguauuucuaucaugauugaagaggucaugagaagccgcugguccaaaaagaugcugaugacagggacccuugcuguguucuuucugcucaucaugggacagcugaccuggaacgaucugauucggcuuugcaucaugguuggcgccaaugccucugacagaaugggcauggggacaacguaccuggcucucauggccaccuucaaaaugcgcccuauguuugcggugggacugcuguucagacggcugacaagccgcgagguccuucugcucaccauuggccugucccugguggcuucuguggaacuucccaacagccuggaggaacucggggauggacuggccaugggcaucaugauccucaagcugcuuacagacuuucaaucccaucagcugugggccacccuccugagccugacguucauuaaaacaaccuuuucucuucacuaugcuuggaagaccauggccaugguccuguccaucguuagccucuucccccugugucucucuacaaccucccagaagacaacguggcugccugugcuucuggggagccugggaugcaaaccgcucaccauguuucugauugcugagaauaagaucuggggcagacggucuuggccccuuaacgaaggcauuauggccguggggaucgucuccauccugcucagcucccugcucaaaaacgaugugccucuggcgggaccccuuauugccggcgggaugcugaucgcuuguuacguuauuagcggaucuagcgccgaccugucccucgagaaggcugccgaggugucuugggaagaggaagccgagcauagcggcgcuucccacaauauccuggucgaagugcaggaugacgggacaaugaaaauuaaggaugaggagcgcgacgauacccuuacaauccugcucaaagcgacccugcucgccguuucuggaguguauccucugagcauccccgcuacgcuuuucgucugguacuucuggcaaaagaagaaacagagauccggcgugcugugggacaccccuucucccccggaagucgagcgggccgugcuggaugacggcauuuaucgcaucaugcagagagggcuccugggacggagccagguuggcgugggggucuuucaagaaaacguguuccauacaauguggcacguuacccgcggagccgugcuuauguaccagggcaagagacuggagccuuccugggcuagcgucaaaaaggaccucauuucuuacgggggaggcuggcggcugcagggcuccuggaauacaggggaggaaguccaggugaucgccguugagcccggcaagaacccuaagaauguccaaaccgcgcccggcacauuuaagacgccggaaggggaggugggagcuauugcccucgauuucaaaccuggcaccagcgggucucccaucgugaacagagaaggaaagauugucggccuguauggcaauggggugguuacaaccuccggaaccuacgugagcgccaucgcucaggccaaagcgucccaggagggcccucuucccgagaucgaagacgaggucuuucgcaagcggaaccugacaauuauggaucugcaccccgggucuggaaaaacgagacgcuaucucccugcuaucgugcgggaagccauuaagagaaagcugcgcacccuuauccuggccccgacacggguuguggcuagcgagauggccgaagcucucaaaggcaugcccauuagauaccaaaccacagccgucaaguccgagcauaccgggaaagagaucguggaccugaugugccacgcgacguucacaaugcgccugcucagcccuguucgggugcccaauuauaacaugaucauuauggaugaagcccauuuuaccgacccuucuuccaucgcugccagaggcuacauuagcacccgggucggaaugggcgaggcugccgccaucuucaugacagcuacacccccugggucuguggaagcguuuccgcagagcaaugccgugauucaggaugaggaacgcgacauccccgagagauccuggaacucuggauaugaguggaucacagauuucccuggcaagaccgucugguuuguucccagcauuaaauccgggaaugacaucgcuaacugucuucggaagaauggaaagcgcgugauucagcugucuagaaaaacguucgauacagaauaccaaaagaccaaaaacaacgacugggacuacguggucacaaccgauaucagcgagaugggcgccaauuuccgggccgacagagugauugauccucgccggugccugaagcccguuauccucaaagacgggccggaaagagugauucuggcuggcccuaugcccgucacgguggccuccgcggcucagcgccggggaagaaucggccgcaaccacaauaaggagggggaucaguauaucuacaugggacagccccuuaacaaugacgaggaucaugcccacuggaccgaagccaagaugcugcucgacaacauuaauacaccugagggcaucauucccgcucuguuugaaccugagcgggaaaagagcgccgcgaucgauggggaguauagacugcgcggagaggccagaaagaccuucguugagcucaugcggcgcggcgaccuuccgguguggcugucuuacaaagucgcuuccgagggguuucaauauagcgauagacgguggugcuucgacggcgaacgcaacaaucaggugcuggaggaaaacauggaugucgagauuuggacaaaggagggagaacgcaagaagcuccggcccagauggcuggacgcccgcaccuacuccgacccucuugcucugcgggaguuuaaagaguucgccgcuggcagacgcucugugagcggggaucucauccuggagaucggaaagcugccccagcaccucacacagcgggcccaaaaugcgcuugacaaccugguuaugcugcauaauuccgaacagggcgggagagccuaucggcacgcuauggaggagcucccugauaccauugaaacgcugaugcuucuggcccucaucgcugugcugacaggaggcgugacccuguuuuuccucucuggccgcgggcuuggaaagaccagcauuggccugcugugugucauggccuccagcguucuccuguggauggccucuguggagccccauuggaucgcugcguccauuauccuugaauuuuuccugauggugcuccugaucccggagccugacagacagcggacaccccaggauaaccaacuggccuacgucgugauugggcuccuuuuuaugauccugaccguugcugccaaugagaugggacugcucgaaacaacgaaaaaggaccugggcauugggcacguggccgucgagaaccaccaucacgcugccaugcuugauguggaccugcauccugcgagcgccuggacccucuacgcugucgccacaaccaucauuacacccaugaugcgccacaccaucgaaaacacgaccgcuaauauuucucugacagccaucgcgaaccaggccgcuauccugaugggacucgauaaaggcuggccuauuuccaagauggacaucggcgugccccuucuggcccuggggugcuauagccagguuaauccgcucacccugacagcugccgugcuuaugcuggucgcucauuacgccauuaucggaccuggccuccaagcgaaagccaccagagaggcucagaagcggacggccgcugggauuaugaagaaccccacaguggauggaaucguugccaucgaccuggaucccguggucuaugacgccaaauucgaaaagcagcugggccagauuaugcuccuuauccuguguaccucucaaauucugcucaugcgcacaaccugggcgcugugcgagagcaucacccuugcuacagggccucugacgacccucugggagggauccccgggcaaauuuuggaauacaaccauugccgugucuauggcuaacaucuucagaggcagcuaccuggccggggccggacuggcuuucucccucaugaaaagccuuggcgggggacggcgcggcacaggggcccagggagaaacccugggcgagaaauggaagagacagcugaaucagcucuccaagucugaauuuaacacguauaaacggagcggcaucauggagguggacagauccgaagcgaaggaggggcugaaacgcggagagacaaccaagcacgccguuucucggggcaccgcuaaacuuagaugguucgucgaacgcaaucuggugaagcccgaggggaaggugauugaucucggauguggcagaggcggguggagcuacuauugcgccgggcugaaaaaggucacagaaguuaaaggcuacaccaaagggggaccuggccacgaggaacccaucccuauggcuacauacggguggaaccuggugaaacuccauuccggaaaggacguguuuuucauucccccugagaaaugugauacgcuucugugcgacaucggcgagucuagcccgaaucccaccauugaagaggggagaacacugcgcguccucaagaugguggaaccuuggcugcggggaaaccaauuuuguaucaagauucuuaaucccuauaugccuuccguuguggagacccuggagcagaugcagagaaaacacggcggcaugcucguccgcaacccccugagcagaaauucuacacaugaaauguacuggguguccugcgggaccggaaacaucguuagcgccgugaauaugacgucuagaaugcugcucaaccgcuucaccauggcgcaccggaagccgacauaugagagagaugucgaccugggcgccgggacccgccacguggcuguggaaccugaggucgccaaccuugauaucauuggacagagaaucgaaaauauuaaacaugagcacaaguccacauggcauuacgacgaggauaaccccuauaaaaccugggcuuaccacggcagcuaugaaguuaagcccucuggguccgccagcuccauggugaauggaguggucaagcugcucacaaaaccuugggacgugauccccaugguuacccaaauugcuaugacggauacaaccccuuuuggccagcagcggguguucaaggagaaagucgacacccgcacaccgaaggccaaaagaggcacggcgcaaaucauggaagugaccgccaaguggcuguggggguuucuuagccggaacaagaaacccagaaucuguacacgggaggaguucacccgcaagguuagaucuaaugcugccauuggagcuguguuugucgacgagaaccaguggaauagcgccaaagaggccguggaagaugagcgguucugggaccugguucaucgcgaaagagagcuccacaagcagggcaaaugcgcgacaugcguguacaacaugauggggaagcgggaaaagaaacugggagaguuuggcaaggcuaaagggucccgcgccaucugguacauguggcugggcgccagauuccucgaguucgaagcucugggauuuaugaaugaggaucacugguucucucgggaaaacagccuuuccggcgucgagggggagggacugcauaagcucggcuauauucugcgcgacaucucuaaaauuccugggggaaauauguacgccgaugacaccgcuggcugggauacaagaaucaccgaagacgaucuucagaacgaggcccggaucacggacauuauggaacccgagcacgcgcugcucgccaagagcaucuuuaaacugaccuaucaaaauaaggugguccgcgugcagagaccugcuaagaacgggacaguuauggaugugauuucccggcgcgaccagagaggcucuggacaggucggcaccuacgggcugaauacauucaccaacauggaagcccaacucauccggcagauggagagcgagggaaucuuuucccccagcgaacuggagacgccgaaccuugcuaaaagagugcuggauuggcucgaaaaguauggcguggagcgccugaaacggauggccaucucuggggacgacuguguugugaagccuaucgaugacagauucgcgacagcccuuaccgcucugaaugauaugggaaaaguccgcaaggacauuccccagugggaaccuuccaagggcuggaacgauuggcagcaagugcccuuuugcagccaucacuuccaccagcucaucaugaaagacgggcgggagauuguugugccuuguagaaaucaggaugagcuggucggccgcgcccgggugucucagggagcuggcuggucccugagagaaacagccugccucggaaagagcuacgcucaaauguggcagcugauguauuuucaucgccgggaccuuagacuggccgcgaacgccaucuguuccgcuguccccguggauuggauuccgaccucucgcacgaccuggagcauccacgcccaucaccaguggaugacaaccgaggacaugcucuccguuuggaaucggguguggauugaagagaacccuuggauggaagauaaaacacauaucagcucuuggggagacguccccuaccugggcaagagagaggaccaauggugcgggucccuuaucggacugaccgcccgggcuacaugggccaccaauauucagguggcgaucaaccagguuagacgccucauuggcaaugagaacuaccuggauuauaugacgagcaugaaacgguucaagaaugaaucugaccccgagggggcucugugguga

SEQ ID NO: 19318 - RNA, 9879 nt, Artificial Sequence
  derived and/or modified CDS sequence (opt5) from DENV-1__EU482516__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacacugucucuucacuaugcuuggaaaaccauggccaugguucuguccauugugagccucuuuccccugugucucucuaccacaucccagaagaccacauggcugccugugcuucuggggagccugggaugcaagccgcucacgauguuccugaucgcugagaauaaaauuuggggccggcgcucuuggccccuuaacgaaggcaucauggccgucgggaucguguccauucugcucagcucccugcucaagaacgauguuccucuggcgggaccccuuaucgccggcgggaugcugauugcuuguuacgugaucagcggaucuagcgccgaccugucccucgagaaagcugccgaggucucuugggaagaggaagccgagcauagcggcgcuucccacaauauucugguggaaguucaggaugacgggaccaugaagaucaaagaugaggagagagacgauacacuuaccauccugcucaaggcgacacugcucgccgugucuggagucuauccucugagcauucccgcuacccuuuuugugugguacuucuggcagaagaagaagcagcgguccggcguccugugggacacgccuucucccccggaagugggccgcgccguucuggaugacgggaucuauagaauuaugcagcggggacuccugggccgcagccaggugggggucggaguguuccaagagaacguuuuucauaccauguggcacgugacaagaggcgccguccuuauguaccaggggaaacggcuggaaccuuccugggcuagcgugaagaaagaccucaucucuuacggaggcggcuggagacugcagggguccuggaauaccggagaggaggugcagguuauugccgucgaacccggcaagaacccuaaaaaugugcaaacagcgcccgggaccuucaagacaccggagggagaagugggcgcuaucgcccucgauuuuaagccugggacgagcggaucucccauugucaaccgcgagggcaaaaucgugggccuguaugggaauggaguugugaccacauccggcaccuacgucagcgccaucgcucaggccaaggcgucccaggaagggccucuucccgagauugaggacgaaguguuccggaaaagaaaccugaccaucauggaucugcaccccggaucuggcaagacacgccgguaucucccugcuauuguuagagaggccaucaaacgcaagcugcggacgcuuauucuggccccgaccagaguggucgcuagcgaaauggccgaggcucucaaggggaugcccauccgcuaccaaacaaccgccgugaaauccgaacauacaggcaaggagaucguugaccugaugugccacgcgaccuuuacgaugcggcugcucagcccugugagaguccccaauuauaacaugauuaucauggaugaggcccauuucacagacccuucuuccauugcugcccggggauacaucagcacccgcgugggcaugggggaagcugccgccauuuuuaugaccgcuacacccccuggaucuguggaggcguucccgcagagcaaugccgucauccaggaugaagagagagacauccccgaacgguccuggaacucuggcuaugaguggauuaccgauuuuccugggaaaacaguuugguucgugcccagcaucaaguccggaaaugacauugcuaacugucuucgcaaaaauggcaagagagugauccagcugucucggaagaccuuugauacggaguaccagaaaaccaagaacaacgacugggacuacgucgugaccacagauauuagcgaaaugggggccaauuucagagccgaccgcguuaucgauccucggagaugccugaaacccgugauucucaaggacggcccggagcgcgucauccuggcuggaccuaugcccgugaccguugccuccgcggcucagcggagaggccgcaucgggcggaaccacaauaaagaaggagaucaguauauuuacaugggccagccccuuaacaaugacgaggaucaugcccacuggacggaggccaagaugcugcucgacaacaucaauaccccugaagggauuauccccgcucuguucgagccugaaagagaaaagagcgccgcgauugauggagaauaucgccugagaggcgaggcccggaaaacauuuguggagcucaugcgcagaggggaccuuccggucuggcugucuuacaagguggcuuccgaaggcuuccaauauagcgaucggcgcuggugcuuugacggagagagaaacaaucagguccuggaagagaacauggauguggaaaucuggaccaaagagggcgagcggaagaaacucagaccccgcuggcuggacgcccggacauacuccgacccucuugcucugagagaguucaaggaguuugccgcugggcgccggucuguuagcggagaucucauccuggaaauuggcaaacugccccagcaccucacccagagagcccaaaaugcgcuugacaaccuggugaugcugcauaauuccgagcaagggggacgggccuaucgccacgcuauggaggaacucccugauacaaucgagacccugaugcuucuggcccucauugcugugcugacgggcggcgucacacuguucuuucucucugggagaggacuuggcaagaccagcaucgggcugcuguguguuauggccuccagcgugcuccuguggauggccucuguggaaccccauuggauugcugcguccaucauccuugaguucuuucugaugguccuccugauuccggaaccugaccggcagcgcacaccccaggauaaccaacuggccuacgugguuaucggacuccuuuucaugauucugacaguggcugccaaugagaugggccugcucgagaccacaaagaaagaccuggggaucggacacgucgccguggaaaaccaccaucacgcugccaugcuugaugucgaccugcauccugcgagcgccuggacgcucuacgcuguggccaccacaauuaucacccccaugaugagacacacaauugagaacaccacggcuaauaucucucugaccgccaucgcgaaccaggccgcuauucugaugggccucgauaagggcuggccuaucuccaaaauggacauugggguuccccuucuggcccugggaugcuauagccaggugaauccgcucacacugaccgcugccguccuuaugcugguggcucauuacgccaucauuggcccugggcuccaagcgaaggccacacgggaagcucagaaacgcaccgccgcuggaaucaugaagaaccccacgguugauggcaucguggccauugaccuggaucccgucguguaugacgccaaguuugagaaacagcuggggcagaucaugcuccuuauucuguguacaucucaaauccugcucaugagaaccacaugggcgcugugcgaaagcauuacccuugcuaccggaccucugacaacgcucugggagggcuccccgggcaaguucuggaauaccacaaucgccgugucuauggcuaacaucuuucgggggagcuaccuggccggagccggccuggcuuucucccucaugaaaagccuugggggaggccgcagagggaccggagcccagggcgagacacugggcgaaaaguggaaacggcagcugaaucagcucuccaagucugaguucaacaccuauaagagaagcgggauuauggaaguugaccgcuccgaggcgaaagaaggacugaagcggggcgagacgacaaaacacgccgucucuagagggaccgcuaaacuucgcugguuuguggagcggaaucuggugaaacccgaaggaaaggucaucgaucucggcugugggagaggaggcuggagcuacuauugcgccggccugaagaaaguuaccgaggugaagggguacacaaaaggaggcccugggcacgaggaacccauuccuauggcuaccuacggauggaaccuggugaagcuccauuccggcaaagacgucuucuuuauucccccugaaaagugugauacacuucugugcgacauuggggagucuagcccgaaucccacgaucgaggaaggacgcacccugcgggugcucaaaaugguugagccuuggcugagaggcaaccaauucuguauuaagauccuuaaucccuauaugccuuccguggucgaaacacuggagcagaugcagcgcaagcacggcgggaugcucgugcggaacccccugagcagaaauucuacccaugagauguacuggguuuccugcggaacaggcaacaucgugagcgccgucaauaugaccucucgcaugcugcucaaccgguuuacgauggcgcacagaaaaccgaccuaugaacgcgauguggaccugggggccggaacaagacacguggcugucgagccugaaguugccaaccuugauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaagcugcucaccaagccuugggacguuauucccauggugacacaaaucgcuaugaccgauacgacaccuuucggccagcagcgcgucuuuaaagaaaagguggacaccagaaccccgaaagccaagcgggggacagcgcaaaucauggagguuacggccaaauggcuguggggauuccuuagcagaaacaagaagccccggauuuguacccgcgaagaguuuacaagaaaagugcggucuaaugcugccaucggcgcugucuucguggacgaaaaccaguggaauagcgccaaggaggccguugaggaugaacgcuuuugggaccuggugcauagagagcgggaacuccacaaacaggggaagugcgcgaccugcgucuacaacaugaugggaaaacgcgagaagaagcugggcgaguucgggaaagcuaagggcuccagagccauuugguacauguggcugggagcccgguuucucgaguucgaggcucugggcuucaugaaugaagaucacugguuuucucgcgagaacagccuuuccgggguggaaggagagggccugcauaaacucggguauauccugagagacauuucuaauaucccuggaggcaacauguacgccgaugacacagcugggugggauacccggaucacagaggacgaucuucagaaugaagcccgcauuaccgacaucauggagcccgaacacgcgcugcucgccaagagcauuuucaaacugacguaucaaaacaaggucgugagaguucagcggccugcuaaaaauggcaccgugauggaugucaucucccgcagagaccagcggggaucuggccagguggggacauacggacugaacaccuuuacaaacauggaggcccaacucauuagacagauggaaagcgagggcaucuucucccccagcgagcuggaaaccccgaaucuugcugagcgcgugcuggauuggcucgaaaaguaugggguugagcggcugaagagaauggccaucucuggagacgacuguguggucaaaccuauugaugaccgcuuugcgacggcccuuacagcucugaacgauaugggcaaggugcggaaagacaucccccagugggaaccuuccaagggguggaaugauuggcagcaaguucccuucugcagccaucacuuucaccagcucauuaugaaagacggcagagagaucguggucccuugucgcaaccaggaugagcuggugggacgggccagagucucucagggcgcuggguggucccugcgcgaaaccgccugccucggaaagagcuacgcucaaauguggcagcugauguauuuccaucggagagaccuucgccuggccgcgaaugccauuuguuccgcugugcccguugauuggaucccgacaucucggaccacguggagcauucacgcccaucaccaguggaugaccacagaggacaugcucuccguguggaacagagucuggaucgaagagaauccuuggauggaagauaagacccauaucagcucuuggggcgacgugcccuaccuggggaaacgggaggaccaauggugcggaucccuuauuggccugacagccagagcuaccugggccacaaacauccagguugcgauuaaucaggugcgccggcucaucgggaacgagaauuaccuggauuauaugaccagcaugaagagauuuaaaaacgaaucugaccccgagggcgcucugugguga

SEQ ID NO: 19319 - RNA, 9879 nt, Artificial Sequence
  derived and/or modified CDS sequence (opt5) from DENV-1__EU482517__SS-prME
agcgugaccaugcugcucaugcugaugcccaccgcccuugcuuuccaccugacgaccagaggaggggaaccucauaugaucguguccaagcaggaacggggaaagucucuccuguuuaagacaagcgccggcguuaacaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaacacagcucacgcgaaaaagcaggaagucgugguucugggaagccaagagggcgccaugcacacggcucugaccggggccacagaaauucagaccuccggaacaaccacgaucuuugccggccaucucaagugcagacugaaaauggauaaacuuacacugaaagggaugagcuaugugauguguaccggcucuuucaagcucgagaaagaacuggcugagacccagcacggaacaguccuggugcagauuaaguacgagggcaccgacgccccgugcaagaucccuuucuccacacaagaugaaaaagggguuacgcagaauggacggcuuaucaccgcgaaccccauugugacagacaaggagaaaccugucaauaucgaagcugagccgcccuuuggcgagagcuauauugugaucggggccggagaaaaggcccucaaacugucuugguucaagaagggcagcuccauugggaaaauguuugaggcuaccgccagaggcgcucgccggauggccauccugggagauacagcgugggacuucggcucuaucgggggaguguuuaccagcguuggcaagcucguccaucagauuuucgggacggccuacggagugcuguuuuccggcgugagcuggaccaugaaaaucgggauuggcguccuucugacauggcucggacugaacucuagauccaccagccugucuaugacauguaucgcugugggccuuguuacccucuaccugggggugaugguccaggccgauuccggaugcgugauuaauuggaagggccgcgaacugaaaugugggagcggaaucuucguuacaaacgaggugcacaccuggacggaacaauauaaguuucaggcugacuccccuaagcggcucucugccgcgauuggcaaagccugggaggagggggucugcggcaucagaagcgcuacacgccuggaaaacaucauguggaagcagauuuccaaugagcuuaaccauauccugcucgaaaaugacaugaaauucaccgugguugugggagaugucgccggcauucuggcucaggggaagaaaaugauccggccgcaacccauggagcacaaguacucuuggaaaagcuggggaaaggccaagauuaucggcgccgacgugcagaacaccacauuuaucauugaugggccuaauacccccgaauguccugacgaucagagagcuuggaacaucugggagguggaggacuauggauucggcauuuuuacgacaaauaucuggcugaaacuucgcgauuccuacacccaggucugcgaccaccggcucaugagcgcggccauuaaggauucuaaagcuguucaugccgacaugggcuauuggaucgaauccgagaagaacgaaacauggaaacuggccagagcuagcuucaucgaggugaagaccuguauuuggcccaagucucacacacugugguccaauggggugcucgaaagcgagaugaucauuccgaaaaucuacggaggcccuauuucucaacauaacuaucgccccggguacuucacccagacggccggaccuuggcaccugggcaaacuugagcuggauuuugaccucugcgaagggaccacagucgugguugaugagcacugcggaaaucggggccccagccugagaaccacaaccgugacgggcaaaaucauccaugaaugguguugccgguccuguacacugccuccccuucgcuucagaggggaggacggaugcugguacggcauggagauucggccggucaaggaaaaagaggaaaaccucgucaagagcaugguuucugcgggguccggagagguggacagcuuuucccugggccugcucuguaucucuauuaugaucgaagaggucaugagaagccgcuggucccggaagaugcugaugaccgggacacuugcuguguucuuucugcucauuaugggacagcugaccuggaaugaucugaucagacuuugcauuaugguuggcgccaacgccucugaccgcaugggcauggggaccacauaucuggcucucauggccacguucaaaaugagaccuauguuugcggugggacuccuguuccggcgccugaccagcagagagguccuucugcucacaaucggccugucccugguggcuucuguggaacuucccaauagccuggaggaacucggggauggacuggccaugggcaucaugauucucaagcugcuuaccgacuuucaaucccaccagcugugggccacacuccugagccugaccuucaucaaaacgacauuuucucuucauuacgcuuggaagaccauggccaugguccuguccauuguuagccucuucccccugugucucucuaccacaucccagaaaaccacauggcugccugugcuucuggggagccugggaugcaagccgcucacgauguuucugaucgcugagaacaagauuuggggccggcgcucuuggccccuuaacgaaggcaucauggccguggggaucgucuccauucugcucagcucccugcucaaaaaugaugugccucuggcgggaccccuuaucgccggcgggaugcugauugcuuguuauguuaucagcggaucuagcgccgaccugucccucgagaaggcugccgaggugucuugggaagaggaagccgagcacagcggcgcuucccauaacauucuggucgaagugcaggaugacgggaccaugaaaaucaaggaugaggagagagacgauacacuuaccauccugcucaaagcgacacugcucgccguuucuggaguguacccucugagcauucccgcuacccuuuucgucugguauuucuggcaaaagaaaaagcagcgguccggcgugcugugggacacgccuucucccccggaagucgagcgcgccgugcuggaugacggcaucuacagaauuaugcagcgggggcuccugggacgcagccagguuggcgugggggucuuucaagaaaauguguuccacaccauguggcacguuacaagaggagccgugcuuauguaucagggcaagcggcuggagccuuccugggcuagcgucaaaaaggaccucaucucuuacgggggaggcuggagacugcagggcuccuggaacaccggggaggaaguccaggugauugccguugagcccggcaagaauccuaagaacguccaaacagcgcccggcaccuuuaaaacaccggaaggggaggugggagcuaucgcccucgauuucaagccuggcacgagcgggucucccauugugaaucgcgaaggaaagaucgucggccuguacggcaacggggugguuaccacauccggaaccuaugugagcgccaucgcucaggccaaagcgucccaggagggcccucuucccgagauugaagacgaggucuuucggaagagaaaucugaccaucauggaucugcaucccgggucuggaaaaacacgccgguaccucccugcuauugugagagaagccaucaagcgcaaacugcggacgcuuauucuggccccgaccagaguuguggcuagcgagauggccgaagcucucaagggcaugcccauccgcuaucaaacaaccgccgucaaguccgagcacacagggaaagagaucguggaccugaugugccaugcgaccuucacgaugcggcugcucagcccuguuagagugcccaacuacaauaugauuaucauggaugaagcccacuuuacagacccuucuuccauugcugcccggggcuauaucagcacccgcgucggaaugggcgaggcugccgccauuuucaugaccgcuacacccccugggucugcggaagccuuuccgcagagcaacgcugugauccaggaugaggaaagagacauccccgagcgguccuggaacucuggauacgaguggauuaccgauuucccuggcaagacagugugguuuguccccagcaucaaauccgggaacgacauugccaauugucuucgcaagaacggaaaaagaguuauccagcugucucggaagaccuucgauacggaauaucaaaagaccaagaauaaugacugggacuacguggugaccacagauauuagcgagaugggcgccaacuucagagcugaccgcgucaucgauccucggagaugccugaagcccgugauucucaaagacgggccggaacgcguuauccuggccggcccuaugcccgugaccgucgcguccgcugcccagcggagaggacgcaucggccggaaucauaacaaggagggggaucaguacauuuauaugggacagccccuuaauaacgacgaggaucacgcccacuggacggaagcuaaaaugcugcucgacaauaucaacaccccugagggcauuauccccgcccuguuugaaccugagagagaaaagagcgcggccauugauggggaguaccgccugagaggagaggcucggaagacauucguggaacucaugcgcagaggcgaccuuccgguuuggcugucuuauaaaguggccuccgagggguuucaauacagcgaucggcgcuggugcuucgacggcgaaagaaauaaccagguccuggaggaaaauauggauguggagaucuggaccaaggagggagaacggaaaaagcucagaccccgcuggcuggacgcucggacauauuccgacccucuugcccugagagaguuuaaagaguucgcugccggccgccggucugucagcggggaucucauccuggagauuggaaagcugccccagcaucucacccagagagcgcaaaacgcccuugacaaucuggugaugcugcacaacuccgaacagggcgggcgggcuuaccgccaugccauggaggagcucccugauacaaucgaaacccugaugcuucuggcucucauugccguucugacgggaggcgugacacuguuuuuccucucuggcagagggcuuggaaaaaccagcaucggccugcugugugugauggccuccagcguccuccuguggauggcuucuguugagccccacuggauugcggccuccaucauccuugaauuuuuccugauggugcuccugauuccggagccugaccggcagcgcacaccccaggauaaucaacuggcuuauguggucaucgggcuccuuuuuaugauucugacaguggccgccaacgagaugggacugcucgaaaccacaaagaaggaccugggcaucgggcacguugcuguggagaaccaucaccaugccgcgaugcuugaugucgaccugcacccugccagcgcuuggacgcucuacgccguggcuaccacaauuaucacccccaugaugagacauacaauugaaaauaccacggccaacaucucucugaccgcgaucgccaaucaggcugccauucugaugggacucgauaaaggcuggccuaucuccaagauggacauuggcgucccccuucuggcucuggggugcuacagccaggugaacccgcucacacugaccgccgcuguucuuaugcugguggcccacuaugcgaucauuggaccuggccuccaagccaaagcuacacgggaggcccagaagcgcaccgcugccgggaucaugaaaaaucccacggucgauggaaucguggccauugaccuggaucccguuguguacgacgcgaaguucgaaaagcagcugggccagaucaugcuccuuauucuguguacaucucaaauccugcucaugagaaccacaugggcucugugcgagagcauuacccuugccaccgggccucugacaacgcucugggagggauccccgggcaaauuuuggaacaccacaaucgcugucucuauggccaauaucuuccggggcagcuaucuggccggggcuggacuggccuucucccucaugaaaagccuuggcgggggacgcagaggcaccggggcgcagggagaaacacugggcgagaaauggaagcggcagcugaaccagcucuccaaaucugaauuuaauaccuacaagagaagcggcauuauggagguggaccgcuccgaagccaaggaggggcugaaacggggagagacgacaaagcacgcugugucuagaggcaccgccaaacuucgcugguucguugaacggaaccuggucaagcccgaggggaaagugaucgaucucggauguggcagagggggauggagcuauuacugcgcuggccugaagaaggugaccgaagucaaaggcuauacaaaaggcgggccugggcaugaggaacccauuccuauggccaccuacggguggaaucugguuaaacuccacuccggaaaggacguguuuuucauucccccugagaaaugugauacacuucugugcgacauuggcgagucuagcccgaaccccacgaucgaagaggggcgcacccugcgggugcucaagauggucgaaccuuggcugagaggaaaucaauuuuguauuaaaauccuuaaccccuacaugccuuccgugguugagacacuggagcagaugcagcgcaagcauggcggcaugcucgugcggaauccccugagcagaaacucuacccacgaaauguauugggucuccugcgggacaggaaauaucgugagcgcgguuaacaugaccucucgcaugcugcucaaccgguucacgauggcccacagaaagccgaccuacgagcgcgauguggaccugggcgcugggacaagacaugucgccguggaaccugagguggcuaaucuugauauuaucggacagcggauugaaaacaucaaacacgagcauaaguccaccuggcacuaugacgaggauaaucccuacaaaacaugggccuaucauggcagcuacgaagucaagcccucuggguccgcuagcuccaugguuaacggaguggugaaacugcucaccaagccuugggacgucauucccauggugacacaaaucgccaugaccgauacgacaccuuuuggccagcagcgcguuuucaaggagaaaguggacaccagaaccccgaaggcgaaacggggcacagcccaaaucauggaagucacggcuaaguggcuguggggguuucuuagcagaaauaaaaagccccggauuuguacccgcgaggaguucacaagaaaggugcggucuaacgccgcuaucggagccguuuuuguggacgagaaucaguggaacagcgccaaagaggcggucgaagaugagcgcuucugggaccuggugcacagagaacgggagcuccacaagcagggcaaaugcgcuaccugcguuuauaauaugauggggaagcgcgagaagaagcugggagaguuuggcaaggccaaaggguccagagccauuugguacauguggcugggcgcucgguuccucgaguucgaagcccugggauuuaugaacgaggaucauugguucucucgcgaaaauagccuuuccggcguggagggggagggacugcacaagcucggcuacauccugagagacauuucuaaaaucccugggggaaacauguaugcugaugacacagccggcugggauacccggaucacagaagacgaucuucagaaugaggcgcgcauuaccgacaucauggaacccgagcaugcccugcucgcuaagagcauuuuuaaacugacguaccaaaacaaggucgugagaguccagcggccugccaaaaaugggaccgugauggauguuaucucccgcagagaccagcggggcucuggacaggugggcacauaugggcugaacaccuucacaaacauggaagcucaacucauuagacagauggauagcgagggaaucuuuucccccagcgagcuggaaaccccgaaucuugccgagcgcguccuggacuggcucgaaaaguacggcguggagcggcugaagagaauggcgaucucuggggacgauugugugguuaaaccuauugacgaucgcuucgccacggcucuuacagcccugaacgacaugggaaaggugcggaaagauaucccccagugggaaccuuccaagggcuggaaugacuggcagcaaguccccuuuugcagccaccacuuccaucagcucauuaugaaagaugggagagagaucgugguuccuugucgcaaccaggacgagcuggugggccgggcuagagucucucagggagccggcuggucccugcgcgaaaccgcuugccucggaaagagcuaugcccaaauguggcagcugauguacuuucaccggagagaucuucgccuggcggccaaugcuauuuguuccgccgugcccgucgacuggaucccgacaucucggaccacguggagcauucaugcccaccaucaguggaugaccacagaggauaugcucuccguguggaacagaguuuggaucgaagagaauccuuggauggaagacaagacccacaucagcucuuggggagacgugcccuaucugggcaaacgggaggaucaauggugcgggucccuuauuggacugacagcuagagccaccugggcgacaaacauccaggucgcuauuaaucaggugcgccggcucaucggcaacgagaauuaccuggacuacaugaccagcaugaagagauucaaaaacgaaucugaucccgagggggcccugugguga

SEQ ID NO: 19320 - RNA, 9879 nt, Artificial Sequence
  derived and/or modified CDS sequence (opt5) from DENV-1__EU482519__SS-prME
agcgugaccaugcugcucaugcugaugcccaccgcccuugcuuuccaccugacgacccggggcggggaaccucauaugaucgugaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugauggcccuuuuucuggcgcaugccaucgggaccuccauuacccagaagggaaucaucuucauucuccugaugcuugucacaccuucuauggcuaugagaugcgugggcaucgggagccgggauuuuguugagggacuguccggcgccacguggguggacgucgugcucgagcacgggagcugugugaccacaauggcuaaggauaaacccacccuggacauugaacugcucaagacagaggucaccaacccugccguucugcgcaaacuuugcaucgaagcgaagauuucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugaucacaugcgccaaguuuaagugcgucacgaaacuugagggaaaggugguucaguacgaaaaccugaaauauucugugauugucaccgugcacacaggcgaccagcaucaaguugggaaugaguccaccgaacacggaacaaccgcuacgaucacaccccaggccccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugauucagaacggacggcugaucacagcuaaucccaucgucacggacaaagagaagccugugaacauugaagccgagccgcccuuuggcgagagcuauaucgugauugggguuggagaaaaagcccuuaagcucucuugguucaagaaaggcagcuccaucgggaagauguuugaggcuaccgccagaggcgcucgccggauggccauucugggagauacagcgugggacuucggcucuaucgggggagucuuuaccagcgugggcaaacuggugcaucagaucuucgggacagccuacggaguccucuuuuccggcgugagcuggaccaugaagauugggaucggcguucugcuuacguggcugggacucaauucuagauccaccagccugucuaugacauguauugcugugggccuggucacccuuuaccucggggugaugguucaggccgauuccggaugcgugaucaacuggaaaggccgcgaacugaagugugggagcggaauuuucgucacaaaugaggugcacaccuggacagaacaauauaaguuucaggcugacuccccuaaacggcugucugccgcgaucggcaaggccugggaggaggggguuugcggcauuagaagcgcuacccgccucgaaaacaucauguggaaacagaucuccaacgagcugaaucauauucuucuggaaaacgacaugaaguucacgguggucgugggagauguggucggcauccucgcccaggggaaaaagaugauucggccgcaacccauggagcacaaauacucuuggaaaagcuggggaaaggcuaagaucauuggcgccgacguucagaauacaaccuuuaucaucgaugggccuaacacccccgaauguccugacgaucagagagccuggaauauuugggagguggaggacuauggauucggcaucuuuacaaccaacauuuggcugaagcugcgcgauuccuacacgcaggcuugcgaccaccggcuuaugagcgcggccaucaaagauucuaaggcugugcaugccgacaugggcuauuggauugaauccgagaaaaaugaaacauggaagcucgccagagcuagcuucaucgaggucaagaccuguaucuggcccaaaucucacacacugugguccaacggggugcuggaaagcgagaugguuauuccgaagaucuacggaggcccuauuucucaacauaauuaucgccccggguacuucacccagacagccggaccuuggcaccucggcaaacuggagcuugauuuugaccugugcgaagggaccacgguggucguggaugagcacugcggaaaccggggccccagccucagaaccacaaccguuacaggcaagaucauucaugaaugguguugccgguccuguacccugccuccccugcgcuucaaaggggaggacggaugcugguacggcauggagaucagaccggugaaggaaaaggaggaaaaucuugucaaaagcauggugucugcgggguccggagagguugacagcuuuucccucggccugcuguguaucucuauuaugaucgaagaggugaugcggagcagauggucccgcaagaugcucaugacggggacacuggcugucuuccuucugcucauuaugggacagcugaccuggaacgaucugacacggcuuugcaucauggugggcgccaaugccucugacagaaugggcauggggaccaccuaucuggcucucauggccacauuuaaaaugcgcccuauguucgcggugggacugcucuuuagacggcugacgagccgcgagguccuucugcucaccauuggccugucccugguugcuucuguggaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccauggugcucuccaucgucagccuguucccccucugucugucuaccaccucccagaagacaaccuggcuuccugugcugcuggggagccucggaugcaaaccgcugacaauguuucuuauugcugagaauaagaucuggggcagaaaaucuuggccccugaacgaaggcauuauggccguugggguggucuccauccuccugagcucccuccugaagaacgaugugccucuugcgggaccccugauugccggcgggaugcugaucgcuuguuauguuaucagcggaucuagcgccgaccucucccuggagaaagcugccgaggugucuugggaagaggaagccgagcacagcggcgcuucccauaauauucuugucgaagugcaggaugacgggacgaugaagaucaaagaugaggagcgggacgauacccugacaauucuccugaaggcgacccuccuggccgucucuggaguguacccucuuagcauccccgcuacacuguucguuugguauuuuuggcaaaagaaaaagcagcgcuccggcgugcugugggacaccccuucucccccggaagucgagagagccgugcucgaugacggcauuuaccggaucaugcagcgcgggcugcuuggaagaagccagguuggcgugggggucuuccaagaaaacguguuccacacgauguggcacgugacccggggagccguucugauguaucagggcaaacgccucgagccuuccugggcuagcgucaagaaagaccugaucucuuacgggggaggcuggagacuccagggcuccuggaauacaggggaggaaguccaggugauugccgucgagcccggaaagaacccuaagaaugugcaaaccgcgcccggcacauuuaaaaccccggaaggggagguuggagcuaucgcccuggauuucaagccuggcacaagcgggucucccauugugaaccgggaaggaaaaaucgucggccuuuacggcaauggggugguuacgaccuccggaacauaugugagcgccauugcucaggccaaggcgucccaggagggcccucugcccgagaucgaagacgaggucuuuagaaaacgcaaccugaccauuauggaucuccaucccgggucuggaaagacccggagauaccugccugcuaucgugcgcgaagccaucaagcggaaacuuagaacacugauucucgccccgacgcgcguuguggcuagcgagauggccgaagcucugaagggcaugcccauccgguaucaaaccacagccgucaaauccgagcacaccgggaaggagauuguggaccugaugugccaugcgacauucaccaugagacuccuuagcccugugcgcguccccaauuacaacaugaucauuauggaugaagcccacuuuacggacccuucuuccaucgcugcccggggcuauaucagcacaagaguuggaaugggcgaggcugccgccauuuucaugaccgcuacacccccugggucuguggaagcguuuccgcagagcaaugccgugauccaggaugaggaacgggacauucccgagcgcuccuggaacucuggauacgaguggaucacagauuucccuggcaaaaccgucugguuugugcccagcauuaaguccgggaaugacaucgcuaacugucugagaaagaauggaaaacggguuauccagcugucucgcaagacauucgauaccgaauaucagaagacgaagaacaacgacugggacuacguggucacaaccgauauuagcgagaugggcgccaauuuuagagccgaccgggugaucgauccuagacgcugccucaaacccguuauucugaaggacgggccggaacgggugauccuugcuggcccuaugcccgucacaguggccuccgcggcucagagacgcggacggauuggcagaaaccauaauaaggagggggaucaguacaucuauaugggacagccccugaacaaugacgaggaucacgcccacuggaccgaagccaaaaugcuccuggacaacauuaauacgccugagggcaucauccccgcucuguucgaaccugagcgcgaaaagagcgccgcgauugauggggaguaccggcucagaggagaggcccgcaaaaccuucgucgaacuuaugagacggggcgaccugccgguguggcugucuuauaagguugcuuccgagggguuucaauacagcgaucgcagauggugcuucgacggcgaacggaacaaucaggugcucgaggaaaacauggauguggagaucuggacaaaagagggagaacgcaagaaacugagaccccgguggcuugacgccagaaccuauuccgacccucuggcucuccgcgaguuuaaggaguucgccgcuggccggagaucugucagcggggaucugauucuggagaucggaaagcucccccagcaucuuacacagcgcgcccaaaaugcgcuggacaaccugguuaugcuccacaauuccgaacagggcgggcgggccuacagacaugcuauggaggagcugccugauaccauugaaacacuuaugcugcucgcccugaucgcugugcugaccggaggcgugacgcucuuuuuccuuucuggccgggggcugggaaaaacaagcaucggccugcucugugucauggccuccagcgugcugcuuuggauggccucuguugagccccacuggauugcugcguccaucauucuggaauuuuuccucauggugcugcugaucccggagccugaccgccagagaacaccccaggauaaccaacucgccuaugucgugauugggcuucuguuuaugauccugaccgucgcugccaaugagaugggacuccuggaaacaaccaagaaagaccuuggcaucgggcacguggccguugagaaccaucaccaugcuacaaugcuggauguggaccuccacccugccagcgcguggacgcuguacgccgucgcuaccacaauuaucacccccaugaugcggcauacaauugaaaacaccacggccaauaucucucugaccgcuauugccaaccaggcggccauccucaugggacuugauaagggcuggccuauuuccaaaauggacaucggcgugccccugcuggcucucgggugcuacagccagguuaauccgcugacacuuaccgccgcugugcugaugcucgucgcccacuaugcuaucauuggaccuggccugcaagccaaggcgacacgcgaggcccagaagagaaccgcugccgggaucaugaaaaaccccacgguggauggaauuguggcuaucgaccuggaucccguugucuacgacgccaaguucgaaaaacagcucggccagauuaugcuucugauccuguguacaucucaaauccuccugaugcggaccacaugggcccuuugcgagagcauuacccuggcgaccgggccucucacaacgcugugggagggauccccgggcaaguuuuggaauaccacaaucgcugugucuauggccaacauuuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcauuauggagguggaccgguccgaagccaaagaggggcuuaagagaggagagaccacgcgccacgcggucucucggggcacagccaaacugagaugguucguugaacgcaaucucgugaagcccgaggggaaggugaucgaucugggauguggcagagggggauggagcuauuacugcgcuggccugaaaaaggucaccgaagugaaaggcuauaccaaagggggaccuggccaugaggaacccaucccuauggccacauacggguggaaccucguuaaacuucacuccggaaaggacguguuuuucacacccccugagaaaugugauacacugcugugcgacauuggcgagucuagcccgaaucccacgaucgaagaggggagaacccuccgcguccugaagaugguggaaccuuggcuucggggaaaccaauuuuguauuaagauccugaaucccuacaugccuuccguuguggagacacucgagcagaugcagagaaaacauggcggcaugcugguccgcaacccccugagcagaaauucuacccacgaaauguauuggguguccugcgggacaggaaacauugugagcgcugucaauaugaccucuagaaugcuccugaaccgcuucacgauggcccaccggaagccgaccuacgagagagauguugaccuuggcgcggggacacgccauguggccguggaaccugaggucgcuaaccuggauaucauuggacagagaaucgaaaauaucaaacacgagcauaaguccaccuggcacuaugacgaggauaaccccuacaaaacaugggccuaucauggcagcuacgaagugaagcccucuggguccgcuagcuccaugguuaauggaguggucaagcuccugaccaaaccuugggacgugauucccaugguuacacaaaucgccaugaccgauacgacaccuuuuggccagcagcggguguucaaggagaaagucgacacccgcaccccgaaggcuaaaagaggcacagcccaaauuauggaagugacggcgcgguggcuuuggggguuucugagcagaaacaagaagccccggaucuguacccgcgaggaguucacaagaaaaguucggucuaaugccgcuauuggagccguguuugucgacgagaaccaguggaauagcgcuaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcguugagggggagggacuccauaagcugggcuacauccuucgcgacauuucuaaaaucccugggggaaauauguaugcugaugacacagccggcugggauaccagaauuacagaagacgaucugcaaaacgaggcuaagaucaccgacauuauggaacccgagcacgcccuccuggcgacgagcaucuuuaaacugaccuaccagaauaaggugguccgggugcagcgcccugccaagaacgggacagugauggauguuaucuccagacgggaccagcgcggcucuggacaagugggcaccuaugggcucaauacauucaccaacauggaagcucagcugauuagacagauggagagcgagggaaucuuucuucccuccgaacuggagacgccgaaccucgccgaacggguccuggauuggcuugagaaacauggcguggaaagacugaagcgcauggcuauuagcggggacgacuguguugugaaaccuaucgaugaccgguucgccacagcgcucaccgcccugaaugauaugggaaaggucagaaaagacauuccccagugggagccuucuaagggcuggaacgauuggcaacaggugcccuuuugcucccaccacuuccaucagcugaucaugaaggacgggcgcgagaucgucgugccuugucggaaucaggaugaacucguuggcagagcucgcgugagccaaggagccggcuggucucugcgggagacagcuugccuugggaaauccuacgcccagauguggcagcugauguauuuucacagacgcgaccuccggcuggcugccaacgcgauuuguagcgccguccccguggauuggguuccgaccuccagaacgaccuggucuauccaugcucaccaucaauggaugacaaccgaagacaugcuuagcguguggaaucgcgucuggauugaggaaaacccuuggauggaggauaagacacacguguccagcuggggagacgugcccuaccugggcaaacgggaggaccaguggugcgggucucucaucggacugaccgccagagccacaugggcuuccaauauucagguugccaucaaccagguccggagacugauuggcaaugaaaacuaucucgauuacaugaccagcaugaagcgcuucaaaaaugagggggaccccgaaggcgcgcugugguga

SEQ ID NO: 19321 - RNA, 9879 nt, Artificial Sequence
  derived and/or modified CDS sequence (opt5) from DENV-1__EU482520__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagagcaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccccccaggcuccuacaaccgagauccagcucacagacuacggcgcccugacccuggauuguucuccccggacgggccucgacuucaacgaaauggugcugcuuacaaugcgcgagaaguccuggcugguccauaaacagugguuucucgaucugccucuucccuggaccagcggggccuccacaucucaagagaccuggaauagacaggaccugcucgugaccuucaagacagcucacgcgaaaaagcaggaagucgugguucugggaagccaagagggcgccaugcacacggcucugaccggggccacagaaauucagaccuccggaacaaccacgaucuuugccggccaucucaagugccggcugaaaauggauaagcuuacacugaaagggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccccccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggauggacacugcggcaacagaggccccagccuccggaccacaaccgucacggggaaaaucauccacgagugguguugccgcuccuguacacugccuccccugagauuccggggagaagacggcugcugguaugggauggagauuagaccggugaaggagaaagaagagaaucuuguuaagagcauggugucugcgggauccggcgaagucgacagcuuuucccucgggcugcuguguaucucuauuaugaucgaggaagugaugcgcagccggugguccagaaagaugcucaugaccggaauucuggcuguuuucuuucuucugaucaugggccagcucacauggaacgaucugauucgccugugcaucauggugggcgccaaugccucugacagaauggggaugggaaccaccuaccuugcucugauggccacauucaaaaugcggccuauguuugcggucggccuccuguuccgcagacucacgagccgggaggugcugcuucugaccaucgggcucucccugguggcuucugucgagcugcccaacagccuugaagagcugggagauggccucgccauggggauuaugauccugaagcuccugacagacuuucaaucccaucagcuuugggccacccugcucagccugacauucauuaaaaccacguuuucucugcacuaugcuuggaagacaauggccaugguucuuuccaucgugagccuguucccccucugucugucuaccaccucccagaaaacaaccuggcucccugugcugcuuggaagccugggcugcaagccgcugacaauguuucucauugcugaaaauaagaucuggggccgcagaucuuggccccugaacgaggggaucauggccgucggaauuguguccauccuucugagcucccuccugaaaaacgauguuccucucgcgggcccccugauugccgggggaaugcuuaucgcuuguuacgugauuagcggcucuagcgccgaccugucccuggaaaaggcugccgaggucucuugggaggaagaggccgaacauagcggggcuucccacaauauccucguggagguucaggaugacggaacgaugaaaaucaaggaugaagagcgggacgauacccugacaauucuucugaaagcgacccuccuggccgugucuggcgucuauccucucagcauccccgcuacacuguucgugugguacuucuggcaaaagaaaaagcagcgcuccggcguccuuugggacaccccuucucccccggagguggggagagccguucuggaugacggaauuuaucggaucaugcagcgcggccugcucgggagaagccaggugggagucggcguguuucaagaaaacguuuuccauacgauguggcacgugacccggggggccguccugauguaccagggaaagagacuugagccuuccugggcuagcgugaaaaaggaccugauuucuuacggcggcggguggcgccuccagggauccuggaauacaggcgaagaggugcagguuaucgccgucgagcccgggaaaaacccuaagaaugugcaaaccgcgcccggaacauuuaaaaccccggaaggcgaggugggggcuauugcccuggauuucaagccuggaacaagcggcucucccaucgucaaccgggaaggcaagaucguggggcucuauggaaauggcguugugacgaccuccgggacauacgucagcgccauugcucaggccaaagcgucccaggagggaccucugcccgaaaucgaggacgagguguuuagaaagcgcaaccuuaccauuauggaucugcaccccggcucugggaaaacccggagauaucugccugcuaucguucgcgaagccauuaagcggaaacucagaacacugauccuugccccgacgcgcguggucgcuagcgagauggccgaagcucugaagggcaugcccauccgguaccaaaccacagccgugaaguccgagcauaccggaaaagaaauuguugaccucaugugccacgcgacauucaccaugagacugcugagcccugugcggguccccaauuauaacaugaucauuauggaugaggcccauuuuacggacccuucuuccaucgcugcccgcggcuacauuagcacaagaguggggaugggagaggcugccgccaucuucaugaccgcuacccccccuggcucuguggaagcguuuccgcagagcaaugccgucauccaggaugaggaacgggacauucccgagcgcuccuggaacucuggguaugaauggaucacagauuucccuggaaagaccguuugguuugugcccagcauuaaauccggcaaugacaucgcuaacugucucagaaagaaugggaaacgggugauucagcuuucuagaaagacauucgauaccgaguaccaaaagacgaaaaacaacgacugggacuacgucgugacaaccgauaucagcgagaugggcgccaauuuccgcgccgaccggguuauugauccuagacgcugccugaagcccgugauccugaaagacggaccggaacgggucauccucgcuggcccuaugcccgugacaguugccuccgcggcucagagacgcgggcggauuggaagaaaccacaauaaggagggcgaucaguauaucuacauggggcagccccugaacaaugacgaagaucaugcccacuggaccgaggccaaaaugcuucuggacaacauuaauacgccugagggaaucauucccgcucucuuugaaccugagcgcgaaaagagcgccgcgaucgauggcgaguauagacugcggggggaagcccgcaagaccuucguggagcugaugagacggggcgaccucccggucuggcuuucuuacaaaguggcuuccgagggauuucaauauagcgaucgcagauggugcuucgacggcgaacggaacaaucagguccuggaggaaaacauggauguggagaucuggacaaaggaaggggagagaaaaaagcugcgcccccgguggcucgacgccagaaccuacuccgacccucuggcucuucgcgaguuuaaagaauucgccgcuggacggagaucuguuagcggcgaucugauucucgagaucgggaagcugccccagcaccugacacagcgggcccaaaaugcgcucgacaaccuugugaugcugcauaauuccgaacagggaggccgcgccuauagacacgcuauggaggaacugccugauaccauugagacacucaugcugcuugcccugaucgcugugcucaccggcggggucacgcuguuuuuccugucuggacggggccucgggaaaacaagcauuggacuucuguguguuauggccuccagcgugcugcucuggauggccucuguggagccccauuggaucgcugcguccaucauucuggaauuuuuccuuaugguccugcucaucccggagccugaccgccagagaaccccccaggauaaccaacuggccuacgugguuauuggccugcucuuuaugauccuuaccguggcugccaaugaaauggggcugcuggagacaaccaagaaggaccucggaauuggccacgucgccguggagaaccaccaucacgcugccaugcuggaugucgaccuucauccugcgagcgccuggacacuguacgcuguggccacgaccaucauuacacccaugaugcggcacaccaucgaaaacacaaccgcuaauaucucucucacggccauugcgaaccaggccgcuauccugaugggccuggauaaaggguggccuauuuccaagauggacaucggaguuccccuccuugcccugggcugcuauagccaggugaauccgcugacccucacagcugccguccugaugcuuguggcucauuacgccauuaucgggccuggacugcaagcgaaagccacccgcgaggcucagaagagaacagccgcuggcaucaugaaaaaccccaccguugaugggauuguggccaucgaccucgaucccgucguguaugacgccaaguucgaaaagcagcugggacagauuaugcugcucauccuuuguacgucucaaauucugcugaugcggacaaccugggcgcucugcgagagcaucacacuggcuaccggcccucuuaccacacugugggaaggcuccccggggaaauuuuggaauacgaccaucgccgugucuauggcuaacauuuuccgcggaagcuaccucgccggcgccgggcuggcuuucucccugaugaagagccucggaggcgggagacggggaacaggcgcccagggcgagacccuuggggagaaauggaagagacagcugaaucagcuguccaaaucugaauuuaacacauauaagcgcagcggaaucauggagguugaccgguccgaagcgaaggagggccucaaaagaggggaaaccacgaagcacgccgucucucgcggaacagcuaaacugcggugguucguggagagaaaucuugugaagcccgagggcaaagucauugaucugggguguggacgcggcggcuggagcuacuauugcgccgggcucaagaagguuaccgaagugaaaggauacaccaagggcgggccuggacacgaggaacccaucccuauggcuacauacggcuggaaccuggugaaacugcauuccgggaaggacgucuuuuucauucccccugagaaaugugauacccuccuuugcgacaucggagaaucuagcccgaaucccacaauugaggagggccggacgcugagagugcugaagaugguugaaccuuggcuccgcggcaaccaauuuuguaucaaaauccugaaucccuauaugccuuccguggucgagacccuugaacagaugcagcggaagcacgggggaaugcuggugagaaacccccucagccgcaauucuacacaugagauguacuggguuuccugcggcaccgggaacauugugagcgccgucaauaugacaucucggaugcugcugaacagauucaccauggcgcaccgcaagccgacguaugagagagauguggaccucggagccggcacccggcacguggcugucgaaccugagguugccaaccuggauaucauugggcagcgcaucgaaaauauuaaacaugagcacaaguccacauggcauuacgacgaagauaaccccuauaaaaccugggcuuaccacggaagcuaugaggugaagcccucuggcuccgccagcuccauggugaauggcgucgugaaacuucugacaaagccuugggacguuauccccauggugacccaaaucgcuaugacagauaccacgccuuuugggcagcagagagucuucaaggagaaaguggacacacggaccccgaaggccaaaagaggaaccgcgcaaauuauggaaguuacagccaaguggcucuggggcuuucugagccggaacaaaaagccccgcaucuguacgagagaggaauucacccggaaggugcgcucuaaugcugccauuggggcugucuuuguggacgagaaccaguggaauagcgccaaagaagccguugaggaugagagauucugggaccuugugcaucgggaacgcgagcugcacaagcagggaaaaugcgcgacaugcgucuacaacaugaugggcaagagagaaaaaaagcucggggaguuuggcaaggcuaaaggaucccgggccaucugguacauguggcugggcgcccgcuuccuggaauucgaggcucucggguuuaugaaugaggaucacugguucucuagagaaaacagccuguccggaguggagggcgaagggcuucauaagcugggauauauucuccgggacaucucuaauaucccuggcgggaacauguacgccgaugacaccgcuggcugggauacacgcauuaccgaggacgaucugcagaaugaggccagaaucacagacauuauggaacccgagcacgcgcuucuggccaaaagcaucuuuaagcucaccuaucaaaacaaagucgugcggguucagcgcccugcuaagaauggaacggugauggaugucauuuccagacgggaccagagaggcucugggcaggugggaaccuacggccugaacacauucaccaacauggaagcccaacugauccgccagauggagagcgaagggaucuuuucccccagcgagcucgagacaccgaaucuggcugaacgggugcuugauuggcuggagaaauauggaguugaaagacucaagcgcauggccauuucuggcgacgacuguguggucaagccuaucgaugaccgguucgcgaccgcccugacggcucuuaacgauauggggaaagugagaaaggacauuccccagugggagccuuccaaaggcuggaaugauuggcagcaaguucccuuuugcagccaucacuuccaccagcugaucaugaaggacggacgcgaaauuguggucccuugucggaaccaggaugagcucgugggcagagcccgcgucucucagggggcuggauggucccugcgggagacagccugccugggcaaaagcuacgcucaaauguggcagcucauguauuuucauagacgcgaccugcggcuugccgcgaaugccaucuguuccgcugugcccguugauuggauuccgaccucuagaacaaccuggagcauccacgcccaucaccaguggaugacgaccgaagacaugcuguccguguggaaccgggucuggaucgaggaaaauccuuggauggaggauaagacacauauuagcucuuggggggacgugcccuaccucggaaagagagaagaccaauggugcggcucccugaucgggcuuaccgcccgcgcuacaugggccaccaacauucagguugcgaucaaucaggugcggagacugauuggcaacgagaauuaccucgauuauaugacaagcaugaaacgcuucaagaacgagucugaccccgaaggagcucugugguga

SEQ ID NO: 19322 - RNA, 9879 nt, Artificial Sequence
  derived and/or modified CDS sequence (opt5) from DENV-1__EU482521__SS-prME
agcgugaccaugcugcucaugcugaugcccaccgcccuugcuuuccaccugacgacccggggcggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaggacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggagaauguuugaggccacagcucgcggcgcccggagaauggcgauccugggagauaccgccugggacuucggcucuauugggggaguguuuacaagcguuggcaagcugguccaucagaucuucgggaccgcuuacggagugcucuuuuccggcgugagcuggacgaugaaaauugggaucggcguccugcuuaccuggcugggacucaauucucgcuccaccagcuucucuaugaccuguauugccgugggccugguuacacuguaccuuggggugaugguccaggcugauuccggaugcgugaucaacuggaagggccgggaacucaaaugugggagcggaauuuuuguuaccaaugaggugcacacauggaccgaacaauauaaguuccaggccgacuccccuaagagacugucugcggccaucggcaaggcuugggaggagggggucugcggcauccgcagcgccacgcggcuggaaaacauuauguggaagcagaucuccaacgagcucaaucauauucugcuugaaaacgacaugaaauuuacagugguugugggagaugucgcuggcauccuggcccaggggaagaaaaugauuagaccgcaacccauggaguacaaguauucuuggcgcagcuggggaaaagccaagaucaucggcgcugacgugcagaauaccaccuucauuaucgaugggccuaacacacccgaauguccugacgaucagcgggcguggaauauuugggagguggaggacuacggauuuggcaucuucaccacgaacauuuggcucaagcugagagauuccuauacacaggucugcgaccaccgccugaugagcgccgcuaucaaagauucuaaggccguucacgccgacaugggcuacuggaucgaauccgagaaaaaugaaaccuggaaacuugcucgggccagcuucauugaggugaaaacauguaucuggcccaagucucauacccucugguccaacggggugcuggaaagcgagaugauuaucccgaagauuuauggaggcccuaucucucaacacaauuacagacccggguacuuuacacagaccgcgggaccuuggcaucugggcaaacucgagcuggauuucgaccuuugcgaagggacgaccgucgugguugaugagcacugcggaaaccggggccccagccugcgcacaaccacagugaccggcaagaucauucacgaaugguguugcagauccuguacgcucccuccccugcgguuuagaggggaggacggaugcugguauggcauggagauccgcccggucaaagaaaaggaggaaaaucuggugaaaagcaugguuucugcuggguccggagagguggacagcuucucccuuggccuccuguguauuucuaucaugauugaagaggucaugcggagcagauggucccgcaagaugcugaugacagggacccucgccguguuucugcuucugaucaugggacagcucacauggaacgaucugauuagacugugcaucaugguuggcgccaaugcuucugaccggaugggcauggggaccaccuaccuugcccugauggcgacauucaagaugcgcccuauguuugcugugggacuccuguucagacggcucacgagccgcgagguccugcuucugaccaucggccucucccugguggccucuguggaacugcccaacagccuugaggaacugggggauggacucgccaugggcauuaugauccugaaacuccugacagacuuucaaucccaucagcuuugggcuacccugcucagccugacauucauuaagaccacguuuucucugcacuaugccuggaaaacaauggcuaugguccuuuccaucguuagccuguucccccucugucugucuaccaccucccagaagacaaccuggcucccugugcugcuugggagccugggaugcaaaccgcugacaauguuucucauugccgagaauaagaucuggggcagacggucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaagccgccgaggugucuugggaagaggaagcugagcauagcggcgcgucccacaauauccucgucgaagugcaggaugacgggacgaugaagaucaaagaugaggagcgcgacgauacccugacaauucuucugaaggccacccuccuggcuguuucuggaguguauccucucagcauccccgccacacuguucgucugguacauuuggcagaagaagaaacagagauccggcgugcuuugggacaccccuucucccccggaagucgagcgggccgugcuggaugacggcaucuaucgcauuaugcagagagggcugcucggacggagccagguuggcgugggggucuuccaagaaaacguguuucauacgauguggcacguuaccagaggagcugugcugauguaccagggcaagcgccuugagccuuccugggccagcgucaagaaagaccugaucucuuacgggggaggcuggcggcuccagggcuccuggaauacaggggaggaaguccaagugauugcgguugagcccggaaagaacccuaaaaauguccaaaccgcucccggcacauucaagaccccggaaggggaggugggagccaucgcccuggauuuuaaaccuggcacaagcgggucucccaucgugaacagagaaggaaagauugucggccucuauggcaauggggugguuacgaccuccggaacauacgugagcgcuaucgcccaggcgaaggcuucccaggagggcccucugcccgagauugaagacgaggucuuccgcaaacggaaccuuaccaucauggaucugcaccccgggucuggaaagaccagacgcuaucugccugccauugugcgggaagccaucaaaagaaagcuccgcacacugauccuugcuccgacgcggguuguggccagcgagauggcugaagcccugaaaggcaugcccauuagauaccaaaccacagcggucaaguccgagcauaccgggaaggagaucguggaccucaugugccacgccacauuuaccaugcggcugcugagcccuguucgcgugcccaauuauaacaugauuaucauggaugaagcucauuucacggacccuucuuccauugccgcuagaggcuacaucagcacacgggucggaaugggcgaggccgccgcuaucuuuaugaccgcgacacccccugggucuguggaagccuucccgcagagcaaugcugugauucaggaugaggaacgcgacauccccgagagauccuggaacucuggauaugaguggauuacagauuuuccuggcaaaaccgucugguucguucccagcaucaaguccgggaaugacauugccaacugucuccggaaaaauggaaagagagugauccagcuuucucgcaaaacauuugauaccgaauaccaaaagacgaagaacaacgacugggacuacguggucacaaccgauauuagcgagaugggcgccaauuuccgggcugacagagugaucgauccucgccggugccugaaacccguuauccugaaggacgggccggaaagagugauucucgccggcccuaugcccgucacaguggcguccgcugcccagcgccggggaagaaucggccgcaaccacaauaaagagggggaucaguauauuuacaugggacagccccugaacaaugacgaggaucaugcccacuggaccgaagcuaagaugcuucuggacaacaucaauacgccugagggcauuauccccgcccucuucgaaccugagagagagaaaagcgcggccaucgauggggaguaucggcugcgcggagaggcuagaaagaccuuuguugaacugaugcggcgcggcgaccucccgguguggcuuucuuacaaggucgccuccgagggguuccaauauagcgauagacgguggugcuuugacggcgaaagaaacaaucaggugcuggaggaaaacauggaugucgagauuuggacaaaagagggagaacgcaagaaacugcggcccagauggcucgacgcucgcaccuacuccgacccucuggcccuucgggaguucaaggaauuugcugccggcagacggucugugagcggggaucugauccucgagauuggaaaacugccccagcaccugacacagcgcgcgcaaaaugcccucgacaaccuuguuaugcugcauaauuccgaacagggcgggagagcuuaucggcacgccauggaggagcugccugauaccaucgaaacacucaugcugcuugcucugauugccgugcucaccggaggcgugacgcuguucuuucugucuggccgcgggcucggaaagacaagcaucggccuucugugugucauggccuccagcguucugcucuggauggcuucuguggagccccauuggaucgcggccuccauuauccuggaguucuuucuuauggugcugcucauuccggagccugacagacagcggacaccccaggauaaccaacuggcuuacgucgugaucgggcuccuguucaugauucuuaccguugccgccaaugagaugggacugcuggaaacaaccaaaaaggaccucggcaucgggcacguggcugucggaaaccaccaucacgccgcgaugcuggauguggaccuucauccugccagcgcuuggacacuguacgccgucgcuacgaccauuaucacacccaugaugcgccacaccaucgagaacacaaccgccaauauuucucucacggcgaucgccaaccaggcugccauucugaugggccuggauaagggcuggccuaucuccaaaauggacauuggggugccccuccuugcucugggaugcuauagccagguuaauccgcugacccucacagccgcugugcugaugcuugucgcccauuacgcgaucaucggcccugggcugcaagccaaggcuaccagagaagcccagaaacggacagcugccggaauuaugaagaaccccaccguggauggcaucguugccauugaccucgaucccguggucuaugacgcgaaauuugagaagcagcuggggcagaucaugcugcucauucuuuguacgucucaaauccugcugaugcgcacaaccugggcucucugcgaaagcaucacacuggccaccggaccucuuaccacacugugggagggcuccccgggcaaguucuggaauacgaccauugcugugucuauggccaacaucuuuagagggagcuaccucgccggagcuggccuggccuucucccugaugaaaagccucgggggaggccggagagggacaggagcgcagggcgagacccuuggcgaaaaguggaaacgccagcugaaucagcuguccaagucugaguucaacacauauaaacggagcgggauuauggaaguggacagauccgaggccaaggaaggacucaagcgcggcgagaucaccaaacacgcuguuucucgggggacggccaagcugagaugguuugucgagcgcaaucuugugaaacccgaaggaaaggugauugaucugggcugugggcggggaggcuggagcuacuauugcgcuggccucaaaaaggucacagagguuaagggguacaccaaaggaggcccugggcacgaagaacccaucccuauggccaccuacggauggaaccuggugaagcugcauuccggcaaagacguguucuuugugcccccugaaaagugugauacacuccuuugcgacauuggggagucuagcccgaaucccaccaucgaggaaggaagaacacugcgcgugcugaaaaugguugagccuuggcuccggggcaaccaauucuguaucaagauucugaaucccuauaugccuuccguggucgaaacgcuugagcagaugcagagaaaacacggcgggaugcuggugcgcaacccccucagcagaaauucuacccaugagauguacuggguuuccugcggaacaggcaacaucgugagcgcggucaauaugaccucuagaaugcugcugaaccgcuuuacaauggcccacagaaagccgaccuaugaacgggauguggaccucggggcuggaacgcgccacguggccgucgagccugaaguugcuaaccuggauauuaucggccagagaauugagaauaucaagcaugaacacaaauccaccuggcauuacgacgaggauaaccccuauaagacaugggccuaccacgggagcuaugaggugaaacccucuggauccgcuagcuccauggugaauggcgucgugaaacuucugaccaaaccuugggacguuauccccauggugacacaaauugccaugaccgauacaaccccuuucggccagcagcgggucuuuaaggaaaagguggacacgagaacaccgaaagcgaagcgggggaccgcccaaaucauggagguuaccgcuaaauggcucuggggauuccugagccgcaacaagaaacccagaauuuguacacgggaagaguuuacgcgcaaggugagaucuaaugccgcuaucggcgccgucuucguggacgaaaaccaguggaauagcgccaaggaggcgguugaggaugaacgguuuugggaccuugugcaucgcgagagagaacugcacaaacaggggaagugcgcuaccugcgucuacaacaugaugggaaaacgggagaagaaacucggcgaguucgggaaggccaagggcucccgcgccauuugguacauguggcugggagcuagauuucuggaguucgaggcccucggcuucaugaaugaagaucacugguuuucucgggagaacagccuguccgggguggaaggagagggccuucauaaacugggguauauccuccgcgacaucucuaagauuccuggaggcaauauguacgcugaugacacagccgggugggauaccagaaucacagaggacgaucugcagaacgaagcgcggauuaccgacaucauggagcccgaacacgcccuucuggcuaaaagcauuuucaagcucacauaucaaaauaaagucgugcgcguucagagaccugccaagaacggcaccgugauggaugucaucucccggagagaccagcgcggaucuggccagguggggacguacggacugaauaccuuuacaaacauggaggcucaacugauccggcagauggaaagcgagggcauuuucucccccagcgagcucgaaaccccgaaccuggccgagagagugcuugauuggcuggaaaaauaugggguugagcgccucaagcggauggcgaucucuggagacgacuguguggucaagccuauugaugacagauuugccacagcucugaccgcccuuaaugauaugggcaaagugcgcaaggacaucccccagugggaaccuuccaaaggguggaacgauuggcagcaaguucccuucugcagccaucacuuucaccagcugauuaugaaggacggccgggagaucguggucccuuguagaaaucaggaugagcucgugggacgcgcucgggucucucagggcgccggguggucccugagagaaacggcuugccugggaaaaagcuacgcccaaauguggcagcucauguauuuccaucgccgggaccugagacuugcggccaacgcuauuuguuccgccgugcccguugauuggaucccgacaucucggaccacauggagcauccacgcccaucaccaguggaugaccacggaggacaugcuguccguguggaauagagucuggauugaagagaacccuuggauggaagauaagacccauaucagcucuuggggcgacgugcccuaccucgggaagcgcgaggaccaauggugcggaucccugauuggccuuacagcucgggccaccugggcgacaaauauccagguugcuauuaaccaggugagacgccugaucgggaaugagaacuaccucgauuauaugaccagcaugaaaagauuuaagaaugaaucugaccccgagggcgcccugugguga

SEQ ID NO: 19323 - RNA, 9879 nt, Artificial Sequence
  derived and/or modified CDS sequence (opt5) from DENV-1__EU482523__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuaucgcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugaugggacuggauaaaggcuggccuaucuccaagauggacauuggcguuccccuccuugcucuggggugcuauagccaggugaauccgcugacccucacagccgcuguccugaugcuuguggcccauuacgcgaucauuggaccuggccugcaagccaaagcuacccgcgaggcccagaagagaacagcugccgggaucaugaaaaaccccaccguugauggaaucguggccauugaccucgaucccgucguguaugacgcgaaguucgaaaagcagcugggccagaucaugcugcucauucuuuguacgucucaaauccugcugaugcggacaaccugggcucucugcgagagcauuacacuggccaccgggccucuuaccacacugugggagggauccccgggcaaauuuuggaauacgaccaucgcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcauuauggagguugaccgguccgaagccaaggaggggcucaaaagaggagagaccacgaagcacgcugucucucgcggcacagccaaacugcggugguucguggaaagaaaucuugugaagcccgaggggaaagucaucgaucugggauguggccgcgggggauggagcuacuauugcgcuggccucaagaagguuaccgaagugaaaggcuacaccaaaggcgggccugggcacgaggaacccauuccuauggccacauacggguggaaccuggugaaacugcauuccggaaaggacgucuuuuucauucccccugagaaaugugauacccuccuuugcgacauuggcgagucuagcccgaaucccacaaucgaagaggggcggacgcugagagugcugaagaugguugaaccuuggcuccgcggaaaccaauuuuguauuaaaauccugaaucccuauaugccuuccguggucgagacccuugagcagaugcagcggaagcacggcggcaugcuggugagaaacccccucagccgcaauucuacacaugaaauguacuggguuuccugcgggaccggaaacaucgugagcgcggucaauaugacaucucggaugcugcugaacagauucaccauggcccaccgcaagccgacguaugagagagauguggaccucggcgcugggacccggcacguggccgucgaaccugagguugcuaaccuggauauuaucggacagcgcauugaaaauaucaaacaugagcacaaguccacauggcauuacgacgaggauaaccccuauaaaaccugggccuaccacggcagcuaugaagugaagcccucuggguccgcuagcuccauggugaauggagucgugaaacuucugacaaagccuugggacguuauucccauggugacccaaaucgccaugacagauaccacgccuuuuggccagcagagagucuucaaggagaaaguggacacacggaccccgaaggcgaaaagaggcaccgcccaaaucauggaaguuacagcuaaguggcucuggggguuucugagccggaacaaaaagccccgcauuuguacgagagaggaguucacccggaaggugcgcucuaaugccgcuaucggagccgucuuuguggacgagaaccaguggaauagcgccaaagaggcgguugaagaugagagauucugggaccuugugcaucgggaacgcgagcugcacaagcagggcaaaugcgcuacaugcgucuacaacaugauggggaagagagagaaaaagcucggagaguuuggcaaggccaaagggucccgggccauuugguacauguggcugggcgcucgcuuccuggaguucgaagcccucggauuuaugaaugaggaucacugguucucuagagaaaacagccuguccggcguggagggggagggacuucauaagcugggcuauauccuccgggacauuucuaaaaucccugggggaaauauguacgcugaugacaccgccggcugggauacacgcaucaccgaagacgaucugcagaacgaggcgagaauuacagacaucauggaacccgagcacgcccuucuggcuaagagcauuuuuaaacucaccuaucaaaauaaggucgugcggguucagcgcccugccaaaaacgggacggugauggaugucaucuccagacgggaccagagaggcucuggacaggugggcaccuacgggcugaauacauucaccaacauggaagcucaacugauucgccagauggagagcgagggaaucuuuucccccagcgaacucgagacaccgaaccuggccgaacgggugcuugauuggcuggagaaguauggcguugaaagacucaagcgcauggcgaucucuggggacgacuguguggucaaaccuauugaugaccgguucgccaccgcucugacggcccuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcucgcgucucucagggagccggcuggucccugcgggagacagcuugccugggaaagagcuacgcccaaauguggcagcucauguauuuucauagacgcgaccugcggcuugcggccaacgcuauuuguuccgccgugcccguugauuggaucccgaccucuagaacaaccuggagcauucacgcccaucaccaguggaugacgaccgaagacaugcuguccguguggaaucgggucuggaucgaggaaaacccuuggauggaggauaagacacauaucagcucuuggggagacgugcccuaccucggcaaaagagaggaccaauggugcgggucccugauuggacuuaccgcucgcgccacaugggcgaccaauauccagguugcuauuaaccaggugcggagacugaucggcaaugaaaacuaccucgauuauaugacaagcaugaagcgcuucaaaaaugagucugaccccgaaggggcccugugguga

SEQ ID NO: 19324 - RNA, 9879 nt, Artificial Sequence
  derived and/or modified CDS sequence (opt5) from DENV-1__EU482525__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccaccagcuucucuaugaccuguaucgccguuggccuggugacacuguaccuuggggucauggugcaggcugauuccggaugcguuauuaacuggaaaggccgcgaacucaagugugggagcggaaucuuugugaccaaugagguccacacauggaccgaacaauauaaguuccaggccgacuccccuaaacggcugucugcggccauuggcaaggcuugggaggagggggugugcggcaucagaagcgccacgcgccuggaaaacaucauguggaaacagauuuccaacgagcucaaucauauccugcuugaaaacgacaugaagcugacaguuguggucggagauguggcuggcauucucgggcagggcaagaaaaugauccggccgcaacccauggaguacaaauauucuuggaaaagcuggggcaaggccaagauuaucggggccgacgcucagaauaccaccuuuaucauugauggaccuaacacacccgaauguccugacgaucagagagcguggaauaucugggagguggaggacuacggcuucggcauuuuuaccacgaacaucuggcugaagcugcgcgauuccuauacacaggucugcgaccaccggcuuaugagcgccgcuauuaaagauucuaaggccguucacgccgacaugggguacuggaucgaauccgagaaaaaugaaaccuggaagcucgcuagagccagcuucaucgaggugaagacauguauuuggcccaaaucucauacccugugguccaacggagugcuggaaagcgagaugaucauuccgaagaucuauggcgggccuauuucucaacacaauuaccgccccggauacuucacacagaccgcgggcccuuggcaucucgggaaacuggagcuugauuuugaccugugcgaaggaacgaccgucgugguugaugagcacugcggcaaccggggccccagccucagaacaaccacagugaccgggaagaucauccacgaaugguguugccgguccuguacgcugccuccccugcgcuucagaggagaggacggcugcugguaugggauggagauucggccggucaaagaaaaggaggaaaaucuugucaagagcaugguuucugcuggauccggcgagguggacagcuuuucccucgggcugcuguguaucucuauuaugaucgaagaggucaugagaagccgcuggucccggaaaaugcucaugacaggaacccuggccguguucuuucuucugauuaugggccagcucacauggaacgaucugaucagacugugcauuaugguuggcgccaaugcuucugaccgcauggggaugggaaccaccuaccuugcccugauggcgacauucaagaugagaccuauguuugcugugggccuccuguuccggcgccucacgagcagagagguccugcuucugaccaucgggcucucccugguggccucuguggaacugcccaacagccuugaggaacugggagauggccucgccauggggaucaugauucugaaacuccugacagacuuucaaucccaucagcuuugggcuacccugcucagccugacauucaucaagaccacguuuucucugcacuaugccuggaaaacaauggcuaugguccuuuccauuguuagccuguucccccucugucugucuaccaccucccagaagacaaccuggcucccugugcugcuuggaagccugggcugcaagccgcugacaauguuucucaucgccgagaauaaaauuuggggccggaagucuuggccccugaacgaagggaucauggcggugggaaucgucuccauucuucugagcucccuccugaaaaacgaugugccucucgccggcccccugaucgcugggggaaugcuuauugccuguuacguuaucagcggcucuagcgcugaccugucccuggagaaggccgccgaggugucuugggaagaggaagcugagcauagcggggcgucccacaauauucucgucgaagugcaggaugacggaacgaugaaaaucaaggaugaggagcgcgacgauacccugacaauccuucugaaagccacccuccuggcuguuucuggcguguauccucucagcauucccgccacacuguucgucugguacuucuggcaaaagaagaaacagagauccggcgugcuuugggacaccccuucucccccggaagucgagcgggccgugcuggaugacgggaucuaucgcauuaugcagagaggacugcucggccggagccagguuggggugggagucuuucaagaaaacguguuccauacgauguggcacguuacccgcggcgcugugcugauguaccaggggaagagacuugagccuuccugggccagcgucaaaaaggaccugaucucuuacggaggcggcuggcggcucagaggguccuggaauacaggagaggaaguccaggugauugcgguugagcccggcaaaaacccuaagaauguccagaccgcucccgggacauuuaagaccccggaaggagaggugggcgccaucgcccuggauuucaaaccugggacaagcggaucucccauugugaaccgcgaaggcaagaucgucggccucuaugggaauggagugguuacgaccuccggcacauacgugagcgcuaucgcccaagcgaaggcuucccaggaggggccucugcccgagauugaagacgaggucuuucggaagagaaaccuuaccaucauggaucugcaccccggaucuggcaaaacccgccgguaucugccugccauugugagagaagccaucaagcgcaagcuccggacacugauucuugcuccgacgagaguuguggccagcgagauggcugaagcccugaaagggaugcccauccgcuaccagaccacagcggucaaguccgagcauaccggcaaagagaucguggaccucaugugccacgccacauucaccaugcggcugcugagcccuguuagagugcccaauuauaacaugauuaucauggaugaagcucauuuuacggacccuucuuccauugccgcucggggauacaucagcacacgcgucggcaugggggaggccgccgcuauuuucaugaccgcgacacccccuggaucuguggaagccuuuccgcaaagcaaugcugugauccaggaugaggaaagagacauccccgagcgguccuggaacucuggcuaugaguggauuacagauuucccugggaagaccgucugguuuguucccagcaucaaauccggaaaugacauugccaacugucuccgcaagaauggcaagagagugauccagcuuucucggaaaacauucgauaccgaauaccagaagacgaaaaacaacgacugggacuacguggucacaaccgauauuagcgagaugggggccaauuucagagcugaccgcgugaucgauccucggagaugccugaagcccguuauucugaaagacggcccggaacgcgugauccucgccggaccuaugcccgucacaguggcguccgcugcccaacggagaggccgcaucgggcggaaccacaauaaggagggagaucaguauauuuacaugggccagccccugaacaaugacgaggaucaugcccacuggaccgaagcuaagaugcuucuggacaacaucaauacgccugaggggauuauccccgcccucuuugaaccugagagagaaaagagcgcggccguugauggagaguaucgccugagaggcgaggcucggaagaccuucguggagcugaugcgcagaggggaccucccggucuggcuuucuuacaaaguggccuccgagggcuuucaguauagcgaucggcgcuggugcuucgacggagaaagaaacaaucaaguccuggaggaaaacauggauguggagauuuggacaaaggagggcgaacggaaaaagcugagaccccgcuggcucgacgcucggaccuacuccgacccucuggcccuuagagaguuuaaagaguucgcugccgggcgccggucuguuagcggagaucugauccucgagaucggcaagcugccccagcaccugacacagagagcgcagaaugcccucgacaaccuugugaugcugcauaauuccgaacaagggggacgggcuuaucgccacgccauggaggagcugccugauaccauugaaacacucaugcugcuugcucugaucgccgugcucaccggcggcgucacgcuguuuuuccugucugggagaggacucggcaagacaagcauugggcuucuguguguuauggccuccagcgugcugcucuggauggcuucuguggagccccauuggaucgcggccuccauuauccuggaauuuuuccuuaugguccugcucaucccggagccugaccggcagcgcacaccccaggauaaccagcuggcuuacgugguuauuggacugcucuuuaugauccuuaccguggccgccaaugagaugggccugcuggaaacaaccaaaaaggaccucgggauuggacacgucgcuguggagaaccaccaucacgccgcgaugcuggaugucgaccuucauccugccagcgcuuggacacuguacgccguggcuacgaccaucauuacacccaugaugagacacaccaucgaaaacacaaccgccaauauuucucucacggcgaucgccaaccaagcugccauccugaugggccuggauaaaggcuggccuauuuccaagauggacaucgggguuccccuccuugcucugggaugcuauagccaggugaauccgcugacccucacagccgcuguccugaugcuuguggcccauuacgcgauuaucggcccugggcugcaggccaaagcuacccgggaggcccaaaagcgcacagcugccggaauuaugaagaaccccaccguugauggcaucguggccaucgaccucgaucccgucguguaugacgcgaaauucgaaaagcagcuggggcagauuaugcugcucauccuuuguacgucucagauucugcugaugagaacaaccugggcucucugcgagagcaucacacuggccaccggaccucuuaccacacugugggagggcuccccgggcaaauuuuggaauacgaccauugcugugucuauggccaacaucuuccgggggagcuaccucgccggagcuggccuggccuucucccugaugaaaagccucgggggaggccgcagagggacaggagcgcaaggcgaaacccuuggcgagaaauggaagcggcagcugaaucagcuguccaagucugaauuuaacacauauaaaagaagcgggaucauggagguugaccgcuccgaagccaaggagggacucaaacggggcgagaccacgaagcacgcugucucuagagggacagccaaacugcgcugguucguggaacggaaucuugugaagcccgagggaaaggucauugaucugggcugugggagaggaggcuggagcuacuauugcgcuggccucaaaaagguuaccgaagugaaaggguacaccaagggaggcccugggcacgaggaacccaucccuauggccacauacggauggaaccuggugaaacugcauuccggcaaggacgucuuuuucauucccccugagaaaugugauacccuccuuugcgacaucggggagucuagcccgaaucccacaauugaagagggacgcacgcugcgggugcugaagaugguugaaccuuggcucagaggcaaccaguuuuguaucaagauucugaaucccuauaugccuuccguggucgagacccuugagcaaaugcagcgcaaacacggcgggaugcuggugcggaacccccucagcagaaauucuacacaugaaauguacuggguuuccugcggaaccggcaacaucgugagcgcggucaauaugacaucucgcaugcugcugaaccgguucaccauggcccacagaaagccgacguaugagcgcgauguggaccucgggaccggaacaagacacguggcugucgaaccugagguugccaaccuggauaucauuggccagcggaucgaaaauauuaaacaugagcacaaguccaccuggcauuacgacgaggauaaccccuauaaaacaugggcuuaccacgggagcuaugaagugaagcccucuggauccgccagcuccauggugaauggcgucgugaaacuucugaccaaaccuugggacguuauccccauggugacacagauugcuaugaccgauacgacaccuuuuggccaacagcgcgucuucaaggagaaaguggacaccagaaccccgaaggccaaacgggggacagcgcagaucauggaaguuacggccagauggcucuggggauuucugagccggaacaagaagccccgcaucuguaccagagaggaguucacacggaaagugcgcucuaaugcugccauuggcgcugucuuuguggacgagaaccaauggaauagcgccaaggaggccguugaagaugagagauucugggaccuugugcaucgggaacgcgagcugcacaaacaggggaagugcgcgaccugcgucuacaacaugaugggaaaaagagaaaagaagcucggcgaguuugggaaagcuaagggcucccgggccaucugguacauguggcugggagcccgcuuccuggaguucgaagcucucggcuuuaugaaugaggaucacugguucucuagagaaaacagccuguccgggguggagggagagggccuucauaaacugggguauauucuccgggacaucucuaagauuccuggaggcaauauguacgccgaugacacagcugggugggauacccgcaucacagaagacgaucugcagaacgaggccaaaaucaccgacauuauggaacccgagcacgcgcuucuggccaaggcuaucuuuaaacucacguaucagaauaaggucgugagaguucaacggccugccaagaacggcaccgugauggaugucauuagccgcagagaccagcggggauccggccagguggggacauacggacugaauaccuucacaaacauggaagcucagcugaucagacaaauggagucugagggcauuuuuagccccuccgaacucgagaccccgaaccuggccgaacgcgcgcuugauuggcuggagaaauaugggaucgaacggcucaagagaauggccaucagcggagacgacugugugguuaaaccuauugaugaccgcuucgcuacggcccugacagcucuuaaugauaugggcaaggugcggaaagacaucccccagugggagccuucuaagggguggaacgauuggcagcagguccccuuuugcucccaucacuuccaccaacugauuaugaaggacggcagagagaucgugguuccuugucgcaaucaggaugaacucgugggacgggccagagucagccagggcgcuggguggucucugcgcgagaccgccugccugggaaaauccuacgcgcagauguggcaacucauguauuuucaucggagagaccugcgccuugccgcuaacgccauuuguagcgccgugcccgucgauugggugccgacaucccggaccacguggucuauccacgcucaucaccaguggaugaccacagaagacaugcugagcguuuggaauagaguguggauugaggaaaacccuuggauggaggauaagacccauaucuccagcugggaggacguccccuaccucggcaaacgggaagaccaguggugcgggucucugaucggacuuacagccagagcgaccugggcuacaaauauucaaguggccaucaaccagguucgccggcugauuggcaaugagaacuaccucgauuauaugaccuccaugaagagauucaaaaaugaaacggaccccgagggggcccugugguga

SEQ ID NO: 19325 - RNA, 9879 nt, Artificial Sequence
  derived and/or modified CDS sequence (opt5) from DENV-1__EU482526__SS-prME
agcgugaccaugcugcucaugcugaugcccaccgcccuugcuuuccaccugacgacccggggcggggaaccucauaugauugucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguacccucuuagcauccccgcuacacuguucgucugguauuuuuggcaaaagaaaaagcagcgcuccggcgugcugugggacaccccuucucccccggaaguugagagagccgugcucgaugacggcauuuaccggaucaugcagcgcgggcugcuuggaagaagccaggucggcguggggguuuuccaagaaaacguguuccacacgauguggcacgucacccggggagccgugcugauguaucagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauuuaaaaccccggaaggggaggucggagcuauugcccuggauuucaagccuggcacaagcgggucucccaucgugaaccgggaaggaaaaauuguuggccuuuacggcaaugggguggucacgaccuccggaacauaugugagcgccaucgcucaggccaaggcgucccaggagggcccucugcccgagaucgaagacgagguuuuuagaaaacgcaaccugaccauuauggaucuccaucccgggucuggaaagacccggagauaccugccugcuaucgugcgcgaagccauuaagcggaaacuuagaacacugauccucgccccgacgcgcgucguggcuagcgagauggccgaagcucugaagggcaugcccauucgguaucaaaccacagccguuaaauccgagcacaccgggaaggagaucguggaccugaugugccaugcgacauucaccaugagacuccuuagcccuguccgcgugcccaauuacaacaugaucauuauggaugaagcccacuuuacggacccuucuuccaucgcugcccggggcuauauuagcacaagagugggaaugggcgaggcugccgccaucuucaugaccgcuacacccccugggucugucgaagcguuuccgcagagcaaugccguuauucaggaugaggaacgggacauccccgagcgcuccuggaacucuggauacgaguggaucacagauuucccuggcaaaaccgugugguuugugcccagcauuaaguccgggaaugacaucgcuaacugucugagaaagaauggaaaacgggucauucagcugucucgcaagacauucgauaccgaauaucagaagacgaagaacaacgacugggacuacgugguuacaaccgauaucagcgagaugggcgccaauuuuagagccgaccgggugauugauccuagacgcugccucaaacccgucauccugaaggacgggccggaacgggugauucuugcuggcccuaugcccguuacaguggccuccgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaagagcgccgcgaucgauggggaguaccggcucagaggagaggcccgcaaaaccuucgucgaacuuaugagacggggcgaccugccgguguggcugucuuauaaggucgcuuccgagggguuucaauacagcgaucgcagauggugcuucgacggcgaacggaacaaucaggugcucgaggaaaacauggauguugagauuuggacaaaagagggagaacgcaagaaacugagaccccgguggcuugacgccagaaccuauuccgacccucuggcucuccgcgaguuuaaggaguucgccgcuggccggagaucugugagcggggaucugauccuggagaucggaaagcucccccagcaucuuacacagcgcgcccaaaaugcgcuggacaaccuggugaugcuccacaauuccgaacagggcgggcgggccuacagacaugcuauggaggagcugccugauaccauugaaacacuuaugcugcucgcccugaucgcuguccugaccggaggcguuacgcucuuuuuccuuucuggccgggggcugggaaaaacaagcauuggccugcucugugugauggccuccagcgugcugcuuuggauggccucugucgagccccacuggaucgcugcguccauuauccuggaauuuuuccucauggugcugcugaucccggagccugaccgccagagaacaccccaggauaaccaacucgccuauguugugauugggcuucuguuuaugauccugaccgucgcugccaaugagaugggacuccuggaaacaaccaagaaagaccuuggcauugggcacguggccgucgagaaccaucaccaugcuacaaugcuggauguggaccuccacccugccagcgcguggacgcuguacgccguugcuaccacaaucauuacccccaugaugcggcauacaaucgaaaacaccacggccaauauuucucugaccgcuaucgccaaccaggcggccauccucaugggacuugauaagggcuggccuauuuccaaaauggacaucggcgugccccugcuggcucucgggugcuacagccaggucaauccgcugacacuuaccgccgcugugcugaugcucguugcccacuaugcuauuaucggaccuggccugcaagccaaggcgacacgcgaggcccagaagagaaccgcugccgggauuaugaaaaaccccacgguggauggaaucgucgcuaucgaccuggaucccgugguguacgacgccaaguucgaaaaacagcucggccagauuaugcuucugauccuguguacaucucaaauucuccugaugcggaccacaugggcccuuugcgagagcaucacccuggcgaccgggccucucacaacgcugugggagggauccccgggcaaguuuuggaauaccacaauugcuguuucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcauuauggaggucgaccgguccgaagccaaagaggggcuuaagagaggagagaccacgcgccacgcggugucucggggcacagccaaacugagaugguucguggaacgcaaucucgucaagcccgaggggaagguuaucgaucugggauguggcagagggggauggagcuauuacugcgcuggccugaaaaaggugaccgaagugaaaggcuauaccaaagggggaccuggccaugaggaacccauuccuauggccacauacggguggaaccucgucaaacuucacuccggaaaggacguguuuuucacacccccugagaaaugugauacacugcugugcgacaucggcgagucuagcccgaaucccacgauugaagaggggagaacccuccgcguucugaagaugguggaaccuuggcuucggggaaaccaauuuuguaucaagauucugaaucccuacaugccuuccgucguggagacacucgagcagaugcagagaaaacauggcggcaugcugguucgcaacccccugagcagaaauucuacccacgaaauguauuggguguccugcgggacaggaaacaucgucagcgcugugaauaugaccucuagaaugcuccugaaccgcuucacgauggcccaccggaagccgaccuacgagagagauguggaccuuggcgcggggacacgccaugucgccguugaaccugagguggcuaaccuggauaucauuggacagagaaucgaaaauauuaaacacgagcauaaguccaccuggcacuaugacgaggauaaccccuacaaaacaugggccuaucauggcagcuacgaagugaagcccucuggguccgcuagcuccauggucaauggagugguuaagcuccugaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuuuggggguuucugagcagaaacaagaagccccggaucuguacccgcgaggaguucacaagaaaaguccggucuaaugccgcuauuggagccguguuuguugacgagaaccaguggaauagcgcuaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcgucgagggggagggacuccauaagcugggcuacauucuucgcgacaucucuaaaauuccugggggaaauauguaugcugaugacacagccggcugggauaccagaaucacagaagacgaucugcaaaacgaggcuaagaucaccgacauuauggaacccgagcacgcccuccuggcgacgagcaucuuuaaacugaccuaccagaauaaggugguucgggugcagcgcccugccaagaacgggacagucauggaugugauuuccagacgggaccagcgcggcucuggacaagugggcaccuaugggcucaauacauucaccaacauggaagcucagcugaucagacagauggagagcgagggaaucuuuucccccagcgaacuugagaucccgaaccuggccgaacggguucucgauuggcuggagaaauacggcguggaaagacuuaagcgcauggcuaucucuggggacgacugugucgugaaaccuauugaugaccgguucgccacggcgcugacagcccucaaugauaugggaaagguuagaaaagacgugccccagugggagccuuccaagggcuggaacgauuggcaacagguccccuuuugcagccaucacuuccaccagcugaucaugaaggacgggcgcgagauuguggucccuugucggaaucaggaugaacuggugggcagagcucgcguuucucaaggagccggcuggucccuccgggagaccgcuugccuggggaaaagcuaugcccagauguggcagcuuauguacuuucauagacgcgaccugcggcucgcugccaacgcgaucuguuccgccgugcccgucgauugggugccgacaucuagaaccacguggagcauucacgcucaucaccaauggaugaccacagaagacaugcuguccguuuggaaucgcguguggaucgaggaaaacccuuggauggaggauaagacccaugucagcucuuggggagacgugcccuaucuuggcaaacgggaggaccaguggugcgggucccugauuggacucacagccagagccaccugggcuagcaauauccagguggccaucaaccagguucggagacugauuggcaaugaaaacuaccuggauuacaugacaucuaugaagcgcuucaaaaaugagggggaccccgaaggcgcgcucugguga

SEQ ID NO: 19326 - RNA, 9879 nt, Artificial Sequence
  derived and/or modified CDS sequence (opt5) from DENV-1__EU482527__SS-prME
agcgugacaaugcugcugaugcugaugcccacagcccuugcuuuccaccugacgaccagaggcggggagccucauaugaucgucuccaagcaggaacggggaaaaucucugcuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugggaaaggagugacccaaaacggccggcugaucacagcuaaucccauugucacggacaaggaaaaaccugugaacaucgaggccgaaccgcccuucggggagucuuauauugugaucggagccggcgagaaggcucugaaacuuagcugguuuaaaaagggguccucuauuggcaaaauguucgaagccaccgcuagaggagcccgccggauggcgauccucggcgauacagccugggacuuugggagcaucggaggcguuuucaccuccgucgggaagcuggugcaucagauuuuuggaacagcuuacggcgugcuguucagcggggucucuuggaccaugaaaaucggcauuggagugcuccugacguggcuuggccucaauuccagaagcaccucucucuccaugacauguaucgccguugggcuggugacccuguaccuuggagucauggugcaggcugauagcggcugcguuauuaacuggaaggggcgcgagcucaaguguggauccggcaucuuugugacaaaugaaguccacaccuggacagagcaguauaaauuccaagccgacucuccuaagcggcugagcgcggccauugggaaggcuugggaagagggcgugugcggaaucagauccgccacccgccuggagaacaucauguggaagcagauuucuaacgaacucaaucauauccugcuugagaacgacaugaaauuuacgguuguggucggcgauguggcugggauucuggcccagggaaagaaaaugauccggccgcagcccauggaauacaaguauagcuggaaguccuggggcaaagccaagauuaucggggcugacgugcaaaauacaaccuucaucauugauggaccuaacacccccgaguguccugacgaucagagagcguggaauaucugggaagucgaggacuacggcuuuggcauuuucacaaccaacaucuggcucaaacugcgcgauagcuauacgcagguuugcgaccaccggcugaugucugccgcuauuaaggauuccaaagccgugcacgccgacaugggguacuggaucgagagcgaaaagaaugagacauggaaacuugcuagagccucuuucaucgaagugaaaaccuguauuuggcccaagucccauacacucuggagcaacggaguccuggagucugaaaugaucauuccgaaaaucuauggcgggccuauuagccagcacaauuaccgccccggauacuuuacccaaacagcgggcccuuggcaucuggggaagcucgagcuggauuucgaccuuugcgagggaaccacggugguuguggaugaacacugcggcaaccggggccccucccugagaaccacaaccgucacagggaaaaucauccacgagugguguugccggagcuguacccucccuccccugcgcuuuaagggagaagacggcugcugguaugggauggagauuagaccggugaaggagaaagaagagaaucugguuaagucuaugguguccgcuggaagcggcgaagucgacuccuucucucuugggcuccuguguaucagcauuaugaucgaggaagugaugcgguccagauggucucgcaaaaugcugaugacgggaacacucgccgucuuuuuccugcuuauuaugggccagcugaccuggaacgaucucauccggcugugcauuauggugggcgccaaugcuagcgacagaauggggaugggaacaaccuaccuggcccuuauggcgaccuuuaagaugcgcccuauguucgcugucggccugcucuuuagacggcugacaucccgcgaggugcuccugcuuacgaucgggcugucucucguggccuucgucgagcugcccaacagccuggaggaacuuggagauggccuggccauggggaucaugauucucaaacugcucaccgacuuucagucccaucaacugugggcuacacuucugagccucaccuucaucaagacaaccuuuucucugcacuaugccuggaagacgauggcuaugguucuguccauugugagccuuuucccccugugucucucuacaaccucccagaaaaccacauggcugccugugcuccugggaagccuuggcugcaagccgcugaccauguuccugaucgccgaaaauaaaauuuggggcagaaagucuuggccccucaacgaggggaucauggcggucggaaucguguccauucugcuuagcucccugcucaaaaacgauguuccucuggccggcccccucaucgcugggggaaugcugauugccuguuacgugaucagcggcucuagcgcugaccuuucccuggaaaaggccgccgaggucucuugggaggaagaggcugaacauagcggggcgucccacaauauucugguggagguucaggaugacggaacaaugaaaaucaaggaugaggaacgggacgauacgcucaccauccugcuuaaggccacacugcucgcugugucuggcgucuauccucugagcauucccgccacccucuuugugugguacuucuggcagaaaaagaaacaacgcuccggcguccugugggacacaccuucucccccggagguggaaagagccguucuugaugacgggaucuaucggauuaugcagcgcggacugcugggcagaagccaggugggggucggaguguuucaggagaacguuuuccauaccauguggcacgugacgcggggcgcuguccucauguaccaagggaagcgccuggaaccuuccugggccagcgugaaaaaggaccuuaucucuuacggaggcggcuggagacugcagggguccuggaauaccggagaggaggugcagguuauugcggucgaacccggcaagaacccuaaaaaugugcagacagcucccgggaccuuuaagacaagcgagggagaagugggcgccaucgcccucgauuucaaaccggggaccucuggauccccuauugucaaccgggagggcaagaucgugggccuguaugggaauggaguugugacaacgagcggcaccuacgucuccgcuaucgcccaagcgaaggcuucucaggaagggccccucccugagauugaggacgaaguguuuagaaagcgcaaccugacaaucauggaucuucaccccggaagcggcaagacccggagauaucugcccgccauuguucgcgaggccaucaaacggaagcugagaacccucauucuggcuccuacacgcguggucgccuccgaaauggcugaggcccuuaaagggaugccgauccgguaccagacgaccgcggugaaguccgaacauacaggcaaagagaucguugaccugaugugccacgccaccuucacaaugagacuccugucucccgugcgcgucccuaauuauaacaugauuaucauggaugaggcucauuuuaccgaccccuccagcauugccgcucggggauacaucucuacgagagugggcaugggggaagccgccgcuauuuucaugacagcgaccccucccggaagcguggaggccuuuccucaauccaaugcugucauccaggaugaggaacgggacaucccggaacgcucuuggaacagcggcuaugaguggauuaccgauuuccccgggaagacaguuugguucgugccuuccaucaagucuggaaaugacauugccaacugucugcgcaagaauggcaagcgggugauccagcucagccgcaaaaccuuugauacagaguaccagaagaccaaaaacaacgacugggacuacgucgugacgacagauauuuccgaaaugggggccaauuucagagcugaccggguuaucgaucccagacgcugccuuaagccugugauucugaaggacggccccgagcgggucauccuggccggaccgaugccugugaccguugcgagcgcugcccaaagacgcggccggaucgggagaaaccacaauaaagaaggagaucaguauauuuacaugggccagccccucaacaaugacgaggaucaugcccacuggacagaggcuaagaugcugcuugacaacaucaauacccccgaagggauuaucccugcccuguuugagcccgaacgcgagaaaucugcggccauugauggagaauaucggcucagaggcgaggcucgcaagacguucguggagcugaugagaagaggggaccugccugucuggcucuccuacaaaguggccagcgaaggcuuucaguauuccgaucgcagauggugcuucgacggagagcggaacaaucaaguccuugaagagaacauggauguggaaaucuggaccaaggagggcgagcgcaaaaagcugagaccgcgguggcuggacgcuagaacauacucugacccccucgcccugcgcgaauuuaaggaguucgcugccgggcggagaagcguuuccggagaucuuauccuggaaauuggcaaacucccucagcaccugacccagcgcgcgcagaaugcccuggacaaccucgugaugcuucauaauucugagcaagggggacgggcuuauagacacgccauggaggaacugcccgauacaaucgagacccugaugcuccuggcucuuauugccgugcugacaggcggcgucacccucuuuuuccugagcgggcggggacugggcaagacguccaucgggcuccuuuguguuauggccagcucugugcugcuguggauggcuuccguggaaccucauuggauugcggccagcaucauccucgaguuuuuccugaugguccuucugauucccgaaccggaccgccagagaacaccucaggauaaccagcucgcuuacgugguuaucggacugcuguuuaugauucucaccguggccgccaaugagaugggccuucuggagaccaccaaaaaggaccuggggaucggacacgucgcuguggaaaaccaccaucacgccgcgaugcucgaugucgaccugcaucccgccucugcuuggacccuuuacgccguggcuacaacgauuaucaccccuaugaugcggcacacaauugagaacaccacagccaauaucucccugaccgcgaucgccaaccaagcugccauucucaugggccuggauaaaggcuggcccaucagcaagauggacauugggguuccucugcucgcucuuggaugcuauucucaggugaauccccugacgcugaccgccgcuguccucaugcugguggcccauuacgcgaucauuggcccggggcuucaggccaaggcuacacgcgaagcccagaaacggaccgcugccggaaucaugaagaacccuacaguugauggcaucguggccauugaccuggaucccgucguguaugacgcgaaauucgagaagcagcucgggcagaucaugcugcugauucucuguaccagccagauccuucugaugcggacgacaugggcucugugcgaauccauuacccucgccacaggaccccugaccacccuuugggagggcucuccuggcaaauucuggaauacaacgaucgcugugagcauggccaacaucuuucgcggguccuaccuggccggagcuggccucgccuucagccugaugaagucccucgggggcgggagacgggggaccggagcgcaaggcgagacacucggcgaaaaguggaaacgccagcuuaaucagcugucuaagagcgaguuuaacaccuauaaaagauccgggauuauggaaguugaccggucugaggccaaggaaggacugaaaagaggcgagacaaccaagcacgcugucagccgcgggacggccaagcuccggugguucguggagagaaaucuggugaaaccggaaggaaaggucaucgaucuuggcugugggcgcggaggcugguccuacuauugcgcuggccugaaaaagguuacagaggugaaaggguacaccaagggaggccccgggcacgaggaaccuauucccauggccaccuacggauggaaccucgugaaacugcauucuggcaaggacgucuuuuucaucccucccgaaaagugugauacacugcucugcgacauuggggagagcuccccuaauccgaccaucgaggaaggacggacacuuagagugcugaaaaugguugagcccuggcugcgcggcaaccaguuuuguauuaagauccucaauccuuauaugcccagcguggucgaaacgcuggagcaaaugcagcggaaacacggcgggaugcuugugagaaacccucugucucgcaauuccacccaugagauguacuggguuagcugcggaacaggcaacaucgugucugcggucaauaugaccucccggaugcuccugaacagauucacaauggcccaccgcaagcccaccuaugaacgggauguggaccugggggcuggaacgagacacguggccgucgagccggaaguugcuaaccucgauauuaucggccagcgcauugagaauaucaaacaugaacacaagagcaccuggcauuacgacgaggauaacccuuauaagacaugggccuaccacgggucuuaugaggugaaacccuccggaagcgcuuccagcauggugaauggcgucgugaagcugcuuaccaaacccugggacguuauuccuauggugacacagaucgccaugaccgauacaacccccuuuggccaacagagagucuucaaggaaaaaguggacacgcggacaccuaaggcgaagcgcgggaccgcccagaucauggagguuaccgcuaaauggcuguggggauuucucucuagaaacaagaaaccgcggauuuguacaagagaagaguucacgcggaaggugcgcagcaaugccgcuaucggcgccgucuuuguggacgaaaaccaauggaacuccgccaaagaggcgguugaggaugaaagauucugggaccuggugcaucgggagcgcgaacuucacaagcaggggaagugcgcuaccugcgucuacaacaugaugggaaaaagagagaagaaacugggcgaguucgggaaggccaaaggcucucgggccauuugguacauguggcucggagcucgcuuucuggaguucgaggcccugggcuuuaugaaugaagaucacugguucagcagagagaacucccucucugggguggaaggagagggccugcauaaacuuggguauauccugcgggacauuagcaaaauccccggaggcaauauguacgcugaugacacagccgggugggauacccgcaucacagaggacgaucuccagaacgaagcgaagauuaccgacaucauggagccugaacacgcccugcuugcuaaguccauuuuuaaacugacauaucagaauaaggucgugagaguucaacggcccgccaaaaacggcaccgugauggaugucaucucucgcagagaccagcggggaagcggccagguggggacguacggacucaauaccuucacaaacauggaggcucagcugauucgccaaauggaauccgagggcaucuuuagcccuucugagcuggaaacccccaaccucgccgggagagugcuggauuggcuugagaagcauggaguugaacggcugaaaagaauggcgaucuccggcgacgacuguguggucaagccgauugaugaccgcuucgccacagcucucaccgcccugaaugauauggggaaggugcggaaagacaucccucagugggagcccagcaagggcuggaacgauuggcagcagguuccuuuuugcucucaccacuuccaucaacuuauuaugaaagacggaagagaaaucgugguccccugucgcaaucaggaugagcuggugggccgggcuagagucucccagggggccggauggagccuccgcgagacggcuugccugggcaaguccuaugcccagauguggcaacugauguacuuucaccggagagaccuccgccuggcggccaacgcuauuuguucugccgugccuguugauugggugcccacaagccggaccacaugguccauccaugcccaccaucaguggaugaccacggaagacaugcuuagcgucuggaauagaguguggauugaggaaaacccguggauggaggauaaaacccacaucucuuccuggggagacguuccuuaucugggaaagcgcgaagaccaguggugcggcagccucaucgggcugacagcucgggccaccugggcgacaaauauucaaguggcuaucaaccaggucagacggcuuauuggcaaugagaacuaccuggauuacaugaccucuaugaagagauucaaaaaugagagcgaccccgaaggagcccucugguga

SEQ ID NO: 19327 - RNA, 9879 nt, Artificial Sequence
  derived and/or modified CDS sequence (opt5) from DENV-1__EU482528__SS-prME
agcgugaccaugcugcucaugcugaugcccaccgcccuugcuuuccaccugacgaccagaggcggggaaccucauaugaucguguccaagcaggaacggggaaagucucuccuguuuaagacaagcgccggcguuaauaugugcacccuuauugcgauggaccugggggaguucugugaagauacaaugaccuacaagugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggcuaugguccaggccgauagcggaugcgugaucaacuggaagggccgcgaacucaaguguggguccggaauuuuuguuaccaaugaggugcacacauggaccgaacaguauaaauuccaagcggacucuccuaagcggcugagcgccgcuaucggcaaagccugggaggagggggucugcggcauuagauccgcuacgcgccuggaaaacaucauguggaagcagaucucuaacgagcucaaucauauucugcuugaaaacgacaugaaauuuacagugguugugggagaugucgccggcauccuggcccaggggaagaaaaugauucggccgcagcccauggaguacaagcacagcuggaaguccuggggaaaagcuaagaucauuggcgcggacgugcaaaauaccaccuucaucaucgaugggccuaacacacccgaauguccugacgaucagagagccuggaauauuugggagguggaggacuauggauuuggcaucuucaccacgaacauuuggcucaaacugcgcgauagcuacacacaggucugcgaccaccggcugaugucugcugccaucaaggauuccaaagccguucaugcugacaugggcuauuggauugaaagcgagaagaaugaaaccuggaaacuugccagagcgucuuucaucgaggugaaaacauguaucuggcccaagucccacacccucuggagcaacggggugcuggaaucugagaugauuaucccgaaaauuuacggaggcccuaucagccagcauaauuaucgccccggguacuuuacacaaaccgcuggaccuuggcaccugggcaagcucgagcuggauuucgaccuuugcgaagggacgaccgucgugguugaugagcacugcggaaaccggggccccucccugagaacaaccacagugaccggcaaaauuauccaugaaugguguugccggagcuguacgcucccuccccugcgcuuuaagggggaggacggaugcugguacggcauggagaucagaccggucaaggaaaaagaggaaaaucuggugaagucuaugguuuccgccgggagcggagagguggacuccuucucucuuggccuccuguguauuagcaucaugauugaagaggucaugcgguccagauggucucgcaaaaugcugaugacagggacccucgccguguuuuuccugcuuaucaugggacagcugacauggaacgaucucauucggcugugcaucaugguuggcgcuaaugccagcgacagaaugggcauggggaccaccuaucuggcgcuuauggcuacauuuaagaugcgcccuauguucgccgugggacugcucuuuagacggcugacgucccgcgagguccuccugcuuaccauuggccugucucucguggccagcguggaacugcccaacucccuggaggaacuuggggauggacuggcuaugggcaucaugauccucaaacugcucacagacuuccagagccaccaacugugggccacccuucugucucucacauuuauuaagaccacguucucccugcauuacgcuuggaagacaauggccaugguccugagcaucguuucucuuuuuccccugugucucuccaccaccagccagaaaacaaccuggcugccugugcuccuggggucucuuggaugcaagccgcugacaauguuccugauugcggagaauaaaaucuggggcagaaaguccuggccccucaacgaaggcauuauggccguggggaucgucagcauccugcuuuccagccugcucaaaaacgaugugccucuggcuggaccccucauugccggcgggaugcugaucgcuuguuauguuauuucuggaagcuccgccgaccuuucucuggagaaggccgcugaggugagcugggaagaggaagcggagcacuccggcgccucucauaauauccuggucgaagugcaggaugacgggacgaugaaaauuaaggaugaggagcgggacgauacccucacaauccugcuuaaggcuacccugcucgccguuagcggaguguacccucuguccauccccgccacacucuucgucugguauuuuuggcagaaaaagaaacaacgcucuggcgugcugugggacaccccuuccccucccgaagucgagagagcugugcuugaugacggcauuuaccggaucaugcagcgcgggcugcugggaagaucccagguuggcgugggggucuuccaggaaaacguguuucacacgauguggcacguuacccggggagccgugcucauguaucaaggcaagcgccuggagcccagcugggcgucugucaaaaaggaccuuauuuccuacgggggaggcuggagacugcagggcagcuggaauacaggggaggaaguccaggugaucgcuguugagcccggaaagaacccuaaaaauguccagaccgcccccggcacauucaagaccucugaaggggaggugggagccauugcucucgauuuuaaaccgggcacauccgggagcccuaucgugaaccgggaaggaaagauugucggccuguacggcaauggggugguuacgaccuccggaacauaugugucugccaucgcgcaagcuaaagccagccaggagggcccccucccugagaucgaagacgaggucuucagaaagcgcaaccugaccauuauggaucuucaucccggguccggaaagacccggagauaccugcccgccaucgugcgcgaagcuauuaaacggaagcugagaacacucauccuggccccuacgcgcguuguggcuagcgagauggccgaagcgcuuaaaggcaugccgauucgguaucagaccacagccgucaagucugagcacaccgggaaagagaucguggaccugaugugccaugcuacauuuaccaugagacuccugucccccguucgcgugccuaauuacaacaugaucauuauggaugaagcccacuucacggaccccagcucuaucgcugcccggggcuauauuagcacaagagucggaaugggcgaggccgcugcgaucuuuaugaccgccaccccucccggguccguggaggcuuucccucaaucuaaugccgugauucaggaugaagaacgggacaucccggagcgcagcuggaacuccggauacgaguggaucacagauuuucccggcaagaccgucugguucguuccuucuauuaagagcgggaaugacaucgccaacugucugcgcaagaauggaaagcgggugauucagcucucccgcaaaacauucgauaccgaauaucagaagacgaaaaacaacgacugggacuacguggucacaaccgauaucagcgagaugggcgcuaauuuuagagccgaccgggugauugaucccagacgcugccuuaagccuguuauccugaaggacgggcccgaacgggugauucuggcgggcccgaugccugucacaguggcuucugccgcccaaagacgcggacggaucggcagaaaccauaauaaagagggggaucaguacaucuauaugggacagccccucaacaaugacgaggaucacgcucacuggaccgaagccaagaugcugcuugacaacauuaauacgcccgagggcaucauuccugcgcuguucgaacccgagcgcgaaaaauccgccgcuaucgauggggaguaccggcucagaggagaggcccgcaagaccuuuguugaacugaugagacggggcgaccugccuguguggcucagcuauaaagucgcuuccgagggguuccaguacucugaucgcagauggugcuuugacggcgaacggaacaaucaagugcuugaggaaaacauggaugucgagauuuggacaaaggagggagaacgcaaaaagcugagaccgcgguggcuggacgccagaaccuauagcgacccccucgcucugcgcgaguucaaggaauuugccgcgggccggagauccgugucuggggaucuuauccuggagaucggaaaacucccucagcaucugacacagcgcgcccagaaugcucuggacaaccucguuaugcuucacaauagcgaacaaggcgggcgggccuacagacaugcuauggaggagcugcccgauaccauugaaacacugaugcuccuggcccuuaucgccgugcugaccggaggcgugacgcuguucuuucuguccggccgggggcugggaaagacaagcauuggccuccuuugugucauggcuucuuccguucugcuguggauggcgagcguggagccucacuggaucgccgcuucuauuauccucgaguucuuucugauggugcuucugauccccgagccggaccgccagagaaccccucaggauaaccagcucgccuaugucgugauugggcugcuguucaugauccucaccguugccgcuaaugagaugggacuucuggaaacaaccaaaaaggaccugggcauugggcacguggccgucgagaaccaucaccaugcggccaugcucgauguggaccugcaccccgcuuccgccuggacacuuuacgcugucgccacgaccaucauuacaccuaugaugcggcauaccaucgaaaacacaaccgcgaauauuagccugacggccaucgcuaaccaagccgcuauccucaugggacuggauaaaggcuggcccauuucuaagauggacaucggcgugccucugcucgcccuugggugcuacagccagguuaauccccugacccugacagcugccgugcucaugcuggucgcgcacuaugccauuaucggaccgggccuucaggcuaaggccacccgcgaggcucagaagagaacagccgccgggauuaugaagaacccuaccguggauggaaucguugcgaucgaccuggaucccguggucuacgacgcuaaauuugaaaagcagcucggccagauuaugcugcugauccucuguacgucccagauucuucugaugcggacaaccugggcccugugcgagucuaucacacucgcuaccgggccccugaccacacuuugggagggaagcccuggcaaauucuggaauacgaccauugccguguccauggccaacaucuuccgcggcagcuaucuggcuggggccggacucgcguuuucccugaugaagucucugggcgggggaagacggggcacaggggcccaaggagaaacccucggcgagaaguggaaacgccagcuuaaucagcugagcaaguccgaguucaacacauacaaaagaucuggcaucauggagguggaccggagcgaagcuaaggaggggcugaaaagaggagagaccacgaagcacgccguuucccgcggcacagcuaagcuccggugguuugucgaaagaaaucuggugaaaccggaggggaaggugauugaucuuggauguggccgcgggggauggucuuauuacugcgccggccugaaaaaggucaccgaaguuaaaggcuauaccaaaggcgggcccgggcaugaggaaccuauccccauggcgacauacggguggaaccucgugaaacugcacagcggaaaggacguguucuuuauuccucccgagaagugugauacccugcucugcgacaucggcgaguccagcccuaauccgacaauugaagaggggcggacgcuuagaguccugaaaaugguggaacccuggcugcgcggaaaccaguucuguaucaagauucucaauccuuacaugcccucuguuguggagacccuggagcaaaugcagcggaaacauggcggcaugcuugucagaaacccucugucccgcaauagcacacacgaaauguauugggugucuugcgggaccggaaacaucguuuccgccgugaauaugacaagccggaugcuccugaacagauuuaccauggcucaccgcaagcccacguacgagcgggaugucgaccugggcgccgggaccagacauguggcuguggaaccggaggucgccaaccucgauaucauuggacagcgcaucgaaaauauuaaacacgagcauaagucuacauggcacuaugacgaggauaacccuuacaagaccugggcuuaucauggcuccuacgaaguuaaacccagcggguccgccagcucuauggugaauggaguggucaagcugcuuacaaaacccugggacgugaucccuaugguuacccagauugcgaugacagauaccacgcccuucggccaacagagaguguuuaaggagaaagucgacacacggaccccuaaggccaagcgcggcaccgcucagaucauggaagugacagccaaauggcuguggggguuccucagcagaaacaagaaaccgcggaucuguacgagagaggaauuuacccggaagguucgcuccaaugcugccauuggagccguguucgucgacgagaaccaauggaacucugcgaaagaggcuguggaagaugagagauuuugggaccugguucaccgggaacgcgagcuucacaagcagggcaagugcgccacaugcguguauaacaugauggggaaaagagaaaagaaacugggagaguucggcaaggccaaagggagccgggcuaucugguacauguggcucggcgcccgcuuccuggaguuugaagcucugggauucaugaaugaggaucauugguuuuccagagaaaacucucucagcggcgucgagggggagggacugcacaaacuuggcuacauucugcgggacaucuccaaaauucccgggggaaauauguaugccgaugacaccgcgggcugggauacacgcaucaccgaagacgaucuccagaacgaggccaagaucacagacauuauggaaccugagcaugcucugcuugccaagucuaucuucaaacugaccuaccagaauaagguggucagagugcaacggcccgcuaaaaacgggacgguuauggaugugauuagccgcagagaccagcggggcuccggacaggucggcaccuaugggcucaauacauuuaccaacauggaagcccagcugauccgccaaauggagagcgagggaauuuucucuccuuccgaacuggagacacccaaccucgcgggcagagugcuggauuggcuugaaaagcacgggguggagcggcugaaaagaauggccaucagcggagacgacuguguugugaagccgaucgaugaccgcuuugcuaccgcccucacggcucugaaugauaugggcaagguccggaaagacauuccucagugggaacccucuaagggguggaacgauuggcaacaggugccuuucugcucccaccauuuucaccaacuuaucaugaaagacggcagaggaauuguugugcccugucgcaaucaggaugagcuggucggccgggccagagugagccagggggcuggauggucccuccgcgagacagccugccugggcaagucuuacgcgcagauguggcaacugauguauuuccaucggagagaccuccgccuggccgcuaacgccaucuguagcgccgucccuguggauuggguucccaccucccggacaaccuggagcauucacgcucaucaccaguggaugacgaccgaagacaugcuuucuguguggaauagagucuggaucgaggaaaacccguggauggaggauaaaacacacauuuccagcuggggagacgugccuuaccugggaaagcgcgaagaccaguggugcggcucucucaucgggcugaccgcccgggcgacaugggcuaccaauauccaaguugccauuaaccaggugagacggcuuaucggcaaugagaacuaucuggauuacaugacaagcaugaagagauuuaaaaaugaguccgaccccgaaggagcccucugguga

SEQ ID NO: 19328 - RNA, 9879 nt, Artificial Sequence
  derived and/or modified CDS sequence (opt5) from DENV-1__EU482529__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacacugcaagagaccuggaaucgccaggaccuccuggugaccuucaaaacagcucacgcgaagaagcaggaagucgugguucugggaucucaagagggcgccaugcacacggcucucaccggggccacagaaauucagaccagcggaacaaccacgaucuuugccggccaucugaaaugcagacuuaagauggauaaacugacacucaaggggauguccuaugugauguguaccggcagcuucaaacuggagaaggaagucgcugagacccagcacggaacagugcugguucagauuaaguacgagggcaccgacgccccgugcaaaaucccuuucucuacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagccacacccaggucugcgaccaccggcucauguccgcggccaucaaagauagcaaggcuguucaugccgacaugggcuauuggaucgaaucugagaaaaaugaaacauggaagcuggccagagcuuccuucauugaggugaagaccuguaucuggcccaaaagccacacacuguggucuaacggggugcucgaauccgagaugauuaucccgaagauuuacggaggcccuaucagccaacauaauuaucgccccggguacuucacccagacggccggaccuuggcaccugggcaaacuugagcuggauuuugaccucugcgaagggaccacagucgugguugaugagcacugcggaaaccggggccccucucugagaaccacaaccgugacgggcaagaucauucaugaaugguguugccggagcuguacacugccuccccuucgcuucagaggggaggacggaugcugguacggcauggagauccggccggucaaagaaaaggaggaaaaucucgugaaguccaugguuagcgcggggucuggagagguggacuccuuuagccugggccugcucuguauuuccaucaugauugaagaggucaugagaucucgcuggagccggaaaaugcugaugaccgggacacuugcuguguucuuucugcucaucaugggacagcugaccuggaacgaucugauuagacuuugcaucaugguuggcgccaaugccuccgaccgcaugggcauggggaccacauaucuggcucucauggccacguucaagaugagaccuauguuugcggugggacuccuguuccggcgccugaccucuagagagguccuucugcucacaaucggccugagccugguggcuuccguggaacuucccaacucucuggaggaacucggggauggacuggccaugggcauuaugauccucaaacugcuuaccgacuuucaaagccaccagcugugggccacacuccugucccugaccuucauuaagacgacauuuagccuucauuacgcuuggaaaaccauggccaugguccugucuaucguuucccucuucccccugugucucagcaccacaucucagaagaccacauggcugccugugcuucuggggucccugggaugcaagccgcucacgauguuucugauugcugagaauaaaaucuggggccggcgcagcuggccccuuaacgaaggcaucauggccguggggauugucucuauccugcucuccagccugcucaagaacgaugugccucuggcgggaccccuuauugccggcgggaugcugaucgcuuguuauguuauuuccggaagcucugccgaccugagccucgagaaagcugccgagguguccugggaagaggaagccgagcacucuggcgcuagccauaauauccuggucgaagugcaggaugacgggaccaugaagaucaaagaugaggagagagacgauacacuuaccauucugcucaaggcgacacugcucgccguuuccggaguguacccucugucuauccccgcuacccuuuucgucugguauuucuggcagaagaagaagcagcggagcggcgugcugugggacacgccuagcccucccgaagucgagcgcgccgugcuggaugacggcauuuacagaaucaugcagcgggggcuccugggacgcucucagguuggcgugggggucuuucaagaaaacguguuccacaccauguggcacguuacaagaggagccgugcuuauguaucagggcaaacggcuggagcccagcugggcuuccgucaagaaagaccucauuagcuacgggggaggcuggagacugcagggcucuuggaauaccggggaggaaguccaggugaucgccguugagcccggaaagaacccuaaaaauguccaaacagcgcccggcaccuuuaagacaccggaaggggaggugggagcuauugcccucgauuucaagccuggcacguccgggagccccaucgugaaccgcgaaggaaaaaucgucggccuguacggcaauggggugguuaccacaucuggaaccuauguguccgccauugcucaggccaaggcgagccaggagggcccucuucccgagaucgaagacgaggucuuucggaaaagaaaccugaccauuauggaucugcaucccggguccggaaagacacgccgguaccucccugcuaucgugagagaagccauuaaacgcaagcugcggacgcuuauccuggccccgaccagaguuguggcuucugagauggccgaagcucucaagggcaugcccauccgcuaucaaacaaccgccgucaaaagcgagcacacagggaaggagauuguggaccugaugugccaugcgaccuucacgaugcggcugcucuccccuguuagagugcccaauuacaacaugaucauuauggaugaagcccacuuuacagacccuagcucuaucgcugcccggggcuauauuuccacccgcgucggaaugggcgaggcugccgccaucuucaugaccgcuacacccccugggagcguggaagcguuuccgcagucuaaugccgugauccaggaugaggaaagagacauucccgagcggagcuggaacuccggauacgaguggaucaccgauuucccuggcaaaacagucugguuuguucccucuauuaagagcgggaaugacaucgcuaacugucuucgcaaaaauggaaagagagugauucagcugucccggaagaccuucgauacggaauaucagaagaccaagaacaacgacugggacuacguggucaccacagauaucucugagaugggcgccaauuucagagccgaccgcgugauugauccucggagaugccugaaacccguuauccucaaggacgggccggaacgcgugauccuggcuggcccuaugcccgucaccguggccagcgcggcucagcggagaggacgcauuggccggaaccauaauaaagagggggaucaguacaucuauaugggacagccccuuaacaaugacgaggaucacgcccacuggacggaagccaagaugcugcucgacaacauuaauaccccugagggcaucauucccgcucuguuugaaccugagagagaaaaguccgccgcgaucgauggggaguaccgccugagaggagaggcccggaaaacauucguugaacucaugcgcagaggcgaccuuccgguguggcugagcuauaaggucgcuucugagggguuucaauacuccgaucggcgcuggugcuucgacggcgaaagaaacaaucaggugcuggaggaaaacauggaugucgagaucuggaccaaagagggagaacggaagaaacucagaccccgcuggcuggacgcccggacauauagcgacccucuugcucugagagaguuuaaggaguucgccgcuggccgccgguccgugucuggggaucucauucuggagaucggaaaacugccccagcaucucacccagagagcccaaaaugcgcuugacaaccugguuaugcugcacaauagcgaacagggcgggcgggccuaccgccaugcuauggaggagcucccugauacaauugaaacccugaugcuucuggcccucaucgcugugcugacgggaggcgugacacuguuuuuccucuccggcagagggcuuggaaagaccucuauuggccugcugugugucauggccagcuccguucuccuguggauggccagcguggagccccacuggaucgcugcgucuaucauucuugaauuuuuccugauggugcuccugaucccggagccugaccggcagcgcacaccccaggauaaccaacuggccuaugucgugauugggcuccuuuuuaugauccugacaguugcugccaaugagaugggacugcucgaaaccacaaagaaagaccugggcauugggcacguggccgucgagaaccaucaccaugcugccaugcuugauguggaccugcacccugcguccgccuggacgcucuacgcugucgccaccacaaucauuacccccaugaugagacauacaaucgaaaacaccacggcuaauaucagccugaccgccauugcgaaccaggccgcuauccugaugggacucgauaagggcuggccuauuucuaaaauggacaucggcgugccccuucuggcccuggggugcuacucccagguuaauccgcucacacugaccgcugccgugcuuaugcuggucgcucacuaugccauuaucggaccuggccuccaagcgaaggccacacgggaggcucagaaacgcaccgccgcugggaucaugaagaaccccacgguggauggaauuguugccaucgaccuggaucccguggucuacgacgccaaguucgaaaaacagcugggccagauuaugcuccuuauccuguguacaagccaaauucugcucaugagaaccacaugggcgcugugcgagucuaucacccuugcuaccgggccucugacaacgcucugggagggaagcccgggcaaguuuuggaauaccacaaucgccguguccauggcuaacauuuuccggggcucuuaucuggccggggccggacuggcuuucagccucaugaaaucccuuggcgggggacgcagaggcaccggggcccagggagaaacacugggcgagaaguggaaacggcagcugaaucagcucagcaaguccgaauuuaacaccuacaagagaucuggcaucauggagguggaccgcagcgaagcgaaagaggggcugaagcggggagagacgacaaaacacgccguuuccagaggcaccgcuaaacuucgcugguucgucgaacggaaucuggugaaacccgaggggaaggugauugaucucggauguggcagagggggauggucuuauuacugcgccggccugaagaaagucaccgaaguuaagggcuauacaaaagggggaccuggccaugaggaacccaucccuauggcuaccuacggguggaaccuggugaagcuccacagcggaaaagacguguuuuucauucccccugagaagugugauacacuucugugcgacaucggcgaguccucuccgaaucccacgauugaagaggggcgcacccugcggguccucaaaaugguggaaccuuggcugagaggaaaccaauuuuguaucaagauccuuaaucccuacaugccuagcguuguggagacacuggagcagaugcagcgcaagcauggcggcaugcucguccggaacccccuguccagaaauagcacccacgaaauguauugggugucuugcgggacaggaaacauuguuuccgccgugaauaugaccagccgcaugcugcucaaccgguucacgauggcgcacagaaaaccgaccuacgagcgcgaugucgaccugggcgccgggacaagacauguggcuguggaaccugaggucgccaaccuugauaucauuggacagcggaucgaaaauauuaagcacgagcauaaaucuaccuggcacuaugacgaggauaaccccuacaagacaugggcuuaucauggcuccuacgaaguuaaacccagcgggucugccuccagcauggugaauggaguggucaagcugcucaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcuguggggguuucuuuccagaaacaagaagccccggaucuguacccgcgaggaguucacaagaaaaguucggagcaaugcugccauuggagcuguguuugucgacgagaaccaguggaacucugccaaggaggccguggaagaugagcgcuucugggaccugguucacagagaacgggagcuccacaaacagggcaagugcgcgaccugcguguauaacaugauggggaaacgcgaaaagaagcugggagaguuuggcaaagcuaaggggagcagagccaucugguacauguggcugggcgcccgguuccucgaguucgaagcucugggauuuaugaaugaggaucauugguucucccgcgaaaacucucuuagcggcgucgagggggagggacugcacaaacucggcuacauucugagagacaucuccaagaucccugggggaaauauguaugccgaugacacagcuggcugggauacccggauuacagaagacgaucuucagaacgaggcccgcaucaccgacauuauggaacccgagcaugcgcugcucgccaaaucuaucuuuaagcugacguaccaaaauaaaguggucagagugcagcggccugcuaagaacgggaccguuauggaugugauuagccgcagagaccagcggggcuccggacaggucggcacauaugggcugaauaccuucacaaacauggaagcccaacucaucagacagauggagucugagggaaucuuuagccccuccgaacuggagaccccgaaccuugcugaacgcgugcuggauuggcucgagaaguacggcguggaacggcugaaaagaauggccauuagcggggacgacuguguugugaagccuaucgaugaccgcuucgcgacggcccuuacagcucugaaugauaugggaaaaguccggaaggacauuccccagugggagccuucuaaaggcuggaacgauuggcagcaagugcccuuuugcucccaccacuuccaucagcucaucaugaaggacgggagagagauuguugugccuugucgcaaucaggaugaacuggucggccgggccagagugagccagggagcuggcuggucucugcgcgagaccgccugccucgggaaguccuaugcucaaauguggcagcugauguacuuucaccggagagaccuucgccuggccgcgaacgccaucuguagcgcuguccccguggauuggauuccgacaucccggaccacguggucuauccaugcccaccaucaguggaugaccacagaagacaugcucagcguuuggaauagaguguggaucgaggaaaacccuuggauggaggauaaaacccacauuuccagcuggggagacguccccuaucugggcaagcgggaggaccaauggugcgggucucuuaucggacugacagccagagcuaccugggccacaaauauucagguggcgaucaaccagguucgccggcucauuggcaaugaaaacuaccuggauuacaugaccuccaugaaaagauucaagaaugagggggaccccgaaggcgcucugugguga

SEQ ID NO: 19329 - RNA, 9879 nt, Artificial Sequence
  derived and/or modified CDS sequence (opt5) from DENV-1__EU482531__SS-prME
agcgugaccaugcugcucaugcugaugcccaccgcccuugcuuuccaccugacgaccagaggcggggaaccucauaugaucgucacaaagcaggaacggggaaaaucccuccuguuuaagaccucugccggcguuaauaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacguccagaauacaaccuuuauuaucgaugggccuaacacccccgaauguccuaaugaccagagagccuggaacauuugggagguugaggauuauggauucggcaucuuuacaaccaauauuuggcugaagcugcgcgacuccuacacgcaggcuugcgaucaccggcuuaugagcgcggccaucaaagacucuaaggcugugcaugccgauaugggcuauuggaucgaauccgagaaaaacgaaacauggaagcucgccagagcuagcuucauugaggugaagaccuguaucuggcccaaaucucacacacugugguccaaugggguccuggaaagcgagauggugauuccgaagaucuacggaggcccuauuucucaacauaacuaucgccccggguacuucacccagacagccggaccuuggcaccucggcaaacuggagcuugacuuugaucugugcgaagggaccacgguuguggucgacgagcacugcggaaaucggggccccagccucagaaccacaaccgugacaggcaagaucauccaugaaugguguugccgguccuguacccugccuccccugcgcuucaaaggggaggauggaugcugguacggcauggagauuagaccgguuaaggaaaaggaggaaaaccuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaaugaccugauccggcuuugcauuauggucggcgccaacgccucugauagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaauagccuggaggaacucggggacggacuggccaugggcaucaugauucucaagcugcuuaccgauuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucgcugagaacaagauuuggggcagaaaaucuuggccccugaacgaaggcaucauggccguggggguuguguccauccuccugagcucccuccugaagaaugacgucccucuugcgggaccccugauugccggcgggaugcugaucgcuuguuaugugauuagcggaucuagcgccgaucucucccuggagaaagcugccgagguuucuugggaagaggaagccgagcacagcggcgcuucccauaacauccuuguggaaguccaggacgaugggacaaugaagauuaaagacgaggagcgggaugacacgcugaccauccuccugaaggcgacacuccuggccgugucuggagucuacccucuuagcauccccgcuacccuguucgugugguauuuuuggcaaaagaaaaagcagcgcuccggcguucugugggauacaccuucucccccggaaguggagagagccguccucgacgauggcauuuaccggaucaugcagcgcgggcugcuuggaagaagccaggugggcguugggguguuccaagaaaaugucuuccacaccauguggcacgugacgcggggagccgugcugauguaucagggcaaacgccucgagccuuccugggcuagcguuaagaaagaccugauuucuuacgggggaggcuggagacuccagggcuccuggaacaccggggaggaaguccaggugaucgccguggagcccggaaagaauccuaagaacguccaaacagcgcccggcaccuuuaaaacaccggaaggggaggugggagcuauugcccuggacuucaagccuggcaccagcgggucucccaucguuaaucgggaaggaaaaauugugggccuuuacggcaacggggucgugacaacguccggaaccuauguuagcgccaucgcucaggccaaggcgucccaggagggcccucugcccgagaucgaagaugagguguuuagaaaacgcaaucugacaauuauggaccuccaucccgggucuggaaagacccggagauaccugccugcuaucguccgcgaagccauuaagcggaaacuuagaacccugauccucgccccgacacgcgugguugcuagcgagauggccgaagcucugaagggcaugcccauucgguaucaaacgaccgccgugaaauccgagcacacagggaaggagaucgucgaucugaugugccaugcgaccuucacaaugagacuccuuagcccugugcgcgugcccaacuacaauaugaucauuauggacgaagcccacuuuaccgauccuucuuccaucgcugcccggggcuauauuagcacgagagucggaaugggcgaggcugccgccaucuucaugacagcuacacccccugggucuguugaagcguuuccgcagagcaacgccgugauucaggacgaggaacgggauauccccgagcgcuccuggaacucuggauacgaguggaucaccgacuucccuggcaaaacagugugguuuguccccagcauuaaguccgggaacgauaucgcuaauugucugagaaagaacggaaaacgggugauucagcugucucgcaagaccuucgacacagaauaucagaagaccaagaacaaugauugggacuacguugugacgacagacaucagcgagaugggcgccaacuuuagagccgaucgggucauugacccuagacgcugccucaaacccgugauccugaaggaugggccggaacggguuauucuugcuggcccuaugcccgugaccgucgccuccgcggcucagagacgcggacggaucggcagaaaucauaacaaggagggggaccaguacaucuauaugggacagccccugaauaacgaugaggaccacgcccacuggacagaagccaaaaugcuccuggauaauauuaacaccccugagggcaucauucccgcucuguucgaaccugagcgcgaaaagagcgccgcgaucgacggggaguaccggcucagaggagaggcccgcaaaacguucguggaacuuaugagacggggcgaucugccggucuggcugucuuauaagguggcuuccgagggguuucaauacagcgaccgcagauggugcuucgauggcgaacggaauaaccagguucucgaggaaaauauggacguggagauuuggaccaaagagggagaacgcaagaaacugagaccccgguggcuugaugccagaacauauuccgacccucuggcucuccgcgaguuuaaggaguucgccgcuggccggagaucugugagcggggaccugauccuggagaucggaaagcucccccagcaucuuacccagcgcgcccaaaacgcgcuggauaaucuggucaugcuccacaacuccgaacagggcgggcgggccuacagacaugcuauggaggagcugccugacacaauugaaacccuuaugcugcucgcccugaucgcuguucugacaggaggcgugacccucuuuuuccuuucuggccgggggcugggaaaaacgagcauuggccugcucugugugauggccuccagcguccugcuuuggauggccucuguggagccccacuggaucgcugcguccauuauccuggaauuuuuccucaugguucugcugaucccggagccugaucgccagagaacaccccaggacaaucaacucgccuauguggucauugggcuucuguuuaugauccugaccguggcugccaacgagaugggacuccuggaaaccacaaagaaagaucuuggcauugggcacgucgccguggagaaccaucaccaugcuaccaugcuggacguugaucuccacccugccagcgcguggacacuguacgccguggcuacgaccaucauuacacccaugaugcggcauaccaucgaaaauacaaccgccaacauuucucugacggcuaucgccaaucaggcggccauccucaugggacuugacaagggcuggccuauuuccaaaauggauaucggcgucccccugcuggcucucgggugcuacagccaggugaacccgcugacccuuacagccgcuguucugaugcucguggcccacuaugcuauuaucggaccuggccugcaagccaaggcgacccgcgaggcccagaagagaacagcugccgggauuaugaaaaaucccaccgucgacggaaucguggcuaucgaucuggaccccgugguuuacgaugccaaguucgaaaaacagcucggccagauuaugcuucugauccuguguacgucucaaauucuccugaugcggacaaccugggcccuuugcgagagcaucacacuggcgaccgggccucucaccacacugugggagggauccccgggcaaguuuuggaacacgaccauugcugucucuauggccaauaucuuccgcggcagcuaucuggcuggggccggacucgccuuuucccuuaugaaaagccugggcgggggaagacggggcacaggggcucagggagaaacccugggcgagaaguggaagcgccagcucaaccagcuguccaaaucugaguucaauaucuacaagagaagcggcauuauggagguggaccgguccgaagccaaagaggggcuuaagagaggagagacaacccgccacgcggugucucggggcacggccaaacugagaugguucgucgaacgcaaccucguuaagcccgaggggaaggugaucgaccugggauguggcagagggggauggagcuauuacugcgcuggccugaaaaaggugacagaagucaaaggcuauaccaaagggggaccuggccaugaggaacccauuccuauggccaccuacggguggaaucucgugaaacuucacuccggaaaggaugucuuuuucacacccccugagaaaugugacacccugcugugcgauaucggcgagucuagcccgaaccccacaauugaagaggggagaacgcuccgcgugcugaagauggucgaaccuuggcuucggggaaaucaauuuuguaucaagauucugaaccccuacaugccuuccgugguugagacccucgagcagaugcagagaaaacauggcggcaugcuggugcgcaauccccugagccggaacucuacacacgaaauguauugggucuccugcgggaccggaaauaucgugagcgcugugaacaugacaucuagaaugcuccugaaccgcuucaccauggcccaccggaagccgacguacgagagagacgucgaucuuggcgcggggacccgccauguugccguggaaccugagguggcuaaucuggacaucauuggacagagaaucgaaaacauuaaacacgagcauaaguccacauggcacuaugaugaggacaaucccuacaaaaccugggccuaucauggcagcuacgaagucaagcccucuggguccgcuagcuccauggugaacggaguugugaagcuccugacaaaaccuugggaugucauccccauggugacccaaauugccaugacagacaccacgccuuuuggccagcagcggguuuucaaggagaaaguggauacacgcaccccgaaggcuaaaagaggcaccgcccaaaucauggaagucacagcgcgguggcuuuggggguuucugagcagaaauaagaagccccggaucuguacgcgcgaggaguucaccagaaaagugcggucuaacgccgcuauuggagccguuuuuguggacgagaaucaguggaacagcgcuaaggaggccgucgaagacgagcgcuucugggaucucgugcagaaagaaagagagcugcacaagcagggcaaaugcgccacaugcgucuauaauaugauggggaagcgggaaaagaaacugggagaguuuggcaaggcgaaagggucccgcgcuaucugguacauguggcucggcgccagauuccuggaguuugaagcccuuggauucaugaacgaggaccacugguucucucgggaaaauagccuguccggcguggagggggagggacuccauaagcugggcuacauucuucgcgauaucucuaaaauuccugggggaaacauguaugcugacgauaccgccggcugggacacaagaaucaccgaagaugaccugcaaaaugaggcuaagaucacagauauuauggaacccgagcacgcccuccuggcgaccagcaucuuuaaacugacguaccagaacaagguugugcggguccagcgcccugccaagaaugggaccgugauggacgugauuuccagacgggaucagcgcggcucuggacaaguuggcacauaugggcucaacaccuucacaaacauggaagcucagcugaucagacagauggagagcgagggaauuuuucuucccuccgaacuggagaccccgaaucucgccgaacgggugcuggacuggcuugagaaacauggcgucgaaagacugaagcgcauggcuaucagcggggaugacugugugguuaaaccuaucgacgaucgguucgccacggcgcucacagcccugaacgacaugggaaaggugagaaaagauauuccccagugggagccuucuaagggcuggaaugacuggcaacagguccccuuuugcucccaccacuuccaucagcugaucaugaaggaugggcgcgagauuguggucccuugucggaaccaggacgaacucgugggcagagcucgcguuagccaaggagccggcuggucucugcgggagaccgcuugccuugggaaauccuacgcccagauguggcagcugauguauuuucacagacgcgaucuccggcuggcugccaaugcgaucuguagcgccgugcccgucgacugggugccgacauccagaaccacguggucuauucaugcucaccaucaauggaugaccacagaagauaugcuuagcguuuggaaccgcguguggaucgaggaaaauccuuggauggaggacaagacccacgucuccagcuggggagaugugcccuaccugggcaaacgggaggaccaguggugcgggucucucauuggacugacagccagagccaccugggcuuccaacauccagguggccaucaaucagguucggagacugauuggcaacgaaaauuaucucgacuacaugacaagcaugaagcgcuucaaaaacgagggggaucccgaaggcgcgcugugguga

SEQ ID NO: 19330 - RNA, 9879 nt, Artificial Sequence
  derived and/or modified CDS sequence (opt5) from DENV-1__EU482532__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaacaugugcacccuuaucgcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccaccacgcgccuggaaaacaucauguggaagcagauuucuaacgagcucaaucauauccugcuugaaaacgacaugaaauuuacaguuguggucggagauguggccggcauucuggcucaggggaagaaaaugauccggccgcagcccauggaguacaaguauagcuggaaguccuggggaaaagccaagauuaucggcgccgacgugcaaaauaccaccuucaucauugaugggccuaacacacccgaauguccugacgaucagagagcuuggaauaucugggaggucgaggacuacggauuuggcauuuucaccacgaacaucuggcucaaacugcgcgauagccacacacagguuugcgaccaccggcugaugucugcggccauuaaggauuccaaagcugugcaugccgacaugggcuauuggaucgaaagcgagaagaaugaaaccuggaaacuugccagagcuucuuucaucgaggugaaaacauguauuuggcccaagucccacacccucuggagcaacgggguccuggaaucugagaugaucauuccgaaaaucuacggaggcccuauuagccagcauaauuaucgcuccggguacuuuacacaaaccgccggacccuggcaccugggcaagcucgagcuggauuucgaccuuugcgaagggacgaccgugguuguggaugagcacugcggaaaccggggcccuagccugagaacaaccacagucaccggcaaaaucauccaugaaugguguugccggucuuguacgcugcccccucugcgcuuuaagggggaggacggaugcugguacggcauggagauuagacccgugaaggaaaaagaggaaaaucugguuaaguccauggugagcgcgggguccggagaggucgacucuuucagccuuggccuccuguguaucuccauuaugaucgaagaggugaugcggucuagauggagccgcaaaaugcugaugacagggacccucgcugucuuuuuccugcuuauuaugggacagcugacauggaacgaucucauccggcugugcauuauggugggcgccaaugccuccgacagaaugggcauggggaccaccuaucuggcucuuauggccacauuuaagaugcgcccgauguucgcggucggacugcucuuuagacggcugacgucucgcgaggugcuccugcuuaccaucggccugagccucguggcuuccgucgaacugccuaacagccuggaggaacuuggggauggacuggccaugggcaucaugauucucaaacugcucacagacuuccagucucaccaacugugggccacccuucugucccucacauuuaucaagaccacguucagccugcauuacgcuuggaagacaauggccaugguucugucuauugugucccuuuuuccccugugucucagcaccaccucucagaaaacaaccuggcugcccgugcuccuggggucccuuggaugcaagccucugacaauguuccugaucgcugagaauaaaauuuggggcagaaagagcuggccgcucaacgaaggcaucauggccgucgggaucguguccauucugcuuagcucucugcucaaaaacgauguuccccuggcgggaccucucaucgccggcgggaugcugauugcuuguuaugugaucagcggauccucugccgaccuuagccuggagaaggcugccgaggucuccugggaagaggaagccgagcacucuggcgcuagccauaauauucugguggaaguucaggaugacgggacgaugaaaaucaaggaugaggagcgggacgauacccucacaauccugcuuaaggcgacccugcucgccguguccggagucuacccccugucuauuccugcuacacucuucgugugguauuuuuggcagaaaaagaaacaacgcagcggcguccugugggacacccccuccccucccgaaguggagagagccguucuugaugacggcaucuaccggauuaugcagcgcgggcugcugggaagaagccaggugggcgucgggguguuccaggaaaacguuuuucacacgauguggcacgugacccggggagccguccucauguaucaaggcaagcgccuggagccgucuugggcuuccgugaaaaaggaccuuaucagcuacgggggaggcuggagacugcagggcucuuggaauacaggggaggaagugcagguuauugccgucgagccuggaaagaaccccaaaaaugugcagaccgcgccuggcacauucaagaccuccgaaggggaggugggagcuaucgcccucgauuuuaaacccggcacaagcggguccccgauugucaaccgggaaggaaagaucgugggccuguacggcaaugggguugugacgaccucuggaacauaugucagcgccaucgcucaagccaaagcgucccaggagggcccucuccccgagauugaagacgagguguucagaaagcgcaaccugaccaucauggaucuucauccugggagcggaaagacccggagauaccugcccgcuauuguucgcgaagccaucaaacggaagcugagaacacucauucuggcccccacgcgcguggucgcuucugagauggccgaagcucuuaaaggcaugccuauccgguaucagaccacagccgugaaguccgagcacaccgggaaagagaucguugaccugaugugccaugcgacauuuaccaugagacuccugagcccggugcgcguccccaauuacaacaugauuaucauggaugaagcccacuucacggacccuucuagcauugcugcccggggcuauaucuccacaagagugggaaugggcgaggcugccgccauuuuuaugaccgcuacacccccugggucuguggaagcguucccccaaagcaaugccgucauccaggaugaggaacgggacaucccugagcgcuccuggaacucuggauacgaguggauuacagauuuuccgggcaagaccguuugguucgugcccagcaucaaguccgggaaugacauugcuaacugucugcgcaagaauggaaagcgggugauccagcucagccgcaaaacauucgauaccgaauaucagaagacgaaaaacaacgacugggacuacgucgugacaaccgauauuucugagaugggcgccaauuuuagagccgaccggguuaucgauccuagacgcugccuuaagcccgugauucugaaggacgggccugaacgggucauccuggcuggccccaugccggugacaguugccuccgcggcucaaagacgcggacggaucggcagaaaccauaauaaagagggggaucaguacauuuauaugggacagccucucaacaaugacgaggaucacgcccacuggaccgaagccaagaugcugcuugacaacaucaauacgcccgagggcauuauccccgcucuguucgaaccugagcgcgagaaguccgccgcgauugauggggaguaccggcucagaggagaggcccgcaagaccuuuguggaacugaugagacggggcgaccugcccgucuggcucuccuauaaaguggcuucugagggguuccaguacagcgaucgcagauggugcuuugacggcgaacggaacaaucaaguccuugaggaaaacauggauguggagaucuggacaaaggagggagaacgcaaaaagcugagaccucgguggcuggacgccagaaccuauuccgacccgcucgcucugcgcgaguucaaggaauuugccgcuggccggagaucuguuagcggggaucuuauccuggagauuggaaaacucccccagcaucugacacagcgcgcccagaaugcgcuggacaaccucgugaugcuucacaauuccgaacaaggcgggcgggccuacagacaugcuauggaggagcugccugauaccaucgaaacacugaugcuccuggcccuuauugcugugcugaccggaggcgucacacucuucuuucugagcggccgggggcugggaaagacaucuaucggccuccuuuguguuauggccuccagcgugcugcuguggauggccucuguggagccccacuggauugcugcguccaucauccucgaguucuuucugaugguccuucugauuccugagcccgaccgccagagaaccccgcaggauaaccagcucgccuaugugguuaucgggcugcuguucaugauucucaccguggcugccaaugagaugggacuucuggaaacaaccaaaaaggaccugggcaucgggcacgucgccgcugagaaccaucaccaugccgcgaugcucgauguggaccugcacccugccagcgcuuggacacuuuacgccgucgcuacgaccauuaucacacccaugaugcggcauaccauugaaaacacaaccgccaauaucucucugacggcgaucgccaaccaagcugccauucucaugggacuggauaaaggcuggccuaucagcaagauggacauuggcgugccccugcucgcucuugggugcuacucccagguuaauccucugacccugacagccgcugugcucaugcuggucgcccacuaugcgaucauuggacccggccuucaggccaaggcuacccgcgaggcccagaagagaacagcugccgggaucaugaagaacccgaccguggauggaaucguugccauugaccuggauccuguggucuacgacgcgaaauuugaaaagcagcucggccagaucaugcugcugauucucuguacgucucagauccuucugaugcggacaaccugggcucugugcgagagcauuacacucgccaccgggccccugaccacacuuugggagggaucccccggcaaauucuggaauacgaccaucgcugugagcauggccaacaucuuccgcggcuccuaucuggccggggcuggacucgccuuuucucugaugaaaagccugggcgggggaagacggggcacaggggcgcaaggagaaacccucggcgagaaguggaaacgccagcuuaaucagcuguccaagucugaguucaacacauacaaaagaagcggcauuauggagguggaccgguccgaagccaaggaggggcugaaaagaggagagaccacgaagcacgcuguuucucgcggcacagccaagcuccggugguuugucgaaagaaaucuggugaaaccugaggggaaggugaucgaucuuggauguggccgcgggggauggagcuauuacugcgcuggccugaaaaaggucaccgaaguuaaaggcuauaccaaagggggaccgggccaugaggaacccauuccuauggccacauacggguggaaccucgugaaacugcacuccggaaaggacguguucuuuauucccccugagaagugugauacccugcucugcgacauuggcgagagcucucccaauccuacaaucgaagaggggcggacgcuuagaguccugaaaaugguggaaccguggcugcgcggaaaccaguucuguauuaagauccucaaucccuacaugccuuccguuguggagacccuggagcaaaugcagcggaaacauggcggcaugcuugucagaaacccccugagccgcaauucuacacacgaaauguauuggguguccugcgggaccggaaacaucguuagcgcggugaauaugacaucucggaugcuccugaacagauuuaccauggcccaccgcaagccuacguacgagcgggaugucgaccugggcgcugggaccagacauguggccguggaacccgaggucgcuaaccucgauauuaucggacagcgcauugaaaauaucaaacacgagcauaaguccacauggcacuaugacgaggauaacccguacaagaccugggccuaucauggcagcuacgaaguuaaaccuuccgggagcgcuucuagcauggugaauggaguggucaagcugcuuacaaaacccugggacgugauucccaugguuacccagaucgccaugacagauaccacgccuuucggccaacagagaguguuuaaggagaaagucgacacacggacccccaaggcgaagcgcggcaccgcccagaucauggaagugacagcuaaauggcuguggggguuccucuccagaaacaagaaaccucggauuuguacgagagaggaauuuacccggaagguucgcucuaaugccgcuaucggagccguguucgucgacgagaaccaauggaauagcgccaaagaggcgguggaagaugagagauuuugggaccugguucaccgggaacgcgagcuucacaagcagggcaagugcgcuacaugcguguauaacaugauggggaaaagagaaaagaaacugggagaguucggcaaggccaaagggucccgggccauuugguacauguggcucggcgcucgcuuccuggaguuugaagcccugggauucaugaaugaggaucauugguuuucuagagaaaacagccucuccggcgucgagggggagggacugcacaaacuuggcuacauccugcgggacauuucuaaaauccccgggggaaauauguaugcugaugacaccgccggcugggauacacgcaucaccgaagacgaucuccagaacgaggcgaagauuacagacaucauggaacccgagcaugcccugcuugcuaagagcauuuucaaacugaccuaccagaauaagguggucagagugcaacggccugccaaaaacgggacgguuauggaugugaucucccgcagagaccagcggggcagcggacaggucggcaccuaugggcucaauacauuuaccaacauggaagcucagcugauucgccaaauggagucugagggaaucuucucccccagcgaacuggagacaccuaaccucgccggcagagugcuggauuggcuugaaaagcacgggguggagcggcugaaaagaauggcgaucucuggagacgacuguguugugaagcccauugaugaccgcuuugccaccgcucucacggcccugaaugauaugggcaagguccggaaagacaucccgcagugggaaccuuccaagggguggaacgauuggcaacaggugcccuucugcagccaccauuuucaccaacuuauuaugaaagacggcagagagaucguugugccuugucgcaaucaggaugagcuggucggacgggcuagagugucccagggcgccggguggucucuccgcgaaacagcuugccugggaaagagcuacgcccagauguggcaacugauguauuuccaucggagagaccuccgccuggcggccaacgcuauuuguuccgccguccccguggauuggguuccuaccagccggacaaccuggucuauccacgcccaucaccaguggaugacgaccgaggacaugcuuuccguguggaauagagucuggauugaagagaaccccuggauggaagauaaaacacacaucagcucuuggggcgacgugccguaccuggggaagcgcgaggaccaguggugcggaagccucaucggccugaccgcucgggccacaugggcgaccaauauucaaguugcuaucaaccaggugagacggcuuauugggaaugagaacuaucuggauuacaugacauccaugaagagauuuaaaaaugaaucugacccugagggcgcccucugguga

SEQ ID NO: 19331 - RNA, 9879 nt, Artificial Sequence
  derived and/or modified CDS sequence (opt5) from DENV-1__EU482533__SS-prME
agcgugaccaugcugcugaugcugaugcccacagcccuugcuuuccaccugacgaccagaggcggggaaccucauaugaucguguccaagcaggaacggggaaaaucucuccuguuuaagacaagcgccggcguuaauaugugcacccuuauugccauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucaucgugcucggaucccaggagggcgcuaugcacacagcccugacgggggccaccgaaauucaaacaagcggaaccacaaccaucuucgcuggccaucugaagugcagacucaaaauggauaagcugacgcuuaaagggaugucuuauguuauguguacaggcuccuucaagcuggagaaggaaguggccgagacccagcacggaaccguccucgugcagauuaaauacgagggcacagacgcgccgugcaagaucccuuuuagcacccaggaugaaaaagggguuacacaaaacggacggcugaucacggcuaaucccauugugaccgacaaggagaaaccugucaacaucgaagccgagccgcccuucggcgagucuuauauugugaucggggccggagaaaaggcucugaaacuuagcugguuuaaaaagggcuccucuauugggaaaauguucgaggccacagcuagaggcgcccgccggauggcgauccucggagauaccgccugggacuuuggcagcaucgggggaguguucacauccguuggcaagcugguccaucagauuuuugggaccgcuuacggagugcuguucagcggcgugucuuggacgaugaaaaucgggauuggcguccuccugaccuggcuuggacucaauuccagaagcacaucucucuccaugaccuguaucgccgugggccugguuacacuguaccuuggggugaugguccaggcugauagcggaugcgugauuaacuggaagggccgcgaacucaaguguggguccggaaucuuuguuaccaaugaggugcacacauggaccgaacaguauaaauuccaagccgacucuccuaagcggcugagcgcggccauuggcaaggcuugggaggagggggucugcggcaucagauccgccacgcgccuggaaaacaucauguggaagcagauuucuaacgagcucaaucauauccugcuugaaaacgacaugaaauuuacagugguugugggagaugucgcuggcauucuggcccaggggaagaaaaugauccggccgcagcccauggaguacaaguauagcuggaaguccuggggaaaagccaagauuaucggcgcugacgugcaaaaugcgaccuucaucauugaugggccuaacacccccgaauguccugacgaucagagagccuggaauaucugggagguggaggacuacggauuuggcauuuucacaaccaacaucuggcucaaacugcgcgauagcuauacgcaggucugcgaccaccggcugaugucugcugccauuaaggauuccaaagccguucacgcugacaugggcuacuggaucgaaagcgagaagaaugaaacauggaaacuugccagagcgucuuucaucgaggugaaaaccuguauuuggcccaagucccauacacucuggagcaacggggugcuggaaucugagaugaucauuccgaaaaucuauggaggcccuauuagccagcacaauuaccgccccggguacuuuacccaaacagcuggaccuuggcaucugggcaagcucgagcuggauuucgaccuuugcgaagggaccacggucgugguugaugagcacugcggaaaccggggccccucccugagaaccacaaccgugacaggcaaaaucauccacgaaugguguugccggagcuguacccucccuccccugcgcuuuaagggggaggacggaugcugguauggcauggagauuagaccggucaaggaaaaagaggaaaaucuggugaagucuaugguuuccgccgggagcggagagguggacuccuucucucuuggccuccuguguaucagcauuaugaucgaagaggucaugcgguccagauggucucgcaaaaugcugaugacggggacacucgccguguuuuuccugcuuauuaugggacagcugaccuggaacgaucucauccggcugugcauuaugguuggcgcuaaugccagcgacagaaugggcauggggacaaccuaccuggcgcuuauggcuaccuuuaagaugcgcccuauguucgccgugggacugcucuuuagacggcugacaucccgcgagguccuccugcuuacgaucggccugucucucguggccagcguggaacugcccaacucccuggaggaacuuggggauggacuggcuaugggcaucaugauucucaaacugcucaccgacuuccagagccaucaacugugggccacacuucugucucucaccuuuaucaagacaaccuucucccugcacuaugcuuggaagacgauggccaugguccugagcauuguuucucuuuuuccccugugucucuccacaaccagccagaaaaccacauggcugccugugcuccuggggucucuuggaugcaagccgcugaccauguuccugaucgcggagaauaaaauuuggggcagaaaguccuggccccucaacgaaggcaucauggccguggggaucgucagcauucugcuuuccagccugcucaaaaacgaugugccucuggcuggaccccucaucgccggcgggaugcugauugcuuguuacguuaucucuggaagcuccgccgaccuuucucuggagaaggccgcugaggugagcugggaagaggaagcggagcauuccggcgccucucacaauauucuggucgaagugcaggaugacgggacaaugaaaaucaaggaugaggagcgggacgauacgcucaccauccugcuuaaggcuacacugcucgccguuagcggaguguauccucuguccauucccgccacccucuucgucugguacuuuuggcagaaaaagaaacaacgcucuggcgugcugugggacacaccuuccccucccgaagucgagagagcugugcuugaugacggcaucuaucggauuaugcagcgcgggcugcugggaagaucccagguuggcgugggggucuuccaggaaaacguguuucauaccauguggcacguuacgcggggagccgugcucauguaccaaggcaagcgccuggagcccagcugggcgucugucaaaaaggaccuuaucuccuacgggggaggcuggagacugcagggcagcuggaauaccggggaggaaguccaggugauugcuguugagcccggaaagaacccuaaaaauguccagacagcccccggcaccuucaagacaucugaaggggaggugggagccaucgcucucgauuuuaaaccgggcaccuccgggagcccuauugugaaccgggaaggaaagaucgucggccuguauggcaauggggugguuacaacguccggaaccuacgugucugccaucgcgcaagcuaaagccagccaggagggcccccucccugagauugaagacgaggucuucagaaagcgcaaccugacaaucauggaucuucaccccggguccggaaagacccggagauaucugcccgccauugugcgcgaagcuaucaaacggaagcugagaacccucauucuggccccuacacgcguuguggcuagcgagauggccgaagcgcuuaaaggcaugccgauccgguaccagacgaccgccgucaagucugagcauacagggaaagagaucguggaccugaugugccacgcuaccuuuacaaugagacuccugucccccguucgcgugccuaauuauaacaugauuaucauggaugaagcccauuucaccgaccccagcucuauugcugcccggggcuacaucagcacgagagucggaaugggcgaggccgcugcgauuuuuaugacagccaccccucccggguccguggaggcuuucccucaaucuaaugccgugauccaggaugaagaacgggacaucccggagcgcagcuggaacuccggauaugaguggauuaccgauuuucccggcaagacagucugguucguuccuucuaucaagagcgggaaugacauugccaacugucugcgcaagaauggaaagcgggugauccagcucucccgcaaaaccuucgauacagaauaccagaagaccaaaaacaacgacugggacuacguggucacgacagauauuagcgagaugggcgcuaauuuuagagccgaccgggugaucgaucccagacgcugccuuaagccuguuauucugaaggacgggcccgaacgggugauccuggcgggcccgaugccugucaccguggcuucugccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaauccgccgcuauugauggggaguaucggcucagaggagaggcccgcaagacguuuguugaacugaugagacggggcgaccugccuguguggcucagcuacaaagucgcuuccgagggguuccaguauucugaucgcagauggugcuuugacggcgaacggaacaaucaagugcuugaggaaaacauggaugucgagaucuggaccaaggagggagaacgcaaaaagcugagaccgcgguggcuggacgccagaacauacagcgacccccucgcucugcgcgaguucaaggaauuugccgcgggccggagauccgugucuggggaucuuauccuggagauuggaaaacucccucagcaccugacccagcgcgcccagaaugcucuggacaaccucguuaugcuucauaauagcgaacaaggcgggcgggccuauagacacgcuauggaggagcugcccgauacaaucgaaacccugaugcuccuggcccuuauugccgugcugacaggaggcgugacccucuucuuucuguccggccgggggcugggaaagacgagcaucggccuccuuugugucauggcuucuuccguucugcuguggauggcgagcguggagccucauuggauugccgcuucuaucauccucgaguucuuucugauggugcuucugauucccgagccggaccgccagagaacaccucaggauaaccagcucgccuacgucgugaucgggcugcuguucaugauucucaccguugccgcuaaugagaugggacuucuggaaaccaccaagaaggaccugggcaucgggcacguggccgucgagaaccaccaucacgcggccaugcucgauguggaccugcaucccgcuuccgccuggacccuuuacgcugucgccacaacgauuaucaccccuaugaugcggcacacaauugaaaacaccacagcgaauaucagccugaccgccaucgcuaaccaagccgcuauucucaugggacuggauaaaggcuggcccaucucuaagauggacauuggcgugccucugcucgcccuugggugcuauagccagguuaauccccugacgcugaccgcugccgugcucaugcuggucgcgcauuacgccaucauuggaccgggccuucaggcuaaggccacacgcgaggcucagaagagaaccgccgccgggaucaugaagaacccuacaguggauggaaucguugcgauugaccuggaucccguggucuaugacgcuaaauuugaaaagcagcucggccagaucaugcugcugauucucuguaccucccagauccuucugaugcggacgacaugggcccugugcgagucuauuacccucgcuacagggccccugaccacccuuugggagggaagcccuggcaaauucuggaauacaacgaucgccguguccauggccaacaucuuccgcggcagcuaccuggcuggggccggacucgcguuuucccugaugaagucucugggcgggggaagacggggcaccggggcccaaggagaaacacucggcgagaaguggaaacgccagcuuaaucagcugagcaaguccgaguucaacaccuauaaaagaucuggcauuauggagguggaccggagcgaagcuaaggaggggcugaaaagaggagagacaaccaagcacgccguuucccgcggcacggcuaagcuccggugguuugucgaaagaaaucuggugaaaccggaggggaaggugaucgaucuuggauguggccgcgggggauggucuuacuauugcgccggccugaaaaaggucacagaaguuaaaggcuacaccaaagggggacccggccacgaggaaccuauucccauggcgaccuacggguggaaccucgugaaacugcauagcggaaaggacguguucuuuaucccucccgagaagugugauacacugcucugcgacauuggcgaguccagcccuaauccgaccaucgaagaggggcggacacuuagaguccugaaaaugguggaacccuggcugcgcggaaaccaguucuguauuaagauccucaauccuuauaugcccucuguuguggagacgcuggagcaaaugcagcggaaacacggcggcaugcuugucagaaacccucugucccgcaauagcacccaugaaauguacugggugucuugcgggacaggaaacaucguuuccgccgugaauaugaccagccggaugcuccugaacagauuuacaauggcucaccgcaagcccaccuaugagcgggaugucgaccugggcgccgggacgagacacguggcuguggaaccggaggucgccaaccucgauauuaucggacagcgcauugaaaauaucaaacaugagcacaagucuaccuggcauuacgacgaggauaacccuuauaagacaugggcuuaccacggcuccuaugaaguuaaacccagcggguccgccagcucuauggugaauggaguggucaagcugcuuaccaaacccugggacgugauuccuaugguuacacagaucgcgaugaccgauacaacccccuucggccaacagagaguguuuaaggagaaagucgacacgcggacaccuaaggccaagcgcggcaccgcucagaucauggaagugaccgccaaauggcuguggggguuccucagcagaaacaagaaaccgcggauuuguacaagagaggaauuuacgcggaagguucgcuccaaugcugccaucggagccguguucgucgacgagaaccaauggaacucugcgaaagaggcuguggaagaugagagauuuugggaccugguucaucgggaacgcgagcuucacaagcagggcaagugcgcgaccugcguguacaacaugauggggaaaagagaaaagaaacugggagaguucggcaaggccaaagggagccgggcuauuugguacauguggcucggcgcccgcuuccuggaguuugaagcucugggauucaugaaugaggaucacugguuuuccagagaaaacucucucagcggcgucgagggggagggacugcauaaacuuggcuauauccugcgggacauuuccaaaauccccgggggaaauauguacgccgaugacacagcgggcugggauacccgcaucacagaagacgaucuccagaacgaggccaagauuaccgacaucauggaaccugagcacgcucugcuugccaagucuauuuucaaacugacauaucagaauaagguggucagagugcaacggcccgcuaaaaacgggaccguuauggaugugaucagccgcagagaccagcggggcuccggacaggucggcacguacgggcucaauaccuuuacaaacauggaagcccagcugauucgccaaauggagagcgagggaaucuucucuccuuccgaacuggagacccccaaccucgcgggcagagugcuggauuggcuugaaaagcaugggguggagcggcugaaaagaauggccaucagcggagacgacuguguugugaagccgauugaugaccgcuuugcuacagcccucaccgcucugaaugauaugggcaagguccggaaagacaucccucagugggaacccucuaagggguggaacgauuggcaacaggugccuuucugcucccaccacuuucaucaacuuauuaugaaagacggcagagagaucguugugcccugucgcaaucaggaugagcuggucggacgggccagagugagccagggcgcuggguggucccuccgcgaaacggccugccugggaaagucuuaugcgcagauguggcaacugauguacuuccaccggagagaccuccgccuggccgcuaacgccauuuguagcgccgucccuguggauuggguucccacaucccggaccacauggagcauccaugcucaccaucaguggaugaccacggaggacaugcuuucuguguggaauagagucuggauugaagagaacccguggauggaagauaaaacccacaucuccagcuggggcgacgugccuuaucuggggaagcgcgaggaccaguggugcggaucucucaucggccugacagcccgggcgaccugggcuacaaauauucaaguugccaucaaccaggugagacggcuuauugggaaugagaacuaccuggauuacaugaccagcaugaagagauuuaaaaaugaauccgaccccgagggcgcccucugguga

SEQ ID NO: 19332 - RNA, 9879 nt, Artificial Sequence
  derived and/or modified CDS sequence (opt5) from DENV-1__EU482534__SS-prME
agcgugacaaugcugcugaugcugaugcccacagcccuugcuuuccaccugacgacccggggaggggagccucauaugauugucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucguuagaacaaccuuuucccugcacuaugccuggaaaacgauggcuauggugcuuagcaucgugucucuguucccccucugucuguccacaaccagccagaagaccacauggcucccuguccugcuugggucucugggaugcaagccgcugaccauguuucucauugccgagaauaaaaucuggggccggaaguccuggccccugaacgaaggcauuauggcgguggggaucguuagcauccuucuguccagccuccugaaaaacgaugugccucucgccggaccccugauugcuggcgggaugcuuaucgccuguuacgucauuucuggaagcuccgcugaccugucucuggagaaggccgccgugguuagcugggaggaagaggcugaacauuccggcgcgucucacaauauccucguggagguccaggaugacgggacaaugaaaauuaaggaugaagaaagagacgauacgcugaccauccuucugaaagccacacuccuggcugugagcggagucuauccucucuccauccccgccacccuguucgugugguacuucuggcaaaagaagaaacagagaucuggcguucuuugggacacaccuuccccucccgagguggaacgggccguccuggaugacggcauuuaucgcaucaugcagagagggcugcucggacggucccaggugggcguugggguguuucaagagaacgucuuccauaccauguggcacgugacgcgcggagcugugcugauguaccagggcaagagacuugaacccagcugggccucuguuaaaaaggaccugauuuccuacgggggaggcuggcggcuccagggcagcuggaauaccggggaggagguccaggugaucgcgguggaacccggcaagaauccuaagaauguccaaacagcucccggcaccuuuaagacaucugagggggaagugggagccauugcccuggauuucaaaccgggcaccuccgggagcccuaucguuaacagagagggaaagauugugggccucuauggcaauggggucgugacaacguccggaaccuacguuucugcuaucgcccaggcgaaagcuagccaggaaggcccccugccugagaucgaggacgaaguguuucgcaagcggaaccuuacaauuauggaucugcaccccggguccggaaaaaccagacgcuaucugcccgccaucguccgggaggccauuaagagaaagcuccgcacccugauccuugcuccuacacgggugguugccagcgaaauggcugaggcccugaaaggcaugccgauuagauaccaaacgaccgcggugaagucugaacauacagggaaagagaucgucgaccucaugugccacgccaccuucacaaugcgccugcugucccccgugcgggugccuaauuauaacaugaucauuauggaugaggcucauuuuaccgaccccagcucuaucgccgcuagaggcuacauuagcacgcgggucggaaugggcgaagccgccgcuaucuucaugacagcgaccccucccggguccguugaggccuuuccucagucuaaugcugugauucaggaugaggaacgcgacaucccggaaagaagcuggaacuccggauaugaguggaucaccgauuuccccggcaagacagugugguuugucccuucuauuaaaagcgggaaugacaucgccaacugucuccggaagaauggaaagcgcgugauucagcuuuccagaaaaaccuucgauacagaguaccaaaagaccaaaaacaacgacugggacuacguugugacgacagauaucagcgaaaugggcgccaauuuccgggcugacagagucauugauccccgccggugccugaagccugugauccugaaagacgggcccgagagaguuauucucgccggcccgaugccugugaccgucgcgucugcugcccagcgccggggaagaaucggccgcaaccacaauaaggaaggggaucaguauaucuacaugggacagccccugaacaaugacgaggaucaugcccacuggacagaggcuaagaugcuucuggacaacauuaauacccccgaaggcaucauuccugcccucuuugagcccgaacgggagaaauccgcggccaucgauggggaauauagacugcgcggagaggcuagaaagacguucguggagcugaugcggcgcggcgaccucccugucuggcuuagcuacaaaguggccuccgaaggguuucaauauucugauagacgguggugcuucgacggcgagcgcaacaaucagguucuggaagagaacauggauguggaaauuuggaccaaggagggagagcgcaagaagcugcggccgagauggcucgacgcucgcacauacagcgacccccuggcccuucgggaauuuaaagaguucgcugccggcagacgcuccgugucuggggaucugauccucgaaaucggaaagcugccucagcaccugacccagcgggcgcaaaaugcccucgacaaccuugucaugcugcauaauagcgagcagggcgggagagcuuaucggcacgccauggaggaacugcccgauacaauugagacccucaugcugcuugcucugaucgccguucucacaggaggcgugacccuguuuuuccuguccggccgcgggcucggaaagacgagcauuggccuucugugugugauggccucuuccguccugcucuggauggcuagcguggaaccucauuggaucgcggccucuauuauccuggaguuuuuccuuaugguucugcucauccccgaaccggacagacagcggacaccucaggauaaccaacuggcuuacguggucauugggcugcucuuuaugauccuuaccguggccgccaaugagaugggacugcuggagaccaccaagaaggaccucggcauugggcacgucgcuguggaaaaccaccaucacgccgcgaugcuggauguugaccuucaucccgccuccgcuuggacccuguacgccguggcuacaacgaucauuaccccuaugaugcgccacacaaucgagaacaccacagccaauauuagccucaccgcgaucgccaaccaggcugccauccugaugggacuggauaaaggcuggcccauuucuaagauggacaucggcgucccucuccuugcucuggggugcuauagccaggugaauccccugacgcucaccgccgcuguucugaugcuuguggcccauuacgcgauuaucggaccgggccugcaagccaaagcuacaagagaagcccagaagcggaccgcugccgggauuaugaagaacccuacagucgauggaaucguggccaucgaccucgaucccgugguuuaugacgcgaaauucgagaagcagcugggccagauuaugcugcucauccuuuguaccucccaaauucugcugaugcgcacgacaugggcucucugcgaaucuaucacccuggccacagggccccuuaccacccugugggagggaagcccuggcaaauuuuggaauacaacgauugcugucuccauggccaacaucuucagaggcagcuaccucgccggggcuggacuggccuucucccugaugaagucucucggcgggggacggcgcggcaccggggcgcagggagagacacuuggcgaaaaauggaagagacagcugaaucagcugagcaaguccgaguuuaacaccuauaaacggucuggcaucauggaaguggacagaagcgaggccaaggaagggcucaaacgcggagagacaaccaagcacgcugugucccggggcacggccaaacugagaugguucgucgagcgcaaucuuguuaagccggaagggaaggugauugaucugggauguggcagagggggauggucuuacuauugcgcuggccucaaaaaggugacagaggucaaaggcuacaccaaagggggacccggccacgaggagccuauccccauggccaccuacggguggaaccuggugaaacugcauagcggaaaggacgucuuuuucauuccucccgaaaaaugugauacacuccuuugcgacaucggcgaguccagcccuaauccgaccauugaggaagggagaacacugcgcgugcugaagauggucgagcccuggcuccggggaaaccaauuuuguaucaagauucugaauccuuauaugcccucugugguugaaacgcuugagcagaugcagagaaaacacggcggcaugcuggugcgcaacccucucucccggaauagcacccaugagauguacugggucucuugcgggacaggaaacaucguguccgcggugaauaugaccagcagaaugcugcugaaccgcuucacaauggcccaccggaagcccaccuaugaaagagaugucgaccucggcgcugggacgcgccacguugccguggagccggaaguggcuaaccuggauaucauuggacagagaaucgagaauauuaaacaugaacacaagucuaccuggcauuacgacgaggauaacccuuauaaaacaugggccuaccacggcuccuaugaggucaagcccagcggguccgcuagcucuauggugaauggaguugugaaacuucugaccaaacccugggacgucaucccuauggugacacaaauugccaugaccgauacaacccccuuuggccagcagcggguuuucaaggaaaaaguggacacgcgcacaccuaaggcgaaaagaggcaccgcccaaaucauggaggucaccgcuaaguggcucuggggguuucugagccggaacaagaaaccgagaaucuguacacgggaagaguucacgcgcaaggugagauccaaugccgcuauuggagccguuuuuguggacgaaaaccaguggaacucugccaaagaggcggucgaggaugaacgguucugggaccuugugcaucgcgagagagaacugcacaagcagggcaaaugcgcuaccugcgucuacaacaugauggggaagcgggagaagaaacucggagaauuuggcaaggccaaagggagccgcgccaucugguacauguggcugggcgcuagauuccuggaguucgaggcccucggauuuaugaaugaagaucacugguucucccgggagaacucucugagcggcguggaaggggagggacuucauaagcugggcuauauucuccgcgacaucuccaaaauucccgggggaaauauguacgcugaugacacagccggcugggauaccagaaucacagaggacgaucugcagaacgaagcgaagaucaccgacauuauggagccugaacacgcccuucuggcuaaaucuaucuuuaagcucacauaucaaaauaagguugugcggguccagcgccccgccaaaaacgggaccgugauggaugugauuagcagacgggaccagcgcggcuccggacagguuggcacguacgggcugaauaccuucacaaacauggaggcucaacugaucagacagauggaaagcgagggaaucuuuucuccuuccgagcucgaaacccccaaccuggccggccgggugcuugauuggcuggagaagcauggggucgaaagacucaaacgcauggcgaucagcggagacgacugugugguuaagccgaucgaugaccgguucgccacagcucugaccgcccuuaaugauaugggcaaagugagaaaggacauuccucagugggagcccucuaagggguggaacgauuggcagcaagucccuuuuugcucccaccacuuccaucagcugaucaugaaagacggccgcgaaauugugguccccugucggaaucaggaugagcucgugggcagagcucgcguuagccagggagccggguggucccugcgggagacggcuugccugggaaagucuuaugcccaaauguggcagcucauguacuuucacagacgcgaccugcggcuugcggccaacgcuaucuguagcgccgugccugucgauugggugcccacauccagaaccacauggagcauucaugcccaccaucaguggaugaccacggaagacaugcugucuguuuggaaucgcguguggaucgaggaaaacccguggauggaggauaaaacccacauuuccagcuggggcgacgucccuuaucucgggaagcgggaagaccaauggugcggaucucugaucggccuuacagcuagagccaccugggcgacaaauauccagguggcuauuaaccaggugcggagacugcucgggaaugagaacuaccuggauuacaugaccagcaugaaacgcuucaagaaugaguccgaccccgaaggcgcccugugguga

SEQ ID NO: 19333 - RNA, 9879 nt, Artificial Sequence
  derived and/or modified CDS sequence (opt5) from DENV-1__EU482535__SS-prME
agcgugaccaugcugcucaugcugaugcccaccgcccuugcuuuccaccugacgaccagaggcggggagccucauaugaucgucaccaagcaggaacgggggaaaucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagaugcgcgauuccuacacacaggucugcgaccaccggcugaugagcgcggccaucaaagauucuaaggcuguucaugccgacaugggcuauuggaucgaauccgagaaaaaugaaaccuggaaacuugccagagcuagcuucauugaggugaagacauguaucuggcccaaaucucacacccucugguccaacggggugcuggaaagcgagaugauuaucccgaagauuuacggaggcccuaucucucaacauaauuaucgccccggguacuucacacagaccgccggaccuuggcaccugggcaaacucgagcuggauuuugaccuuugcgaagggacgaccgucgugguugaugagcacugcggaaaccggggccccagccugagaacaaccacagugaccggcaagaucauucaugaaugguguugccgguccuguacgcucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugacagggacccucgcuguguuccugcuucugaucaugggacagcucacauggaacgaucugauucggcugugcaucaugguuggcgccaaugccucugacagaaugggcauggggaccaccuaucuugcucugauggccacauuuaaaaugcgcccuauguucgcggugggacuccuguuuagacggcucacgagccgcgagguccugcuucugaccaucggccucucccugguggcuucuguggaacugcccaacagccuugaggaacugggggauggacucgccaugggcauuaugauccugaagcuccugacagacuuccaaucccaccagcuuugggccacccugcucagccugacauuuauuaaaaccacgcugucucuucauuacgcuuggaagacaauggccaugguccuguccaucguuagccucauuccccugugucucucuaccaccucccagaagacaaccuggcugccugugcuucuggggagccugggaugcaaaccgcucacaauguuccugaucgcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacgauguggcacgugacccggggagccguccuuauguaucagggcaaacgccuggagccuuccugggcuagcgugaagaaagaccucauuucuuacgggggaggcuggagacugcagggcuccuggaauacaggggaggaagugcagguuaucgccgucgagccccggaagaacccuaagaaugugcaaaccgcgcccggaacauucaaaaccccggaaggcgaggugggggcuauugcccucgauuuuaagccuggaacaagcggcucucccaucgucaacagagaagggaaaaucgugggacuguacggcaauggcguugugacgaccuccgggacauaugucagcgccauugcucaggccaaggcgucccaggagggaccucuucccgagaucgaagacgagguguuccgcaaacggaaccugaccauuauggaucugcaucccggcucugggaagaccagacgcuaccucccugcuaucguucgggaagccauuaagagaaaacugcgcacacuuauccuggccccgacgcggguggucgcuagcgagauggccgaagcucucaagggaaugcccaucagauaucaaaccacagccgugaaauccgagcacaccggcaaggagauuguugaccugaugugccaugcgacauuuaccaugcgccugcucagcccugugcggguccccaauuacaacaugaucauuauggaugaagcccacuucacggacccuucuuccaucgcugccagaggguauauuagcacacgggugggcaugggagaggcugccgccaucuuuaugaccgcuacacccccuggcucuguggaagcguucccgcagagcaaugccgucauccaggaugaggaacgcgacauucccgagagauccuggaacucuggguacgaguggaucacagauuuuccuggaaaaaccguuugguucgugcccagcauuaaguccggcaaugacaucgcuaacugucuucggaagaaugggaaacgcgugauucagcugucuagaaagacauuugauaccgaauaucagaagacgaagaacaacgacugggacuacgucgugacaaccgauaucagcgagaugggagccaauuuccgggccgacagaguuauugauccucgccggugccugaaacccgugauccucaaggacggcccggaaagagucauccuggcugggccuaugcccgugacaguugccuccgcggcucagcgccggggcagaauuggacgcaaccauaauaaggagggcgaucaguacaucuauauggggcagccccuuaacaaugacgaggaucacgcccacuggaccgaagccaaaaugcugcucgacaacauuaauacgccugagggaaucauucccgcucuguuugaaccugagcgggaaaagagcgccgcgaucgauggcgaguacagacugcgcggggaggccagaaaaaccuucguggaacucaugcggcgcggagaccuuccggucuggcugucuuauaagguggcuuccgagggcuuccaauacagcgauagacgguggugcuuugacggggaacgcaacaaucagguccuggaggaaaacaucgauguggagauuuggacaaaagagggcgaaagaaagaaacuccggcccagauggcuggacgcccgcaccuauuccgacccucuugcucugcgggaguucaaggaauuugccgcuggaagacgcucuguuagcggcgaucucauccuggagauugggaagcugccccagcaucucacacagcgggcccaaaaugcgcuugacaaccuggugaugcugcacaauuccgaacagggaggcagagccuaccggcaugcuauggaggagcucccugauaccaucgaaacacugaugcuucuggcccucauugcugugcugaccgggggagucacgcuguucuuucucucuggccgcggccuugggaaaacaagcaucggacugcuguguguuauggccuccagcgugcuccuguggauggccucuguggagccccacuggaucgcugcguccauuauccuugaguucuuucugaugguccuccugauuccggagccugacagacagcggacaccccaggauaaccaacuggccuaugugguuaucggccuccuuuucaugauucugaccguggcugccaaugagauggggcugcucgaaacaaccaagaaagaccugggaaucggccacgccgcugucgagaaccaucaccaugccacaaugcuugauguggaccugcacccugcgagcgccuggacgcucuacgcugucgccaccacaauuaucacccccaugaugcgccauacaaucgaaaacaccacggcuaauauuucucugaccgccaucgcgaaccaggccgcuauucugauggggcucgauaagggauggccuaucuccaaaauggacauuggcgugccccuucuggcccugggcugcuacagccagguuaauccgcucacacugaccgcugccgugcuuaugcuggucgcucacuaugccaucaucgggccuggacuccaagcgaaggccacaagagaggcucagaagcggaccgccgcuggcauuaugaaaaaccccacgguggaugggaucguugccauugaccuggaucccguggucuacgacgccaaguuugaaaaacagcugggacagaucaugcuccuuauucuguguacaucucaaauccugcucaugcgcaccacaugggcgcugugcgagagcaucacccuugcuaccggcccucugacaacgcucugggagggguccccgggaaaguucuggaauaccacaauugccgugucuauggcuaacaucuuuagaggcagcuaucuggccggcgccgggcuggcuuucucccucaugaaaagccuuggaggcgggcggcgcggaaccggcgcccagggggaaacacugggagagaaguggaagagacagcugaaucagcucuccaaaucugaauuuaacauuuacaagcggagcggcaucauggagguggacagauccgaagcgaaagagggccugaagcgcggggagaccacgcggcacgccguuucuagaggaacagcuaaacuucgcugguucgucgaacggaaucuggugaagcccgagggcaaggugauugaucucggguguggaagaggcggguggagcuauuacugcgccggacugaaaaaggucaccgaaguuaaaggcuauaccaagggcgggccuggacaugaggaacccaucccuauggcuacauacggcuggaaccuggugaaacuccacuccgggaaggacguguucuuuacacccccugagaaaugugauacacuucugugcgacauuggagagucuagcccgaaucccacgaucgaagagggccgcacccugcggguccucaagaugguggaaccuuggcugagagggaaccaauucuguaucaagauucuuaaucccuacaugccuuccguuguggagacacuggagcagaugcagcgcaaacauggaggcaugcucguccggaacccccugagcagaaauucuacccacgaaauguauuggguguccugcggcacagggaacaucguuagcgccgugaauaugaccucucgcaugcugcucaaccgguuuacgauggcgcacagaaagccgaccuacgagaaagaugucgaccugggagccggcacacgccauguggcuguggaaccugaggucgccaaccuugauauuaucgggcagagaauugaaaauaucaagcacgagcauaaauccaccuggcacuaugacgaggauaaccccuacaagacaugggcuuaucauggaagcuacgaaguuaagcccucuggcuccgccagcuccauggugaaugggguggucaaacugcucaccaagccuugggacgugauccccaugguuacacaaauugcuaugaccgauacgacaccuuucggacagcagcggguguuuaaagagaaggucgacacccgcaccccgaaagccaagagaggcacagugcaaaucauggaaguuacggcgcgguggcuguggggcuuccuuagcagaaacaagaaaccccggauuuguacccgcgaggaauuuacaagaaaggugcggucuaaugccgcuaucggggccgucuucguggacgagaaccaguggaauagcgcuaaagaggccguugaagaugagcgcuuuugggaccuggugaagaaagaaagagagcuccacaagcagggaaagugcgcgaccugcgucuauaacaugaugggcaaacgggaaaagaaacugggggaguucggaaaggcgaaaggcucccgcgcuauuugguacauguggcugggggccagauuucucgaguucgaagcccugggcuuuaugaaugaggaucacugguucucucgggaaaacagccuuuccggaguggagggcgaggggcugcauaagcucggauacauccugcgcgacaucucuaaaauuccuggcgggaauauguaugcugaugacacagccggaugggauaccagaaucacagaagacgaucuucagaacgaggcuaagauuaccgacaucauggaacccgagcacgcccugcucgcgacgagcauuuucaagcugaccuaccaaaauaaagucgugcggguucagcgcccugccaagaacggcacagugauggaugucaucuccagacgggaccagcgcgggucuggccaggugggaaccuauggccugaauacauuuaccaacauggaagcucaacucaucagacagauggagagcgaggggauuuuccugcccuccgaacuugagacgccgaaccuggccgaacgggugcucgauuggcuggagaaauacggaguugaaagacuuaagcgcauggcuaucagcggcgacgacuguguggucaaaccuauugaugaccgguuugccacagcgcugaccgcccucaaugauauggggaaggugagaaaggacaucccccagugggagccuucuaaaggauggaacgauuggcagcaaguucccuucugcucccaucacuuucaccagcugauuaugaaggacggccgcgagaucguggucccuugucggaaucaggaugaacugguggggagagcucgcgucagccagggcgccggauggucucuccgggagacagcuugccugggcaaauccuaugcccaaauguggcagcuuauguacuuccauagacgcgaccugcggcucgcugccaacgcgauuuguagcgccgugcccguuaauugggugccgaccuccagaacgaccuggucuauccacgcucaucaccaguggaugacaaccgaagauaugcugagcgucuggaaccgcguguggaucgaggaaaauccuuggauggaggacaagacacauguuuccagcuggggagaugugcccuaucuuggaaaacgggaggaccaauggugcggcucucugauugggcucaccgccagagccacaugggcuuccaacauccaggucgccauuaaucaggugcggagacugaucggaaacgaaaauuaccuggacuacaugaccagcaugaagcgcuuuaagaacgagggcgaucccgaaggggcgcucugguga

SEQ ID NO: 19334 - RNA, 9879 nt, Artificial Sequence
  derived and/or modified CDS sequence (opt5) from DENV-1__EU482536__SS-prME
agcgugaccaugcugcugaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucaucagaacaaccuuuucccugcacuaugccuggaaaacgauggcuaugguucuuagcauugugucucuguucccccucugucuguccacaaccagccagaagaccacauggcucccugugcugcuugggucucugggaugcaagccgcugaccauguuucucaucgccgagaauaaaauuuggggccggaaguccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgaggucagcugggaagaggaagcugagcauuccggcgcgucucacaauauucucguggaaguucaggaugacgggacaaugaaaaucaaggaugaggagcgcgacgauaugcugacgauccuucugaaagccacccuccuggcugugagcggagucuauccucucuccauucccgccacacuguucgugugguacuucuggcaaaagaagaaacagagaucuggcguccuuugggacaccccuuccccucccgaaguggagcgggccguucuggaugacggcaucuaucgcauuaugcagagagggcugcucggacggucccaggugggcgucgggguguuucaagaaaacguuuuccauacaauguggcacgugacccgcggagcuguccugauguaccagggcaagagacuugagcccagcugggccucugugaaaaaggaccugaucuccuacgggggaggcuggcggcuccagggcagcuggaauacgggggaggaagugcagguuauugcggucgagcccggcaagaauccuaagaaugugcaaaccgcucccggcacauuuaagaccucugaaggggaggugggagccaucgcccuggauuucaaaccgggcacauccgggagcccuauugucaacagagaaggaaagaucgugggccucuauggcaaugggguugugaccacauccggaacguacgucucugcuaucgcccaggcgaaagcuagccaggagggcccccugccugagauugaagacgagguguuucgcaagcggaaccuuaccaucauggaucugcaccccggguccggaaaaacaagacgcuaucugcccgccauuguucgggaagccaucaagagacgccuccggacccugauucuugcuccuaccagaguggucgccagcgagauggcugaagcccugaagggcaugccgauccgcuaccaaacaacggcggugaaaucugagcauaccgggaaggagaucguugaccucaugugccacgccacauucaccaugcggcugcugucccccgugagagucccuaauuauaacaugauuaucauggaugaagcucauuuuacagaccccagcucuauugccgcucggggcuacaucagcacccgcgugggaaugggcgaggccgccgcuauuuucaugacggcgacaccucccggguccguggaagccuuuccucagucuaaugcugucauccaggaugaggaaagagacaucccggagcggagcuggaacuccggauaugaguggauuaccgauuuccccggcaaaaccguuugguuugugccuucuaucaagagcgggaaugacauugccaacugucuccgcaaaaauggaaagagagugauccagcuuucccggaagacauucgauaccgaauaccagaagacaaagaacaacgacugggacuacgucgugaccacggauauuagcgagaugggcgccaauuucagagcugaccgcguuaucgauccccggagaugccugaaaccugugauucugaaggacgggcccgaacgcgucauccucgccggcccgaugccugugacaguugcgucugcugcccagcggagaggacgcaucggccggaaccacaauaaagagggggaucaguauauuuacaugggacagccccugaacaaugacgaggaucaugcccacuggaccgaagcuaagaugcuucuggacaacaucaauacacccgagggcauuaucccugcccucuuugaacccgagagagaaaaguccgcggccauugauggggaguaucgccugagaggagaggcucggaaaaccuucguggaacugaugcgcagaggcgaccucccugucuggcuuagcuacaagguggccuccgagggguuucaauauucugaucggcgcuggugcuucgacggcgaaagaaacaaucagguccuggaggaaaacauggauguggagaucuggacgaaagagggagaacggaagaaacugagaccgcgcuggcucgacgcucggaccuacagcgacccccuggcccuuagagaguuuaaggaguucgcugccggccgccgguccguuucuggggaucugauccucgagauuggaaaacugccucagcaccugacacagagagcgcaaaaugcccucgacaaccuugugaugcugcauaauagcgaacagggcgggcgggcuuaucgccacgccauggaggagcugcccgauaccaucgaaacacucaugcugcuugcucugauugccgugcucaccggaggcgucacacuguuuuuccuguccggcagagggcucggaaagaccagcaucggccuucuguguguuauggccucuuccgugcugcucuggauggcuagcguggagccucauuggauugcggccucuaucauccuggaauuuuuccuuaugguccugcucauucccgagccggaccggcagcgcacgccucaggauaaccaacuggcuuacgugguuaucgggcugcucuuuaugauucuuacaguggccgccaaugagaugggacugcuggaaaccaccaagaaagaccucggcaucgggcacgucgcuguggagaaccaccaucacgccgcgaugcuggaugucgaccuucaucccgccuccgcuuggacacuguacgccguggcuaccacaauuaucacgccuaugaugagacacaccauugaaaacacaaccgccaauaucagccucacagcgaucgccaaccaggcugccauucugaugggacuggauaagggcuggcccaucucuaaaauggacauuggcguuccucuccuugcucuggggugcuauagccaggugaauccccugacccucacggccgcuguccugaugcuuguggcccauuacgcgaucauuggaccgggccugcaagccaaggcuacccgggaggcccagaaacgcacagcugccgggaucaugaagaacccuaccguugauggaaucguggccauugaccucgaucccgucguguaugacgcgaaguucgaaaaacagcugggccagaucaugcugcucauucuuuguacaucccaaauccugcugaugagaaccacgugggcucucugcgagucuauuacacuggccaccgggccccuuacaacccugugggagggaagcccuggcaaguuuuggaauaccacaaucgcuguguccauggccaacaucuuccggggcagcuaccucgccggggcuggacuggccuucucccugaugaaaucucucggcgggggacgcagaggcacgggggcgcagggagaaacccuuggcgagaaguggaaacggcagcugaaucagcugagcaaguccgaauuuaacacauauaagagaucuggcauuauggagguugaccgcagcgaagccaaagaggggcucaagcggggagagaccacaaaacacgcugucuccagaggcaccgccaagcugcgcugguucguggaacggaaucuugugaaaccggaggggaaggucaucgaucugggauguggcagagggggauggucuuacuauugcgcuggccucaagaaaguuacggaagugaagggcuacacaaaagggggacccggccacgaggaaccuauucccauggccaccuacggguggaaccuggugaagcugcauagcggaaaagacgucuuuuucaucccucccgagaagugugauacccuccuuugcgacauuggcgaguccagcccuaauccgacaaucgaagaggggcgcacccugcgggugcugaaaaugguugaacccuggcucagaggaaaccaauuuuguauuaagauccugaauccuuauaugcccucuguggucgagacacuugagcagaugcagcgcaagcacggcggcaugcuggugcggaacccucucuccagaaauagcacgcaugaaauguacuggguuucuugcgggaccggaaacaucguguccgcggucaauaugacaagccgcaugcugcugaaccgguucaccauggcccacagaaaacccacauaugagcgcgauguggaccucggcgcugggaccagacacguggccgucgaaccggagguugcuaaccuggauauuaucggacagcggauugaaaauaucaagcaugagcacaaaucuacguggcauuacgacgaggauaacccuuauaagaccugggccuaccacggcuccuaugaagugaaacccagcggguccgcuagcucuauggugaauggagucgugaaacuucugacaaagcccugggacguuauuccuauggugacccaaaucgccaugacagauaccacacccuuuggccagcagcgcgucuucaaagagaagguggacaccagaacgccuaaagcgaagcggggcacagcccaaaucauggaaguuaccgcuaaauggcucuggggguuucugagcagaaacaagaagccgcggauuuguacccgcgaggaguucacaagaaaagugcgguccaaugccgcuaucggagccgucuuuguggacgagaaccaguggaacucugccaaggaggcgguugaagaugagcgcuucugggaccuugugcauagagaacgggagcugcacaaacagggcaagugcgcuacgugcgucuacaacaugauggggaaacgcgaaaagaagcucggagaguuuggcaaagccaaggggagcagagccauuugguacauguggcugggcgcucgguuccuggaguucgaagcccucggauuuaugaaugaggaucacugguucucccgcgaaaacucucugagcggcguggagggggagggacuucauaaacugggcuauauccucagagacauuuccaagauccccgggggaaauauguacgcugaugacaccgccggcugggauacacggaucaccgaagacgaucugcagaacgaggcgaaaauuacagacaucauggaaccugagcacgcccuucuggcuaagucuauuuuuaaacucaccuaucaaaauaaggucgugcgcguucagagacccgccaagaacgggacagugauggaugucaucagccggcgcgaccagagaggcuccggacaggugggcaccuacgggcugaauacguucaccaacauggaagcucaacugauucggcagauggagagcgagggaaucuuuucuccuuccgaacucgagacacccaaccuggccggcagagugcuugauuggcuggaaaaacaugggguugagcgccucaagcggauggcgaucagcggagacgacuguguggucaaaccgauugaugacagauucgccaccgcucugacagcccuuaaugauaugggcaaggugcgcaaagacaucccucagugggaacccucuaagggguggaacgauuggcagcaaguuccuuuuugcucccaccacuuccaucagcugauuaugaaggacggccgggagaucgugguccccuguagaaaucaggaugagcucgugggacgcgcucgggucagccagggcgccggguggucccugagagaaaccgcuugccugggaaaaucuuaugcccaaauguggcagcucauguacuuucaccgccgggaccugagacuugcggccaacgcuauuuguagcgccgugccuguugauugggugcccacgucccgcacaaccuggagcauccaugcccaccaucaguggaugacaaccgaggacaugcugucugucuggaaucggguguggauugaagagaacccguggauggaagauaagacgcacguuuccagcuggggcgacgugccuuaucucgggaaaagagaggaccaauggugcggaucucugaucggccuuaccgcucgggccacaugggcgaccaauauccaggucgcuauuaaccaggugagacgccugcucgggaaugagaacuaccuggauuacaugacaagcaugaagcgguucaaaaaugaauccgaccccgagggcgcccugugguga

SEQ ID NO: 19335 - RNA, 9879 nt, Artificial Sequence
  derived and/or modified CDS sequence (opt5) from DENV-1__EU482537__SS-prME
agcgugaccaugcugcucaugcugaugcccaccgcccuugcuuuccaccugacgacccggggcggggaaccucauaugaucgucacaaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacguccagaauacaaccuuuauuaucgaugggccuaacacccccgaauguccugacgaucagagagccuggaauauuugggagguugaggacuauggauucggcaucuuuacaaccaacauuuggcugaagcugcgcgauuccuacacgcaggcuugcgaccaccggcuuaugagcgcggccaucaaagauucuaaggcugugcaugccgacaugggcuauuggaucgaauccgagaaaaaugaaacauggaagcucgccagagcuagcuucauugaggugaagaccuguaucuggcccaaaucucacacacugugguccaacgggguccuggaaagcgagauggugauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuaugugauuagcggaucuagcgccgaccucucccuggagaaagcugccgagguuucuugggaagaggaagccgagcacagcggcgcuucccauaauauccuuguggaaguccaggaugacgggacaaugaagauuaaagaugaggagcgggacgauacgcugaccauccuccugaaggcgacacuccuggccgugucuggagucuacccucuuagcauccccgcuacccuguucgugugguauuuuuggcaaaagaaaaagcagcgcuccggcguucugugggacacaccuucucccccggaaguggagagagccguccucgaugacggcauuuaccggaucaugcagcgcgggcugcuuggaagaagccaggugggcguugggguguuccaagaaaacgucuuccacaccauguggcacgugacgcggggagccgugcugauguaucagggcaaacgccucgagccuuccugggcuagcguuaagaaagaccugauuucuuacgggggaggcuggagacuccagggcuccuggaauaccggggaggaaguccaggugaucgccguggagcccggaaagaacccuaagaauguccaaacagcgcccggcaccuuuaaaacaccggaaggggaggugggagcuauugcccuggauuucaagccuggcaccagcgggucucccaucguuaaccgggaaggaaaaauugugggccuuuacggcaauggggucgugacaacguccggaaccuauguuagcgccaucgcucaggccaaggcgucccaggagggcccucugcccgagaucgaagacgagguguuuagaaaacgcaaccugacaauuauggaucuccaucccgggucuggaaagacccggagauaccugccugcuaucguccgcgaagccauuaagcggaaacuuagaacccugauccucgccccgacacgcgugguugcuagcgagauggccgaagcucugaagggcaugcccauucgguaucaaacgaccgccgugaaauccgagcacacagggaaggagaucgucgaccugaugugccaugcgaccuucacaaugagacuccuuagcccugugcgcgugcccaauuacaacaugaucauuauggaugaagcccacuuuaccgacccuucuuccaucgcugcccggggcuauauuagcacgagagucggaaugggcgaggcugccgccaucuucaugacagcuacacccccugggucuguugaagcguuuccgcagagcaaugccgugauucaggaugaggaacgggacauccccgagcgcuccuggaacucuggauacgaguggaucaccgauuucccuggcaaaacagugugguuuguccccagcauuaaguccgggaaugacaucgcuaacugucugagaaagaauggaaaacgggugauucagcugucucgcaagaccuucgauacagaauaucagaagaccaagaacaacgacugggacuacguugugacgacagauaucagcgagaugggcgccaauuuuagagccgaccgggucauugauccuagacgcugccucaaacccgugauccugaaggacgggccggaacggguuauucuugcuggcccuaugcccgugaccgucgccuccgcggcucagagacgcggacggaucggcagaaaccauaauaaggagggggaucaguacaucuauaugggacagccccugaacaaugacgaggaucacgcccacuggacagaagccaaaaugcuccuggacaacauuaauaccccugagggcaucauucccgcucuguucgaaccugagcgcgaaaagagcgccgcgaucgauggggaguaccggcucagaggagaggcccgcaaaacguucguggaacuuaugagacggggcgaccugccggucuggcugucuuauaagguggcuuccgagggguuucaauacagcgaucgcagauggugcuucgacggcgaacggaacaaucagguucucgaggaaaacauggauguggagauuuggaccaaagagggagaacgcaagaaacugagaccccgguggcuugacgccagaacauauuccgacccucuggcucuccgcgaguuuaaggaguucgccgcuggccggagaucugugagcggggaucugauccuggagaucggaaagcucccccagcaucuuacccagcgcgcccaaaaugcgcuggacaaccuggucaugcuccacaauuccgaacagggcgggcgggccuacagacaugcuauggaggagcugccugauacaauugaaacccuuaugcugcucgcccugaucgcuguucugacaggaggcgugacccucuuuuuccuuucuggccgggggcugggaaaaacgagcauuggccugcucugugugauggccuccagcguccugcuuuggauggccucuguggagccccacuggaucgcugcguccauuauccuggaauuuuuccucaugguucugcugaucccggagccugaccgccagagaacaccccaggauaaccaacucgccuauguggucauugggcuucuguuuaugauccugaccguggcugccaaugagaugggacuccuggaaaccacaaagaaagaccuuggcauugggcacgucgccguggagaaccaucaccaugcuaccaugcuggauguugaccuccacccugccagcgcguggacacuguacgccguggcuacgaccaucauuacacccaugaugcggcauaccaucgaaaacacaaccgccaauauuucucugacggcuaucgccaaccaggcggccauccucaugggacuugauaagggcuggccuauuuccaaaauggacaucggcgucccccugcuggcucucgggugcuacagccaggugaauccgcugacccuuacagccgcuguucugaugcucguggcccacuaugcuauuaucggaccuggccugcaagccaaggcgacccgcgaggcccagaagagaacagcugccgggauuaugaaaaaccccaccgucgauggaaucguggcuaucgaccuggaucccgugguuuacgacgccaaguucgaaaaacagcucggccagauuaugcuucugauccuguguacgucucaaauucuccugaugcggacaaccugggcccuuugcgagagcaucacacuggcgaccgggccucucaccacacugugggagggauccccgggcaaguuuuggaauacgaccauugcugucucuauggccaacaucuuccgcggcagcuaucuggcuggggccggacucgccuuuucccuuaugaaaagccugggcgggggaagacggggcacaggggcucagggagaaacccugggcgagaaguggaagcgccagcucaaucagcuguccaaaucugaguucaacaucuacaagagaagcggcauuauggagguggaccgguccgaagccaaagaggggcuuaagagaggagagacaacccgccacgcggugucucggggcacggccaaacugagaugguucgucgaacgcaaucucguuaagcccgaggggaaggugaucgaucugggauguggcagagggggauggagcuauuacugcgcuggccugaaaaaggugacagaagucaaaggcuauaccaaagggggaccuggccaugaggaacccauuccuauggccaccuacggguggaaccucgugaaacuucacuccggaaaggacgucuuuuucacacccccugagaaaugugauacccugcugugcgacaucggcgagucuagcccgaaucccacaauugaagaggggagaacgcuccgcgugcugaagauggucgaaccuuggcuucggggaaaccaauuuuguaucaagauucugaaucccuacaugccuuccgugguugagacccucgagcagaugcagagaaaacauggcggcaugcuggugcgcaacccccugagcagaaauucuacacacgaaauguauugggucuccugcgggaccggaaacaucgugagcgcugugaauaugacaucuagaaugcuccugaaccgcuucaccauggcccaccggaagccgacguacgagagagaugucgaccuuggcgcggggacccgccauguugccguggaaccugagguggcuaaccuggauaucauuggacagagaaucgaaaauauuaaacacgagcauaaguccacauggcacuaugacgaggauaaccccuacaaaaccugggccuaucauggcagcuacgaagucaagcccucuggguccgcuagcuccauggugaauggaguugugaagcuccugacaaaaccuugggacgucauccccauggugacccaaauugccaugacagauaccacgccuuuuggccagcagcggguuuucaaggagaaaguggacacacgcaccccgaaggcuaaaagaggcaccgcccaaaucauggaagucacagcgcgguggcuuuggggguuucugagcagaaacaagaagccccggaucuguacgcgcgaggaguucaccagaaaagugcggucuaaugccgcuauuggagccguuuuuguggacgagaaccaguggaauagcgcuaaggaggccgucgaagaugagcgcuucugggaccucgugcagaaagaaagagagcugcacaagcagggcaaaugcgccacaugcgucuauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugcugaugacaccgccggcugggauacaagaaucaccgaagacgaucugcaaaacgaggcuaagaucacagacauuauggaacccgagcacgcccuccuggcgaccagcaucuuuaaacugacguaccagaauaagguugugcggguccagcgcccugccaagaacgggaccgugauggaugugauuuccagacgggaccagcgcggcucuggacaaguuggcacauaugggcucaauaccuucacaaacauggaagcucagcugaucagacagauggagagcgagggaauuuuucuucccuccgaacuggagaccccgaaccucgccgaacgggugcuggauuggcuugagaaacauggcgucgaaagacugaagcgcauggcuaucagcggggacgacugugugguuaaaccuaucgaugaccgguucgccacggcgcucacagcccugaaugauaugggaaaggugagaaaagacauuccccagugggagccuucuaagggcuggaacgauuggcaacagguccccuuuugcucccaccacuuccaucagcugaucaugaaggacgggcgcgagauuguggucccuugucggaaucaggaugaacucgugggcagagcucgcguuagccaaggagccggcuggucucugcgggagaccgcuugccuugggaaauccuacgcccagauguggcagcugauguauuuucacagacgcgaccuccggcuggcugccaacgcgaucuguagcgccgugcccgucgauugggugccgacauccagaaccacguggucuauucaugcucaccaucaauggaugaccacagaagacaugcuuagcguuuggaaucgcguguggaucgaggaaaacccuuggauggaggauaagacccacgucuccagcuggggagacgugcccuaccugggcaaacgggaggaccaguggugcgggucucucauuggacugacagccagagccaccugggcuuccaauauccagguggccaucaaccagguucggagacugauuggcaaugaaaacuaucucgauuacaugacaagcaugaagcgcuucaaaaaugagggggaccccgaaggcgcgcugugguga

SEQ ID NO: 19336 - RNA, 9879 nt, Artificial Sequence
  derived and/or modified CDS sequence (opt5) from DENV-1__EU482538__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacagagagaaaccugugaacaucgaagccgagccccccuucggcgagucuuauauugugaucggggccggagaaaaggcucugaaacuuagcugguuuaagaagggcuccucuauugggaaaauguucgaggccaccgcucgcggcgcccggagaauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacugaauucccgcagcaccucucucuccaugacauguaucgccguuggccuggugacccuguaccuuggggucauggugcaggcugauagcggaugcguuauuaacuggaagggccgggaacucaaauguggguccggaaucuuugugacaaaugagguccacaccuggacagaacaauauaaguuccaggccgacucuccuaagagacugagcgcggccauuggcaaagcuugggaggagggggugugcggcauccgcuccgccacccggcuggaaaacaucauguggaagcagauuucuaacgagcucaaucauauccugcuugaaaacgacaugaaacugacgguuguggucggagauguggcuggcauucucgcccaggggaagaaaaugaucagaccgcaacccauggaguacaaguauagcuggaaauccuggggaaaggccaagauuaucggcgcugacgugcagaauacaaccuuuaucauugaugggccuaacacccuggaaugucccgacgaucagcgcgcguggaauaucugggaggucgaggacuacggauucggcauuuuuacaaccaacaucuggcugaaacuucgggauagcuauacgcagguuugcgaccacagacucaugucugccgcuauuaaggauuccaaagccgugcacgccgacaugggcuacuggaucgaaagcgagaagaaugaaacauggaaacuggcucgcgccucuuucaucgaggugaagaccuguauuuggccuaagucccauacacuguggagcaacgggguccucgaaucugagaugaucauucccaaaaucuauggaggcccgauuagccaacacaauuaccggccuggguacuucacccagacagcgggacccuggcaucugggcaagcuugagcuggauuuugaccucugcgaagggaccacggugguuguggaugagcacugcggaaacagaggcccuucccugcggaccacaaccgucacaggcaaaaucauccacgaaugguguugccgcagcuguacccugcccccucuuagauucaagggggaggacggaugcugguauggcauggagauucggcccgugaaagaaaaggaggaaaaucucguuaagucuaugguguccgcugggagcggagaggucgacuccuuuucucugggccugcucuguaucagcauuaugaucgaagaggugaugagaucccgcuggucucggaaaaugcugaugacggggacacuugccguuuucuuucugcucauuaugggacagcugaccuggaacgaucugaucagacuuugcauuauggugggcgccaaugcuagcgaccgcaugggcauggggacaaccuaccuggcccucauggcgaccuucaagaugagaccgauguuugcugucggacugcucuuccggcgccugacauccagagaggugcuucugcucacgaucggccugucucugguggccagcgucgaacuuccuaacucccuggaggaacucggggauggacuggccaugggcaucaugauucucaaacugcuuaccgacuuucaaagccaucagcugugggcuacacuccugucucugaccuucauccggacaaccuuuucccuucacuaugccuggaagacgauggcuaugguucugagcauugugucucucuucccccugugucucuccacaaccagccagaaaaccacauggcugcccgugcuucuggggucucugggaugcaagccucucaccauguuucugaucgccgagaauaagauuuggggccgcaaauccuggccgcuuaacgaaggcaucauggcggucgggaucgugagcauucugcucuccagccugcucaagaacgauguuccccuggccggaccucuuaucgcuggcgggaugcugauugccuguuacgugaucucuggaagcuccgcugaccugucucucgagaaagccgccgaggucagcugggaagaggaagcugagcauuccggcgcgucucacaauauucugguggaaguucaggaugacgggacaaugaagaucaaagaugaggagagagacgauacgcuuaccauccugcucaaggccacacugcucgcugugagcggagucuauccccuguccauuccugccacccuuuucgugugguacuucuggcaaaaaaagaagcagcggucuggcguccugugggacacacccagcccucccgaaguggagcgcgccguucuggaugacggcaucuauagaauuaugcagcgggggcuccugggacgcucccaggugggcgucgggguguuucaagaaaacguuuuccauaccauguggcacgugacgagaggagcuguccuuauguaccagggcaaacggcuggagccgagcugggccucugugaagaaagaccucaucuccuacgggggaggcuggagacugcagggcagcuggaauaccggggaggaagugcagguuauugcggucgagccuggaaagaaccccaaaaaugugcaaacagcuccuggcaccuuuaagacaucugaaggggaggugggagccaucgcccucgauuucaagcccggcaccuccgggagcccgauugucaaccgcgaaggaaaaaucgugggccuguauggcaaugggguugugacaacguccggaaccuacgucucugcuaucgcccagacaaaggcgagccaggagggcccucuucccgagauugaagacgagguguuucggaaaagaaaccugaccaucauggaucugcacccuggguccggaaagacccgccgguaucuccccgcuauuguuagagaagccaucaaacgccggcugagaacacuuauucuggcccccacgcgcguggucgcuagcgagauggccgaagcucucaagggcaugccuauccgguaccaaaccacagccgugaagucugagcauaccgggaaagagaucguugaccugaugugccacgcgacauucaccaugagacugcucuccccggugcggguccccaauuauaacaugauuaucauggaugaagcccauuuuacggacccuagcucuauugcugcccgcggcuacaucagcacaagagugggaaugggcgaggcugccgccauuuucaugaccgcuacccccccuggguccguggaagcguuuccccagucuaaugccgucauccaggaugaggaacgggacaucccugagcgcagcuggaacuccggauaugaguggauuacagauuucccgggcaagaccguuugguuugugcccucuaucaaaagcgggaaugacauugcuaacugucuuagaaagaauggaaaacgggugauccagcuguccagaaagacauucgauaccgaauaccaaaagacgaaaaacaacgacugggacuacgucgugacaaccgauauuagcgagaugggcgccaauuuccgcgccgaccggguuaucgauccuagacgcugccugaagcccgugauucucaaagacgggccugaacgggucauccuggcuggccccaugccggugacaguugccucugcggcucagagacgcggacggaucggcagaaaccacaauaaggagggggaucaguauauuuacaugggacagccucuuaacaaugacgaggaucaugcccacuggaccgaagccaaaaugcugcucgacaacaucaauacgcccgagggcauuauccccgcucuguuugaaccugagcgcgaaaaguccgccgcgauugauggggaguauagacugcggggagaggcccgcaagaccuucguggaacucaugagacggggcgaccuucccgucuggcugagcuacaaaguggcuuccgagggguuucaauauucugaucgcagauggugcuucgacggcgaacggaacaaucagguccuggaggaaaacauggauguggagaucuggacaaaggagggagaaagaaaaaagcuccgcccucgguggcuggacgccagaaccuacagcgacccgcuugcucugcgcgaguuuaaagaauucgccgcuggccggagauccguuucuggggaucucauccuggagauuggaaagcugccccagcaccucacacagcgggcccaaaaugcgcuugacaaccuggugaugcugcauaauagcgaacagggcgggcgcgccuauagacacgcuauggaggagcucccugauaccaucgaaacacugaugcuucuggcccucauugcugugcugaccggaggcgucacgcuguuuuuccucuccggccgggggcuuggaaaaacaagcaucggccugcuguguguuauggccucuuccgugcuccuguggauggccagcguggagccccauuggauugcugcgucuaucauccuugaauuuuuccugaugguccuccugauuccugagcccgaccgccagagaaccccgcaggauaaccaacuggccuacgugguuaucgggcuccuuuuuaugauucugaccguggcugccaaugagaugggacugcucgaaacaaccaagaaggaccugggcaucgggcacgucgccguggagaaccaccaucacgcugccaugcuugaugucgaccugcauccugcguccgccuggacacucuacgcuguggccacgaccauuaucacacccaugaugcggcacaccauugaaaacacaaccgcuaauaucagccugacggccaucgcgaaccaggccgcuauucugaugggacucgauaaaggcuggccuaucucuaagauggacauuggcguuccccuucuggcccuggggugcuauagccaggugaauccucucacccugacagcugccguccuuaugcugguggcucauuacgccaucauuggacccggccuccaagcgaaagccacccgcgaggcucagaagagaacagccgcugggaucaugaaaaacccgaccguugauggaaucguggccauugaccuggauccugucguguaugacgccaaguucgaaaagcagcugggccagaucaugcuccuuauucuguguacgucccaaauccugcucaugcggacaaccugggcgcugugcgagucuauuacacuugcuaccgggccccugaccacacucugggagggaagccccggcaaauuuuggaauacgaccaucgccguguccauggcuaacaucuuccgcggcagcuaccuggccggggccggacuggcuuucucccucaugaagucucuuggcgggggaagacggggcacaggggcccagggagaaacccugggcgagaaauggaagagacagcugaaucagcucagcaaauccgaauuuaacacauauaagcgcucuggcauuauggagguugaccggagcgaagcgaaggaggggcugaaaagaggagagaccacgaagcacgccgucucccgcggcacagcuaaacuucggugguucguggauagaaaucuggugaagccugaagggaaagucaucgaccucggauguggccgcgggggauggucuuacuauugcgccggccugaagaagguuaccgaggugaaaggcuacaccaaggggggaccgggccacgaagagcccauuccuauggcuacauacggguggaaccuggugaaacuccauagcggaaaggaugucuuuuucauccccccugaaaaaugugacacccuucugugcgauauuggcgaguccagccccaauccuacaaucgaggaagggcggacgcugagagugcucaagaugguugagccguggcugcgcggaaaccaauuuuguauuaaaauccuuaaucccuauaugccuucuguggucgaaacccuggagcagaugcagcggaagcacggcggcaugcucgugagaaacccccugucccgcaauagcacacaugagauguacuggguuucuugcgggaccggaaacaucguguccgccgucaauaugacaagccggaugcugcucaacagauucaccauggcgcaccgcaagccuacguaugaaagagacguggaucugggcgccgggacccggcacguggcugucgagcccgaaguugccaaccuugacauuaucggacagcgcauugagaauaucaaacaugaacacaagucuacauggcauuacgaugaggacaacccguauaaaaccugggcuuaccacggcuccuaugaggugaagccuagcggguccgccagcucuauggugaauggagucgugaaacugcucacaaagcccugggauguuauucccauggugacccaaaucgcuaugacagacaccacgccuuuuggccagcagagagucuucaaggaaaaaguggacacacggacccccaaggccaaaagaggcaccgcgcaaaucauggagguuacagccaaguggcuguggggguuucuuagccggaacaaaaagccucgcauuuguacgagagaagaguucacccggaaggugcgcuccaaugcugccaucggagcugucuuuguggaugaaaaccaguggaauucugccaaagaggccguugaggacgaaagauucugggaucuggugcaucgggagcgcgaacuccacaagcagggcaaaugcgcgacaugcgucuacaacaugauggggaagagagagaaaaagcugggagaauuuggcaaggcuaaagggagccgggccauuugguacauguggcugggcgcccgcuuccucgaguucgaggcucugggauuuaugaaugaagaccacugguucuccagagagaacucucuuagcggcguggaaggggagggacugcauaagcucggcuauauccugcgggauauuuccaaaaucccggggggaaauauguacgccgacgauaccgcuggcugggacacacgcaucaccgaggaugaccuucagaacgaagccaagauuacagauaucauggagcccgaacacgcgcugcucgccaaaucuauuuuuaagcugaccuaucaaaauaaagucgugagaguucagcggccugcuaagaacgggacggugauggacgucaucagccgcagagaucagcggggcuccggacaggugggcaccuacgggcugaauacauucaccaacauggaggcccaacucauuagacagauggaaagcgagggaaucuuuucucccuccgagcuggaaacaccuaaccuugcuggccgcgugcuggacuggcucgagaagcaugggguugaacggcugaaaagaauggccaucagcggagacgauuguguggucaagcccauugacgaucgcuucgcgaccgcccuuacggcucugaaugacaugggcaaagugcggaaggauaucccgcagugggagccuucuaaaggguggaacgacuggcagcaaguucccuuuugcucccaccacuuccaucagcucauuaugaaggauggcagagaaaucguggucccuugucgcaaucaggacgagcuggugggacgggccagagucagccagggcgcuggguggucccugcgcgagacagccugccucggaaagucuuaugcucaaauguggcagcugauguacuuucaccggagagaucuucgccuggccgcgaacgccauuuguagcgcugugcccguugacugggugccuaccucccggacaaccuggagcauccaugcccaccaucaguggaugacgaccgaagauaugcucucugucuggaauagaguguggauugaggaaaaccccuggauggaggacaaaacacacguuuccagcugggaagacgugccguaucugggcaagcgggaggaucaauggugcgggucucuuaucggacugaccgccagagcuacaugggccaccaauauccaggucgcgauuaaccaggugcgccggcuccugggcaaugagaacuaccuggacuacaugacaagcaugaaaagauucaagaaugaauccgauccugagggggcucucugguga

SEQ ID NO: 19337 - RNA, 9879 nt, Artificial Sequence
  derived and/or modified CDS sequence (opt5) from DENV-1__EU482539__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacacugcaaauccugcucaugagaaccacaugggcgcugugcgaaucuauuacccuugcuaccggaccucugacaacgcucugggagggcagcccgggcaaguuuuggaauaccacaaucgccguguccauggcuaacaucuuccgggggucuuaccuggccggagccggccuggcuuucagccucaugaaaucccuugggggaggccgcagagggaccggagcccagggcgagacacugggcgaaaaguggaaacggcagcugaaucagcucagcaaguccgaguuuaacaccuauaagagaucugggauuauggaaguugaccgcagcgaggcgaaagaaggacugaagcggggcgagacgacaaaacacgccgucuccagagggaccgcuaaacuucgcugguucguggagcggaaucuggugaaacccgaaggaaaggucaucgaucucggcugugggagaggaggcuggucuuacuauugcgccggccugaagaaaguuaccgaggugaagggguacacaaaaggaggcccugggcacgaggagcccauuccuauggcuaccuacggauggaaccuggugaagcuccauagcggcaaagacgucuuuuucauucccccugaaaagugugauacacuucugugcgacauuggggaguccucuccgaaucccacgaucgaggaaggacgcacccugcgggugcucaaaaugguugagccuuggcugagaggcaaccaauuuuguauuaagauccuuaaucccuauaugccuagcguggucgaaacacuggagcagaugcagcgcaagcacggcgggaugcucgugcggaacccccuguccagaaauagcacccaugagauguacuggguuucuugcggaacaggcaacaucguguccgccgucaauaugaccagccgcaugcugcucaaccgguucacgauggcgcacagaaaaccgaccuaugaacgcgauguggaccugggggccggaacaagacacguggcugucgagccugaaguugccaaccuugauauuaucggccagcggauugagaauaucaagcaugaacacaaaucuaccuggcauuacgacgaggauaaccccuauaagacaugggcuuaccacggguccuaugaggugaaacccagcggaucugccuccagcauggugaauggcgucgugaagcugcucaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcuguggggauuucuuuccagaaacaagaagccccggauuuguacccgcgaagaguucacaagaaaagugcggagcaaugcugccaucggcgcugucuuuguggacgaaaaccaguggaacucugccaaggaggccguugaggaugaacgcuucugggaccuggugcauagagagcgggaacuccacaaacaggggaagugcgcgaccugcgucuacaacaugaugggaaaacgcgagaagaagcugggcgaauuugggaaagcuaagggcagcagagccauuugguacauguggcugggagcccgguuccucgaguucgaggcucugggcuuuaugaaugaagaucacugguucucccgcgagaacucucuuagcgggguggaaggagagggccugcauaaacucggguauauccugagagacauuuccaauaucccuggaggcaacauguacgccgaugacacagcugggugggauacccggaucacagaggacgaucuucagaaugaagcccgcauuaccgacaucauggagcccgaacacgcgcugcucgccaagucuauuuuuaaacugacguaucaaaacaaggucgugagaguucagcggccugcuaaaaauggcaccgugauggaugucaucagccgcagagaccagcggggauccggccagguggggacauacggacugaacaccuucacaaacauggaggcccaacucauuagacagauggaaucugagggcaucuuuagccccuccgagcuggaaaccccgaaucuugcugagcgcgugcuggauuggcucgaaaaguaugggguugagcggcugaagagaauggccaucagcggagacgacuguguggucaaaccuauugaugaccgcuucgcgacggcccuuacagcucugaacgauaugggcaaggugcggaaagacaucccccagugggaaccuucuaagggguggaaugauuggcagcaaguucccuuuugcucccaucacuuccaccagcucauuaugaaagacggcagagagaucguggucccuugucgcaaccaggaugagcuggugggacgggccagagucagccagggcgcuggguggucucugcgcgaaaccgccugccucggaaaguccuacgcucaaauguggcagcugauguauuuucaucggagagaccuucgccuggccgcgaaugccauuuguagcgcugugcccguugauuggaucccgacaucccggaccacguggucuauucacgcccaucaccaguggaugaccacagaggacaugcucagcguguggaacagagucuggaucgaagagaauccuuggauggaagauaagacccauaucuccagcuggggcgacgugcccuaccuggggaaacgggaggaccaauggugcggaucucuuauuggccugacagccagagcuaccugggccacaaacauccagguugcgauuaaucaggugcgccggcucaucgggaacgagaauuaccuggauuauaugaccuccaugaagagauucaaaaacgaaagcgaccccgagggcgcucugugguga

SEQ ID NO: 19338 - RNA, 9879 nt, Artificial Sequence
  derived and/or modified CDS sequence (opt5) from DENV-1__KP188539__SS-prME
agcgugaccaugcugcucaugcugcuucccacagcucuggcuuuccaccuuacgaccagaggcggggagccucauaugauugucuccaagcaggaacggggaaagucucugcuuuuuaagacaagcguuggcgugaacaugugcacccugauugccauggaccucggggagcugugugaagauacaaugaccuacaaaugcccccgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagaacaagaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccauuaucacgccccaagcuccuaccuccgagauucagcugaccgacuacggcgcccucacacuggacuguagccccagaaccggccuugauuucaacgaaaugguccugcucacaaugaaagagaagucuuggcuggugcauaaacagugguuucuugaccugccucuccccuggaccuccggggccagcacgucccaagagacauggaaucggcaggaucugcuggucaccuucaagacagcucacgcgaagaaacaggaagugguugugcucggaucucaagagggcgccaugcacaccgcucugaccggggccacagaaauccagacgagcggaaccacaaccauuuuugccggccaucuuaagugccgccugaaaauggacaagcucacacugaaagggauguccuaugucauguguaccggcagcuucaagcuggagaaggaaguggcugagacgcagcacggaacaguucuugugcaggucaaauacgagggcaccgaugccccgugcaagaucccuuuccucacccaagacgaaaaaggggugacacagaacggaagacugaucaccgcgaaucccauugugacagauaaggagaaaccuguuaacaucgaaacggagccgcccuuuggcgagucuuauauugucgugggggcuggagaaaaggcccugaagcucuccugguucaaaaagggcagcucuaucgggaaaauguuugaggccaccgcucggggcgccagacgcauggcuauucugggagacacagccugggauuucggcagcaucgggggacuuuuuaccuccgugggcaagcugauccaucaggucuucgggacagcguacggagugcucuuuucuggcguuagcuggaccaugaaaauugggaucggcauucugcugacguggcuuggacucaauucccggagcaccucucuguccaugacauguaucgccgugggcauggucacccuguaccucggggugaugguucaggcugacagcggaugcgugauuaacuggaagggcagagaacugaagugugggucuggaaucuucgucacaaacgaggugcacaccuggacagaacaauauaaauuucaggccgauuccccuaagcgccuuagcgcugccauuggcaaagcgugggaggaggggguuugcggcauccgguccgccaccagacuggaaaauaucauguggaagcagauuucuaacgagcucaauuacauccugcuggaaaacgacaugaaauucacgguggucgugggagacgugaauggcauucuugcucaggggaagaaaaugauccgcccgcaacccauggagcauaaguauagcuggaaguccuggggaaaagccaagauuaucggcgcugauauccagaacacaaccuuuauuaucgacgggccugauacccccgaauguccugacgaucagcgggccuggaauauuugggaggucgaggacuacggauucggcaucuuuacaaccaacauuuggcucaaacugagagauucucacacgcagaugugcgaccaccgccugaugagcgccgcuaucaaggauuccaaagcgguucaugccgacaugggcuauuggaucgaaagcgagaagaaugaaacauggaagcucgcucgggccucuuucauugaggugaaaaccuguaucuggcccaagucccacacacuguggagcaacggggugcuugaaucugagauggucauuccgaaaaucuacggaggcccuauuucccaacauaauuauagacccggguacuucacccagacagccggaccuuggcaccugggcaagcucgagcuggauuuugaccugugcgaagggaccacggugguuguggaugagcacugcggauaccgcggccccagccuucggaccacaaccgucacaggcaaaaucauccaugaaugguguugcagaucuuguacccucccuccccugcgguuccgcggggaggacggaugcugguauggcauggagauuagaccggugaaggaaaaggaggaaaaccugguucggagcaugguguccgcugggagcggagagauggacucuuuuucccucggcauccugugugucagcauucuuaucgaagaggugaugagaucccgcuggucucggaaaaugcugaugacggggacacucgccguuuuccugcugcuuauuaugggacagcugaccuggaaugaucucaucagacugugcauuauggugggcgcgaacgcuagcgaccgcaugggcauggggacaaccuaccucgcccugauggccaccuuuaagaugagaccuauguucgcugucggacuucuguuucggcgccucacauccagagaggugcugcugcuuacggugggccugucucucgucgccagcguugaacugcccaauucccucgaggaacugggggauggacuugcgaugggcaucaugaugcugaaacuccugaccgacuuccaaccccaccagcuguggacaacccuucugucucucacauuuauccggaccagccugucccucgauuaugcuuggaagacgauggccauggcccugagcauugugucucuuuucccucugugucuguccacaaccagccagaaaaccacauggcucccggugcugcuugggucuuuuggaugcaagccccugaccauguuccucaucacagagaacaagauuuggggccgcaaauccuggccuaucaacgaaggcauuauggcugucgggaucgugagcauccugcucucuucccugcuuaaggacgauguuccccuggccggaccucugauugcuggcgggaugcucaucgccuguuacgugauuagcggauccagcgcggaccugucucuugagaaagccgcugaggucagcugggaagaggaagccgagcauuccggcacgucucacaauauccugguggaaguucaggaugacgggaccaugaagauuaaagaugaggagagagacgauacacucaccauccugcucaaggcuacacugcuugccgugagcggagucuaucccauguccaucccugccacccuguuugugugguacuucuggcagaagaagaagcagcggucuggcguccugugggacacgcccagcccgccugaaguggagcgcgcuguucucgacgauggcauuuauagaauccugcagcgggggcuucugggacgcucccaggugggcgucgggguguuccaagacggaguuuuucauaccauguggcacgugacaagaggcgcgguccucauguaccaggggaaacggcuggaacccucuugggccagcgugaagaaagaucucauuuccuacggaggcggcuggagauuccaggggagcuggaacaccggagaggaggugcagguuaucgcugucgaaccuggcaagaaucccaaaaacgugcaaacaaccccggggacauuuaagacgccugagggagaagugggcgccauugcccuggacuucaagcccgggaccucuggauccccuaucgucaaucgcgagggcaaaauugugggccuuuaugggaacggaguugugacaaccagcggcaccuacgucucugcuaucgcccaggcgaaggcuacacaggaagggccccugcccgagaucgaggaugaaguguuuaaaaagcggaaucugacgauuauggaccuccacccuggauccggcaaaaccagacgcuaucugccggccaucguucgggaggccauuaagagaaaacuucgcacacugauccucgcucccacccggguggucgccagcgaaauggcggaggcucugaaagggaugccuauuagauaccaaacaaccgccgugaaguccgaacauacgggccgcgagaucguugaucugaugugccacgccacauucaccaugcggcuccuuucucccgugagagucccuaacuauaauaugaucauuauggacgaggcucauuuuaccgaucccgccagcaucgcugcccggggauacauuuccacacgcgugggcaugggggaagcggccgcuaucuucaugaccgccacaccuccgggaagcguggaggcuuuuccccagucuaacgccgucauucaggacgaagagagagauaucccugaacgguccuggaauagcggcuaugacuggaucaccgacuuccccgggaaaacgguuugguuugugccuucuauuaagagcggaaacgauaucgccaauugucugcgcaaaaacggcaagagagugauucagcugucccggaagacauucgacaccgaguaccagaagacaaagaauaacgauugggacuacgucgugaccacggauaucucugagaugggggcuaacuucagagcggaccgcguuauugauccccggagaugccucaaaccggugauccugaaggaaggcccugagcgcgucauucuugccggacccaugcccgugaccguugcuagcgccgcccagcggagaggccgcaucgggcggaaucagaacaaagaaggagaccaguauaucuacaugggccaaccucugaauaacgaugaggaccacgcucauuggacagaggccaagaugcuccuggauaauauuaacacccccgaagggaucauuccugcgcuguuugagccggaaagagagaaguccgcugccaucgacggagaauaucgccucagaggcgaggcccggaaaacauucguggagcuuaugcgcagaggggaucugcccgucuggcugucuuacaagguggcuagcgaaggcuuucaguauuccgaccggcgcuggugcuucgacggagagagaaauaaccagguccucgaagagaauauggauguggaaauuuggaccaaagagggcgagcggaagaaacugagaccucgcuggcuugacgcccggacauacagcgauccccuggcgcucagagaauuuaaggaguucgccgcugggcgccggucuguuuccagcgaccugauccuggaaaucggaaaacucccucagcaccuuacccugagagcccaaaacgcucuggauaaucucgugaugcugcacaacuccgagcagggcgggaaggccuaucggcaugcuauggaggaacuucccgacacgauugagacacugaugcuccuggcccugaucgcggugcucaccggaggcgucacccucuuuuuccugucuggcaaggggcugggaaaaacaagcauuggccuccuguguguuauggccuccucugcccuucuguggauggccagcguggaaccgcacuggaucgcugccuccauuauccucgaguuuuuccugauggugcugcucaucccugaacccgaucgccagagaaccccucaggacaaucaacuugccuacgucgugauugggcugcuguuuaugauccucacaguugcugcgaacgagaugggacugcuugagacgaccaagaaagaucugggcauugggcauguggccgucgaaaaucaccaccaugcuacaaugcucgacguggaucugcggcccgccagcgccuggacccuguacgcugucgccacaaccgugaucacgccuaugaugcgccacaccauugagaacacaaccgcgaacaucucucucacagccauugcuaaucaggccgcuauccuuaugggacuggacaagggcuggcccaucuccaaaauggauauuggcguuccgcugcucgcccuggggugcuauagccaggugaacccucuuacccugacggcggccguccucaugcugguggcucauuacgccaucauuggacccggccugcaagcuaaggccacaagagaagcucagaagcggaccgccgcggggaucaugaaaaaucccacaguugacggaauugugaccaucgaccucgauccugucguguaugacgccaaguucgagaaacagcuuggccagaucaugcugcugauucucuguaccucucaaauccugcuuaugcgcacaacgugggcucugugcgaauccauuacccucgccacagggccgcugaccacacugugggagggaagccccggcaaguuuuggaacaccacgaucgcugugucuauggccaauauuuucagaggcagcuaccucgccggggcgggacuugcuuucucccugaugaaaucucugggcgggggacggcgcggcacaggggcccagggagagacccucggcgaaaaguggaagagacagcugaaccagcuuagcaaauccgaguuuaauaccuauaagaaaagcggcaucauggaaguugaucgguccgaggcuaaggaagggcugaaaagaggagagacaaccaagcacgccgucucucgcggcacagccaagcuccggugguucguggagagaaaccuggugaaaccugaagggaaggucaucgaccugggauguggccgcgggggauggagcuacuauugcgcuggccucaaaaagguuacggaggugaaaggcuacaccaaagggggacccggccaugaggagccuauucccauggccacauacggguggaaucuugugaaacugcacuccggaaaggaugucuuuuucaccccuccggaaaagugugacacacugcucugcgauaucggcgagucuagccccaacccuaccauugaggaagggcggacgcugagagugcuuaaaaugguugagcccuggcugcgcggaaaucaauuuuguaucaagauucucaacccuuauaugcccuccguggucgaaacccuggagcagaugcagcggaaacacggcggcaugcuggugagaaauccgcucucucgcaacagcacacaugagauguacuggguuuccugcgggaccggaaauaucgugagcgcggucaacaugacaucucggaugcugcuuaauagauucaccauggcccaccgcaagccuacauaugaacgggacguggaucugggcgcugggaccagacauguggccgucgagcccgaaguugcuaaccucgacauuaucggacagcgcaucgagaacauuaaaaaugaacacaaguccacguggcacuacgaugaggacaaccccuauaagacaugggccuaccauggcagcuaugaggugaaaccuucuggguccgcgagcucuauggugaauggagucgugagacugcuuaccaagcccugggacguuaucccuauggugacccaaauugccaugacagauacgaccccguuuggccagcagcgggucuucaaagaaaagguggacacacgcacccccagagcuaaacggggcacagcccaaaucauggagguuaccgcuaaguggcuguggggguuucucuccagaacaaagaaaccucggauuuguacccgcgaagaguucacgagaaaggugcggagcaacgccgcuaucggagccgucuuuguggaugaaaaucaguggaacuccgcgaaagaggccguugaggacgaacgcuucugggaucuggugcacagagagcgggaacugcauaagcagggcaaaugcgcuaccugcgucuacaauaugauggggaagcgcgagaagaaacucggagaauuuggcaaggccaaagggagcagagcuaucugguacauguggcugggcgcccgguuccuugaguucgaggcccugggauuuaugaacgaagaccacugguucucucgcgagaauagccucuccggcguggaaggggagggacugcauaaacuuggcuauauucugagagauaucucuaaaauucccgggggaaacauguacgcggacgauacagcuggcugggacacccggaucacagaggaugaccuccagaaugaagccaagauuaccgauaucauggagccugaacacgcccugcuggcuacgagcaucuuuaaacucacauaucaaaacaaggucgugcgcguucagagacccgccaaguccgggaccgugauggacgucauuucucggcgcgaccagagaggcagcggacaggugggcacauacgggcugaauaccuucacgaacauggaggugcaacuuauccggcagauggaauccgagggaaucuuuucuccgagcgagcuggaaaccccuaaucucgcuaaaaagguucuggauuggcuugagaaacacggcgccgaaagacugaagcgcauggcgaucuccggggacgauuguguggucaaacccauugacgaucgguucgccacagcucucaccgcccugaacgacaugggaaaggugagaaaggauaucccucagugggagcccagcaaaggcuggaacgacuggcagcaaguuccuuuuugcucucaucacuuccaucagcugaucaugaaggaugggcgcgaaauugugguccccugucggaaucaggacgagcucgugggcagagcucgcgucucccagggagccggcuggagccugcgggagacagcgugccuugggaaaucuuaugcccaaauguggcagcugauguacuuucacagacgcgaucuccggcuggcugccaacgcuaucuguuccgccgugccgguugacugggugccuaccagcagaacaaccugguccauucacgcucaucaccaguggaugacgacagaagacaugcuuucugucuggaaucgcguguggaucgaggaaaaccccuggauggaggauaagacccauguuagcuccugggaagaggugcccuaucugggaaaacgggaggaccaauggugcggcagccucauugggcugaccgccagagcgacaugggccaccaauauccaggucgcuauuaaccaggugcggagacugaucggaaaugaaaacuaccucgauuacaugacaucuaugaagcgcuucaagaaugaguccgacccugaaggcgcccugugguga

SEQ ID NO: 19339 - RNA, 9879 nt, Artificial Sequence
  derived and/or modified CDS sequence (opt5) from DENV-1__KP188540__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggaugcuguguguguccaucaugaucgaggagguuaugcggucuagauggagccgcaagaugcugaugaccggaacacucgcuguguuccugcuucugauuaugggccagcucaccuggaacgaccugaucagacugugcauuauggucggcgccaaugccuccgaccggauggggaugggaaccacauaccuugcucugauggccacguuuaagaugcgcccuauguucgcggugggccuccuguuuagacggcucaccucucgcgaagugcugcuucugacaaucgggcucagccuggucgcuuccguugagcugcccaacucucuugaagagcugggagauggccucgccauggggauuaugaugcugaaacuccugaccgaauuccaaccccaccagcuuuggacaacccugcucagccugacguuugugaagacaacccugucccuugacuaugccuggaaaaccacagcuauggugcugagcaucgucucucucuucccucugugucucuccaccacaagccagaagacgaccuggcugccggugcuucugggaucuuuuggcugcaaaccccugacaauguuccucauuaccgagaacaagaucuggggcagaaaguccuggccucugaaugaggggaucauggccauuggaaucguuagcauucuucugucuucccuccugaaaaacgaugugccccucgcuggcccucugaucgccgggggaaugcuuauugcguguuacgucaucagcggcuccagcgccgaccugucucuggaaaaggcugccgaggugagcugggaacaggaggcugaacauuccggggccucucacaauauccucguugaggugcaagaugacggaacaaugaaaauuaaggaugaggaacgggacgauacccugacgauccuucugaaagccacccuccuggcugucagcggcguguaucccauguccauuccugcgacacucuucgucugguacuuuuggcagaagaaaaagcagcgcucuggcgugcugugggacacccccagcccgccugagguugaaagagccgugcuugaugacgggaucuaucggauucugcagcgcggacugcucggcagaucccaagucggggugggaguuuuccaggauggcguguuucauacaauguggcacgucacccggggggcugugcugauguaccagggaaagagacuugagcccucuugggccagcgugaaaaaggaccugaucuccuauggcggcggguggcgcuuccagggaagcuggaacacaggcgaggaaguucaagucaucgccguggagccugggaaaaaucccaagaacgugcagacgaccccgggaacauuuaaaaccccugaaggcgaggucggggcuauugcccucgacuucaagcccggaaccucuggcuccccuaucgugaaucgggaaggcaagauuguugggcuguacggaaacggcguggucacaacgagcgggaccuacgugucugcgaucgcucaggccaaagccucccaagagggaccccuccccgagauugaaaaugagguuuuuaagaaaagaaaccugacaaucauggaucuucacccuggcagcgggaagacccgccgguaucugccggcuauugugagagaagccaucaaacgcaagcugcggacacucauccuggcgcccaccagagucguggcuuccgagauggccgaagcccuuaagggcaugccuauucgcuaccagacgacagcuguuaaaucugagcauaccggacgggagaucguggaccugaugugccacgccaccuucacaaugagacuccugagccccguccgggugccuaauuauaacaugauuaucauggaugaagcucauuuuaccgaccccgccuccauugcggcccgcggcuacaucagcacaagaguggggaugggagaggcugccgcuaucuucaugaccgccacgccuccgggcucugucgaagccuuuccccaguccaaugcuguuauucaggaugaggaacgggacaucccugagcgcagcuggaacucuggguaugauuggauuacagacuuccccggaaagaccgugugguucgugccuagcaucaaauccggcaaugauauugcgaacugucugagaaagaacgggaaacgggucauccaacucucuagaaagacauuugacaccgaguaccagaagacgaaaaauaacgauugggacuaugugguuaccacagacaucagcgaaaugggcgccaauuuccgcgcugaucgggugauugaccccagacgcugccuuaagccggucauccugaaagauggaccugagcgggugauucuggccggccccaugcccguuaccguggccuccgcugcccagagacgcgggcggaucggaagaaaccagaauaaggaaggcgaccaauacgucuacauggggcagccucucaacaaugaugaggaccacgcgcauuggacagaggcuaaaaugcugcuugauaacauuaauacccccgaaggaaucauuccugcccuguuugagccggaacgcgagaagucugccgcuaucgacggcgaauauagacuccggggggaggcccgcaagacauucguggagcugaugagacggggcgaucugcccgucuggcucagcuacaaaguggcguccgaaggauuucaguauagcgaccgcagauggugcuucgauggcgagcggaacaaucagguucuugaagagaacauggacguggaaaucuggaccaaggagggggagagaaaaaagcugcgcccucgguggcuggaugccagaacguacucugacccccucgcucugcgcgaauuuaaagaguucgccgcuggacggagauccgugagcggcgaccuuauucuggaaaucgggaagcucccucaacaccugacacugcgggcccagaaugcucucgauaaccuugucaugcugcacaauuccgagcagggaggcaaagccuaucgccaugcgauggaagagcugcccgacaccauugagacccucaugcugcuugcccugaucgcuguucucacaggcggggccacccuguuuuuccugucuggaaagggccucgggaagacaagcauuggacuucugugugugacggcuuccucugcccugcucuggauggccagcguggaaccgcacuggaucgcugcguccaucauucuggaguuuuuccuuaugguccugcucaucccugaacccgauagacagcggaccccucaagacaaccagcuggccuacgugguuauuggccugcucuuuaugauccuuacaguggcugccaacgagauggggcugcuggagaccacaaaaaaggaucucggaauuggcuaugucgccgcugaaaaucaucagcacgccaccaugcuggacguggaucuucaccccgcgagcgccuggacgcuguacgcugucgccaccacagugaucaccccuaugaugcgccauacaaucgagaacaccacggcuaauauuucucucacagccaucgcgaaccaagccgcuauucugaugggccuggacaaaggguggcccaucuccaagauggauauuggaguuccgcuccuugcccugggcugcuacagccaggugaauccucugacccucacagcugccguccugaugcuuguggcucacuaugccaucauugggcccggacugcaggcgaaagccaccagagaagcucagaagcggaccgccgcuggcaucaugaagaaccccacaguugacgggaucguggccauugaucucgacccugucguguacgaugccaaauucgagaagcaacugggacagaucaugcugcucauucuuuguacgucucagauccugcugaugcgcaccacaugggcgcucugcgaauccauuacccuggcuacaggcccgcuuaccacgcugugggagggcagccccgggaaauucuggaauacaaccaucgccgugucuauggcuaacaucuuuagaggaagcuaucucgccggcgccgggcuggcuuucucccugaugaagucucucggaggcgggcggcgcggaaccggcgcccagggcgagacacuuggggaaaaauggaagagacaacugaaucagcugagcaaguccgaguuuaacaccuacaaacggagcggaauuauggaaguugacagauccgaggcgaaggaaggccucaaacgcggggagacaacgaagcaugccgucucucggggaaccgcuaaacugagaugguucguggagcgcaaucuugugaagccugaaggcaaggucaucgaccugggguguggacggggcggcuggagcuauuacugcgccgggcucaaaaagguuacagaggugaaaggauauaccaagggcgggcccggacacgaagagccuauucccauggcuacauacggcuggaaccuggugaaacugcauuccgggaaggaugucuuuuucaugccuccggaaaaaugugacacccuccuuugcgauaucggagagucuagccccaauccuacgauugaggaaggcagaacccugcgcgugcugaagaugguugagcccuggcuccggggcaaccaguuuuguaucaagauccugaauccuuacaugcccuccguggucgaaacacuugagcagaugcaaagaaaacacgggggaaugcuggugcgcaacccgcucucucggaauagcacccacgagauguauuggguuuccugcggcacagggaacauugugagcgccgucaacaugaccucuagaaugcugcugaaucgcuucacaauggcgcaucggaagccuaccuacgaaagagacguggaucucggagccggcacgcgccacguggcugucgagcccgaaguugccaaccuggacaucauugggcagagaaucgagaauauuaaaaacgaacauaaguccacauggcacuaugaugaggacaaucccuacaaaaccugggcuuaucacggaagcuacgaggugaagccuucuggcuccgccagcucuauggugaacggcgucgugcggcuucugaccaagcccugggauguuaucccuauggugacacagauugcuaugacggacaccacaccguuugggcaacagcgcgucuucaaagaaaagguggauaccagaacaccccgggccaaaagaggaaccacacagaucauggagguuaccgcgaaguggcucuggggcuuucugucccggaauaaaaagccucgcaucuguacgagagaagaguucacccggaaggugcgcagcaacgccgcuauuggggccgucuuuguggacgaaaaucaguggaacuccgcuaaagaggccguugaggacgaaagauucugggaucuugugcaucgggagcgcgaacugcacaagcaaggaaaaugcgccacaugcgucuauaauaugaugggcaagagagagaaaaagcucggggaauucggcaaggcgaaaggaagccgggcuaucugguacauguggcugggcgcccgcuuucuggaguucgaggcccucggguuuaugaacgaagaccauugguucucuagagagaauagccuguccggaguggaaggcgaggggcuucacaagcugggauacauucuccgggauaucucuaaaauucccggcgggaacauguaugcugacgauaccgccggcugggacacacgcaucaccgaggaugaccugcagaaugaagcuaagaucacggauauuauggagccugaacaugcccuucuggcgacaagcaucuuuaaacucaccuaccagaacaaggucgugagaguucagcggcccgccaaaaacggaacagugauggacgucauuucccgcagagaucaacggggcucugggcaggugggaaccuauggccugaauacguucaccaacauggaggugcagcugaucagacagauggaaagcgaggggauuuuucucccguccgagcuggaaacaccuaaucuugcugagcgcgcccuggacuggcucgaaaagcacggagcugagcggcugaagagaauggccaucucuggcgaugacuguguugugaaacccaucgacgaucgcuucgcgaccgcccuuacagcucugaacgacauggggaagguccggaaagauauuccucaaugggaacccagcaagggcuggaaugacuggcagcaggugccuuuuugcucccaccauuuccaccagcucaucaugaaagauggaagagagauuguugugcccugucgcaaccaagacgagcuggucggccgggccagagugagccagggggcuggauggucucugcgcgaaaccgccugccucggcaaguccuacgcucagauguggcaacugauguauuuucaucggagagaucuucgccuggccgcgaaugccaucuguagcgcugucccgguggacuggguuccugccucucggacaaccugguccauucacgcccaccaucaguggaugacgacagaggauaugcucagcguguggaacagagucuggaucgaagagaaucccuggauggaagacaagacccacguguccucuugggaggagguucccuaccuggggaaacgggaagaucaguggugcggaagccuuaucggccugaccgcuagagccacaugggcgaccaacauucagguggcuaucaaucaaguccgccggcucauugggaacgagaauuaucuggacuacaugacauccaugaagagauucaaaaacgaaagcgacccugagggcgcccugugguga

SEQ ID NO: 19340 - RNA, 9879 nt, Artificial Sequence
  derived and/or modified CDS sequence (opt5) from DENV-1__KP188541__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggauccuguguguguccaucaugauugaggagguuaugcggucuagauggagccgcaagaugcugaugaccggaacacucgcuguguuccugcuucugaucaugggccagcucaccuggaacgaccugauuagacugugcaucauggucggcgccaaugccuccgaccggauggggaugggaaccacauaccuugcucugauggccacguuuaagaugcgcccuauguucgcggugggccuccuguuuagacggcucaccucucgcgaagugcugcuucugacaauugggcucagccuggucgcuuccguugagcugcccaacucucuugaagagcugggagauggccucgccauggggaucaugaugcugaaacuccugaccgaauuccaaccccaccagcuuuggacaacccugcucagccugacguuugugaagacaacccugucccuugacuaugccuggaaaaccacagcuauggugcugagcauugucucucucuucccucugugucucuccaccacaagccagaagacgaccuggcugccggugcuucugggaucuuuuggcugcaaaccccugacaauguucuucaucaccgagaacaagaucuggggcagaaaguccuggccucucaaugaggggauuauggccaucggaauuguuagcauccugcuuucuucccugcucaaaaacgaugugccccuggcuggcccucucauugccgggggaaugcugaucgcguguuacgucaucagcggcuccagcgccgaccuuucucuggaaaaggcugccgaggugagcugggaacaggaggcugaacauuccggggccucucacaauauucugguugaggugcaagaugacggaacaaugaaaaucaaggaugaggaacgggacgauacccucacgauucugcuuaaagccacccugcucgcugucagcggcguguaucccauguccaucccugcgacacuguuugucugguacuucuggcagaagaaaaagcagcgcucuggcgugcucugggacacccccagcccgccugagguugaaagagccgugcuggaugacgggauuuaucggauccuucagcgcggacugcugggcagaucccaagucggggugggaguuuuucaggauggcguguuccauacaauguggcacgucacccggggggcugugcucauguaccagggaaagagacuggagcccucuugggccagcgugaaaaaggaccuuaucuccuauggcggcggguggcgcuuucagggaagcuggaacacaggcgaggaaguucaagucauugccguggagccugggaaaaaucccaagaacgugcagacgaccccgggaacauucaaaaccccugaaggcgaggucggggcuaucgcccuggacuuuaagcccggaaccucuggcuccccuauugugaaucgggaaggcaagaucguugggcucuacggaaacggcguggucacaacgagcgggaccuacgugucugcgauugcucaggccaaagccucccaagagggaccccugcccgagaucgaaaaugagguuuucaagaaaagaaaccucacaauuauggaucugcacccuggcagcgggaagacccgccgguaucuuccggcuaucgugagagaagccaucaaacgcaagcugcggacacugauucucgcgcccaccagagucguggcuuccgagauggccgaagcccugaagggcaugccuauccgcuaccagacgacagcuguuaaaucugagcauaccggacgggagauuguggaccuuaugugccacgccaccuuuacaaugagacugcucagccccguccgggugccuaauuauaacaugaucauuauggaugaagcucauuucaccgaccccgccuccaucgcggcccgcggcuacaucagcacaagaguggggaugggagaggcugccgcuauuuuuaugaccgccacgccuccgggcucugucgaagccuucccccaguccaaugcuguuauccaggaugaggaacgggacauuccugagcgcagcuggaacucuggguaugauuggaucacagacuuccccggaaagaccgugugguuugugccuagcauuaaauccggcaaugauaucgcgaacugucugagaaagaacgggaaacgggucauccaacugucuagaaagacauucgacaccgaguaccagaagacgaaaaauaacgauugggacuaugugguuaccacagacauuagcgaaaugggcgccaauuuucgcgcugaucgggugaucgaccccagacgcugccucaagccggucauucuuaaagauggaccugagcgggugauccuggccggccccaugcccguuaccguggccuccgcugcccagagacgcgggcggauuggaagaaaccagaauaaggaaggcgaccaauacgucuacauggggcagccucugaacaaugaugaggaccacgcgcauuggacagaggcuaaaaugcuccuggauaacaucaauacccccgaaggaauuaucccugcccuuuucgagccggaacgcgagaagucugccgcuaucgacggcgaauauagacugcggggggaggcccgcaagacauuuguggagcucaugagacggggcgaucugcccgucuggcugagcuacaaaguggcguccgaaggauuccaguauagcgaccgcagauggugcuuugauggcgagcggaacaaucagguucucgaagagaacauggacguggaaauuuggaccaaggagggggagagaaaaaagcuucgcccucgguggcuggaugccagaacguacucugacccccuggcucuccgcgaauucaaagaguuugccgcuggacggagauccgugagcggcgaccugauccuugaaauugggaagcugccucaacaccucacacugcgggcccagaaugcucuggauaaccucgucaugcuucacaauuccgagcagggaggcaaagccuaucgccaugcgguugaagagcugcccgacaccaucgagacccugaugcuccuggcccuuauugcugugcugacaggcggggugacccucuucuuucugucuggaaagggccuggggaagacaagcaucggacuccuuugugucacggccuccucugcucugcuguggauggccagcguggaaccgcacuggaucgccgcuuccauuauccucgaguucuuucugaugguucuucugauuccugaacccgauagacagcggaccccucaagacaaccagcucgcguacguggucaucggccugcuguucaugauucucacaguggccgcuaacgagauggggcuucuggagaccacaaaaaaggaucugggaaucggcuaugucgccgccgaaaaucaucagcacgcuaccaugcucgacguggaucugcaccccgccagcgcguggacgcuuuacgccguugcuaccacagugaucaccccuaugaugcgccauacaauugagaacaccacggccaauaucucucugacagcuauugccaaccaagcggccauccucaugggccuggacaaaggguggcccauuuccaagauggauaucggagucccgcugcucgcucuuggcugcuacagccaggugaauccucugacccugacagccgcuguucucaugcugguggcccacuaugcuauuaucgggcccggacuucaggccaaagcgaccagagaagcccagaagcggaccgcugccggcaucaugaagaaccccacagucgacgggauuguggcuaucgaucuggacccugugguuuacgaugccaaauucgagaagcaacucggacagauuaugcugcugauccucuguacgucucagauucuucugaugcgcaccacaugggcccugugcgaauccaucacccucgcgacaggcccgcugaccacgcuuugggagggcagccccgggaaauuuuggaauacaaccaucgcugucucuauggccaacauuuucagaggaagcuaucuggcuggcgccgggcucgccuuuucccugaugaagucucugggaggcgggcggcgcggaaccggcgcucagggcgagacacucggggaaaaauggaagagacaacuuaaucagcugagcaaguccgaguucaacaccuacaaacggagcggaaucauggaaguggacagauccgaggccaaggaaggccugaaacgcggggagacaacgaagcaugcggugucucggggaaccgccaaacucagaugguuugucgagcgcaaucugguuaagccugaaggcaaggugauugaccuuggguguggacggggcggcuggagcuauuacugcgcugggcugaaaaaggugacagaggucaaaggauauaccaagggcgggcccggacacgaagagccuauccccauggccacauacggcuggaaccucgugaaacugcauuccgggaaggauguuuucuuuaugccuccggaaaaaugugacacccugcucugcgauauuggagagucuagccccaauccuacgaucgaggaaggcagaacccuucgcgugcugaagauggucgagcccuggcugcggggcaaccaguucuguaucaagauucucaauccuuacaugcccuccgugguugaaacacuggagcagaugcaaagaaaacacgggggaaugcuugugcgcaacccgcugucucggaauagcacccacgagauguauugggucuccugcggcacagggaacaucgugagcgcugugaacaugaccucuagaaugcuccugaaucgcuuuacaauggcccaucggaagccuaccuacgaaagagacgucgaucugggagcgggcacgcgccacguugccguggagcccgaaguggcuaaccucgacauuaucgggcagagaauugagaauaucaaaaacgaacauaaguccacauggcacuaugaugaggacaaucccuacaaaaccugggccuaucacggaagcuacgaggucaagccuucuggcuccgcuagcucuauggugaacggcguugugcggcugcuuaccaagcccugggaugucauuccuauggugacacagaucgccaugacggacaccacaccguucgggcaacagcgcguuuuuaaagaaaagguggauaccagaacaccccgggcuaaaagaggaaccacacagaucauggaggucaccgccaaguggcuguggggcuuccucucccggaauaaaaagccucgcauuuguacgagagaagaguuuacccggaaggugcgcagcaacgcggccaucggggcuguuuucguggacgaaaaucaguggaacuccgccaaagaggcugucgaggacgaaagauucugggaucuggugcaucgggagcgcgaacuucacaagcaaggaaaaugcgccacaugcgucuauaauaugaugggcaagagagagaaaaagcugggggaauuuggcaaggccaaaggaagccgggcgauuugguacauguggcucggcgcucgcuuccuggaguuugaggcccugggguucaugaacgaagaccauugguuuucuagagagaauagccucuccggaguggaaggcgaggggcugcacaagcuuggauacauccugcgggauauuucuaaaauccccggcgggaacauguaugccgacgauaccgcuggcugggacacacgcaucaccgaggaugaccuccagaaugaagccaagauuacggauaucauggagccugaacaugcucugcuugccacaagcauuuucaaacugaccuaccagaacaagguugugagaguccagcggcccgcgaaaaacggaacagugauggacgugaucucccgcagagaucaacggggcucugggcagguuggaaccuauggccucaauacguuuaccaacauggaggugcagcugauuagacagauggaaagcgaggggaucuuccugccguccgagcucgaaacaccuaaucuggccgagcgcgcucuugacuggcuggaaaagcacggagccgagcggcucaagagaauggcuaucucuggcgaugacugugucgugaaacccauugacgaucgcuuugccaccgcgcugacagcccuuaacgacauggggaagguucggaaagauaucccucaaugggaacccagcaagggcuggaaugacuggcagcaggugccuuucugcucccaccauuuucaccagcugauuaugaaagauggaagagagaucgucgugcccugucgcaaccaagacgagcucgucggccgggcuagagugagccagggggccggauggucucugcgcgaaaccgcuugccugggcaaguccuacgcccagauguggcaacucauguauuuccaucggagagaucugcgccuugcugccaaugcgauuuguagcgccguuccgguggacugggucccugcuucucggacaaccugguccauccacgcccaccaucaguggaugacgacagaggauaugcugagcguguggaacagaguuuggaucgaagagaaucccuggauggaagacaagacccacguguccucuugggaggagguccccuaccucgggaaacgggaagaucaguggugcggaagccugauuggccuuaccgccagagcuacaugggccaccaacauccagguggcgauuaaucaagugcgccggcugaucgggaacgagaauuaucucgacuacaugacauccaugaagagauuuaaaaacgaaagcgacccugagggcgcucugugguga

SEQ ID NO: 19341 - RNA, 9879 nt, Artificial Sequence
  derived and/or modified CDS sequence (opt5) from DENV-1__KP188543__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagagguggaacccgacgaugucgacuguuggugcaaugcgaccgauacgugggugaccuauggaacauguucccaaaccggcgagcacagacgggacaagcgcucuguugcucuggccccucauguggggcucggacuggagacaagaaccgaaacguggaugagcuccgagggcgccuggaaacagauucagaaggucgaaacaugggcucuucggcaccccggcuucaccgugaucgcccuguuucucgcucaugccauugggacaucuaucacccagaagggaaucauuuucauccugcuuaugcugguuaccccuagcauggcgaugcgcugcgugggcauugggaacagagauuuugucgagggacucuccggcgccacauggguggacgugguccuggagcacgggagcuguguuacgaccauggcuaaaaauaagcccacacuggauaucgaacuccugaaaaccgaggugacaaacccugccgugcuucggaagcugugcauugaagcuaaaaucucuaauaccacgacagacucccgcuguccgacccaaggagaggccacccucgucgaagagcaggaugcgaacuucgugugcagacggacauuuguugaccgcggcuggggcaauggguguggacuguucggcaaggggagccuucugaccugcgccaaguuuaaaugcgugacaaagcucgagggaaaaauuguccaguacgaaaaccugaaguauucugugaucguuacggugcacaccggcgaucagcaucaagucgggaaugagacaaccgaacacggaacaaucgcuaccauuacgccccaggccccuaccuccgagauccagcugacagacuacggcgcucucacccuggacuguagccccagaacaggccuugauuucaacgaaauggugcugcucaccaugaaagagaagucuuggcugguccauaaacagugguuucuugaccugccucuccccuggacguccggggccagcacaucccaagagaccuggaaucggcaggaucugcuggugacauucaagaccgcccacgcuaagaaacaggaaguugugguccucggaucucaagagggcgcgaugcacaccgcccugacaggggcuacggaaauucagaccagcggaacaaccacaaucuuugccggccaucuuaagugccgccugaaaauggacaagcucacccugaaagggauguccuaugugauguguacgggcagcuucaagcuggagaaggaaguugccgagacacagcacggaaccgugcuuguccaggugaaauacgagggcaccgaugcuccgugcaagauuccuuuccucacacaagacgaaaaaggggugacccagaacggaagacugaucacagccaaucccaucguuacggauaaggagaaaccugucaacauugaaaccgagccccccuuuggcgagucuuauaucguggugggggcgggagaaaaggcucugaagcucuccugguucaaaaagggcagcucuauugggaaaauguuugaggccacagcccggggcgcuagacgcauggccauccugggagacaccgcuugggauuucggcagcauugggggacuuuuuacauccgucggcaagcugauccaucagguguucgggaccgccuacggaguucucuuuucuggcgugagcuggacgaugaaaaucgggauuggcauccugcugaccuggcuuggacucaauucccggagcacaucucuguccaugaccuguauugcggucggcauggugacacuguaccucgggguuauggugcaggccgacagcggaugcgucaucaacuggaagggcagagaacugaagugugggucuggaauuuucgugaccaacgagguucacacauggaccgaacaauauaaauuucaggcugauuccccuaagcgccuuagcgccgcuaucggcaaagccugggaggagggggugugcggcauucgguccgcgacgagacuggaaaauaucauguggaagcagaucucuaacgagcucaauuacauucugcuggaaaacgacaugaaauucacagucguggugggagacgucaauggcauccuugcccaggggaagaaaaugauucgcccgcaacccauggagcauaaguauagcuggaaguccuggggaaaagcuaagaucauuggcgccgauauccagaacaccaccuuuaucauugacgggccugauacacccgaauguccugacgaucagcgggcuuggaauaucugggagguugaggacuacggauucggcauuuuuaccacgaacaucuggcucaaacugagagauucucacacacagaugugcgaccaccgccugaugagcgccgccauuaaggauuccaaagcugugcaugcggacaugggcuauuggaucgaaagcgagaagaaugaaaccuggaagcucgcccgggcuucuuucaucgaggugaaaacauguauuuggcccaagucccacacccuguggagcaacgggguccuugaaucugagauggugaucccgaaaauuuacggaggcccuaucucccaacauaauuauagacccggguacuucacacagaccgccggaccuuggcaccugggcaagcucgagcuggauuuugaccugugcgaagggacgaccguuguggucgaugagcacugcggauaccgcggccccagccuucggacaaccacagugaccggcaaaauuauccaugaaugguguugcagaucuuguacgcucccuccccugcgguuccgcggggaggacggaugcugguauggcauggagaucagaccgguuaaggaaaaggaggaaaaccuggugcggagcauggucuccgccgggagcggagagauggacucuuuuucccucggcauucugugugugagcauccuuauugaagagguuaugagaucccgcuggucucggaaaaugcugaugacagggacccucgcuguguuccugcugcuuaucaugggacagcugacauggaaugaucucauuagacugugcaucauggucggcgccaacgcgagcgaccgcaugggcauggggaccaccuaccucgcucugauggccacauuuaagaugagaccuauguucgccgugggacuucuguuucggcgccucacguccagagaggugcugcugcuuaccgucggccugucucucguugcuagcguggaacugcccaauucccucgaggaacugggggauggacuugccaugggcauuaugaugcugaaacuccugacagacuuccaaccccaccagcuguggaccacacuucugucucucaccuuuauccggacgagccugucccucgauuaugcguggaagacaauggcuauggcccugagcaucgugucucuuuucccucugugucuguccaccaccagccagaaaacaaccuggcucccgguccugcuugggucuuuuggaugcaagccccugacaauguuccucauuacggagaacaagaucuggggccgcaaauccuggccuauuaacgaaggcaucauggccguggggauuguuagcauccugcucucuucccugcuuaagaaugacgugccccuggcuggaccucugaucgccggcgggaugcucauugcuuguuacgucaucagcggauccagcgccgaucugucucuugagaaagcggccgaggugagcugggaagaggaagcugagcauuccggcaccucucacaacauucugguugaagugcaggacgaugggacaaugaagaucaaagacgaggagagagaugacacccucacaauucugcucaaggccacccugcuugcugucagcggaguguaucccauguccaucccugccacgcuguuugucugguacuucuggcaaaaaaagaagcagcggucuggcgugcugugggauacccccagcccgccugaaguugagcgcgccgugcucgacgacggcaucuauagaauucugcagcgggggcuucugggacgcucccaggucggcguggggguuuuccaagauggaguguuucauacaauguggcacgucaccagaggcgcugugcucauguaccaggggaaacggcuggaacccucuugggcgagcgugaagaaagaccucaucuccuacggaggcggcuggagauuccaggggagcuggaauacaggagaggagguucaggucauugccguggaaccuggcaagaaccccaaaaaugugcaaaccacaccggggacguuuaagaccccugagggagaagucggcgcuaucgcccuggauuucaagcccgggacaucuggauccccuauugugaaccgcgagggcaaaaucguuggccuuuaugggaauggaguggucaccaccagcggcacauacgugucugccauugcucaggccaaggcgacgcaggaagggccccugcccgagaucgaggacgaaguuuuuaaaaagcggaaccugaccaucauggaucuccacccuggauccggcaaaacaagacgcuaucugccggcuauugugcgggaggccaucaagagaaagcuucgcacccugauucucgcccccacacgggucguggcuagcgaaauggccgaggcgcugaaagggaugccuaucagauaccaaaccacggcuguuaaguccgaacauacaggccgcgagauuguggaccugaugugccacgccaccuucaccaugcggcuccuuucucccgucagagugccuaauuauaacaugaucaucauggaugaggcccauuuuacagaccccgcuagcauugccgcucggggauacaucuccacccgcgugggcaugggggaagccgcggccauuuucaugacagcuaccccuccgggaagcgucgaggccuuuccccagucuaaugcuguuauccaggaugaagagagagacauuccugaacgguccuggaacagcggcuaugauuggaucacggacuuccccgggaaaacagugugguuugugccuucuaucaagagcggaaaugacauugccaacugucugcgcaaaaauggcaagagagucauccagcugucccggaagaccuucgauacagaguaccaaaaaaccaagaacaacgacugggauuacgugguuacgaccgacauuucugagaugggggccaauuucagagcugaucgcgugaucgacccccggagaugccucaaaccggucauucugaaggaaggcccugagcgcgugauccuugcgggacccaugcccguuacaguggccagcgcugcccagcggagaggccgcauugggcggaaccagaauaaagaaggagaucaguauaucuacaugggccaaccucugaacaaugacgaggaucacgcccauuggaccgaggcuaagaugcuccuggacaacaucaauacacccgaagggauuaucccugcccuguuugagccggaaagagagaaguccgcggcuauugauggagaauaucgccucagaggcgaggcccggaaaaccuucgucgagcuuaugcgcagaggggaccugcccguguggcugucuuacaaggucgccagcgaaggcuuucaguauuccgaucggcgcuggugcuucgacggagagagaaacaaucaggugcucgaagagaacauggacguugaaaucuggacaaaagagggcgagcggaagaaacugagaccucgcuggcuugaugcucggaccuacagcgacccccuggcccucagagaauuuaaggaguucgcggccgggcgccggucuguguccggagaucugauucuggaaaucggcaaacucccucagcaccuuacgcugagagcucaaaaugcccuggacaaccucgugaugcugcacaauagcgagcaggggggaaaggcuuaucggcaugccauggaagagcuucccgauacaaucgagacccugaugcuccuggcucugauugccguccucaccggcggcguuacacuuuuuuuccuguccgggaagggacugggcaaaaccucuaucgggcuccugugugugauggcgagcuccgcccuucuguggauggcuucuguggaaccgcacuggauugccgcuagcaucauucucgaguuuuuccugaugguccugcucaucccugaacccgaccgccagagaacaccucaggauaaccaacuugccuacgugguuaucggacugcuguuuaugauucucacgguggccgcuaaugagaugggccugcuugagaccacaaagaaagaccuggggaucggacaugucgcgguggaaaaccaccaccaugccaccaugcucgaugucgaccugcggcccgcuuccgccuggacacuguacgccguggcuaccacgguuauuaccccuaugaugcgccacacaaucgagaacaccacagccaauauuagccucaccgcgaucgccaaccaggcugccauucuuaugggccuggauaagggcuggcccaucucuaaaauggacaucggggugccgcugcucgcucugggaugcuauucccaggucaauccucuuacgcugacagccgcggugcucaugcugguugcccauuacgcuauuaucggccccgggcugcaagccaaggcuaccagagaagcccagaagcggacagcugccggaauuaugaaaaaccccaccguggauggcaucgucaccauugaccucgacccugugguguaugaugcgaaguucgagaaacagcuugggcagaucaugcugcugauccucuguacaagccaaauucugcuuaugcgcacgaccugggcccugugcgaaucuaucacacucgcuaccggaccgcugacaacccugugggagggcucccccggcaaguuuuggaauacgacaauugccguuagcauggcuaacaucuucagagggucuuaccucgccggagccggccuugcguucagccugaugaaaucccuggggggaggccggcgcgggaccggagcucagggcgagacccucggcgaaaaguggaagagacagcugaaucagcuuucuaaaagcgaguuuaacacauauaagaaauccgggauuauggaagucgaccggagcgaggccaaggaaggacugaaaagaggcgagaccacaaagcacgcugugucccgcgggacggccaagcuccggugguucguggagagaaaucuggucaaaccugaaggaaagguuguggaucugggcugugggcgcggaggcuggucuuacuauugcgccggccucaaaaaggugaccgaggucaaaggguacacaaagggaggccccgggcaugaagagccuauccccauggcuaccuacggauggaaccuugugaaacugcacagcggcaaggacguuuuuuucacaccuccggaaaagugugauacccugcucugcgacaucggggaguccucucccaauccuacgauugaggaaggacggacccugagagugcuuaaaauggucgagcccuggcugcgcggcaaccaauuuuguaucaagauucucaauccuuauaugcccagcgugguugaaacacuggagcagaugcagcggaaacacggcgggaugcuggugagaaacccgcucucccgcaauucuacccaugagauguacugggucagcugcggaacaggcaacaucguguccgccgugaauaugaccagccggaugcugcuuaacagauucacaauggcgcaccgcaagccuaccuaugaacgggaugucgaccugggggccggaacgagacauguugcuguggagcccgaaguggccaaccucgauauuaucggccagcgcauugagaauaucaaaaacgaacacaagucuacauggcacuacgacgaggauaaucccuauaagaccugggcuuaccauggguccuaugaggucaaaccuagcggaucugccuccagcauggugaacggcguugugagacugcuuaccaagcccugggacgucaucccuauggugacacaaauugcgaugacggacaccacaccguuuggccagcagcggguuuucaaagaaaagguggauacccgcacacccagagccaaacgggggaccgcucaaaucauggaggucacagccaaguggcuguggggauuucucucuagaaauaagaaaccucggauuuguacccgcgaagaguucacgagaaaggugcgguccaacgcugccaucggcgcuguuuuuguggacgaaaaucaguggaacagcgccaaagaggcggucgaggaugaacgcuucugggaccuggugcacagagagcgggaacugcauaagcaggggaaaugcgccaccugcgucuacaauaugaugggaaagcgcgagaagaaacucggcgaauuugggaaggcuaaaggcuccagagccauuugguacauguggcugggagcucgguuccuugaguucgaggcccugggcuuuaugaacgaagaucacugguucagccgcgagaauucucucagcgggguggaaggagagggccugcauaagcuuggguauauccugagagacaucuccaaaauucccggaggcaacauguacgccgaugacacagcggggugggauacccggaucacagaggacgaucuccagaaugaagcuaagauuaccgacaucauggagccugaacacgcccugcuggccacgucuauuuuuaaacucacauaucaaaacaagguugugcgcguccagagacccgcuaagagcggcaccgugauggaugugaucucccggcgcgaccagagaggaucuggccagguugggacauacggacugaauaccuucacgaacauggaggugcaacuuauccggcagauggaaagcgagggcauuuuuuccccgucugagcuggaaaccccuaaccucgccaaaaagguccuggacuggcuugagaaacacggggcugaaagacugaagcgcauggccaucagcggagaugacugugugguuaaacccauugaugaccgguucgcgacagcccucaccgcucugaaugauaugggcaaggugagaaaggacaucccucagugggagcccuccaaaggguggaacgauuggcagcaagucccuuuuugcagccaucacuuccaucagcugauuaugaaggacggccgcgaaaucgugguccccugucggaaucaggaugagcucgugggaagagcccgcguuucucagggcgcuggguggucccugcgggagacagccugccuuggaaaaagcuaugcgcaaauguggcagcugauguacuuucacagacgcgaccuccggcuggccgcuaacgccaucuguucugcugugccggucgauugggugccuaccuccagaacaaccuggagcauucacgcccaucaccaguggaugacgacagaagacaugcuuuccguuuggaaucgcguguggaucgaggaaaaccccuggauggagaauaagacccaugucucuagcugggaagaggugcccuaucugggcaaacgggaggaccaauggugcgggucccucauuggacugaccgcuagagccacaugggcgaccaacauccagguggccauuaaucagguucggagacugaucggcaacgaaaauuaccucgauuacaugacaagcaugaagcgcuucaagaacgagucugacccugaaggggcucugugguga

SEQ ID NO: 19342 - RNA, 9879 nt, Artificial Sequence
  derived and/or modified CDS sequence (opt5) from DENV-1__KP188544__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucucacacacagaugugcgaccaccgccugaugagcgccgcuauuaaggauuccaaagcgguucaugccgacaugggcuauuggaucgaaagcgagaagaaugaaaccuggaagcucgcucgggccucuuucaucgaggugaaaacauguauuuggcccaagucccacacccuguggagcaacggggugcuugaaucugagauggucaucccgaaaauuuacggaggcccuaucucccaacauaauuauagacccggguacuucacacagaccgccggaccuuggcaccugggcaagcucgagcuggauuuugaccugugcgaagggacgaccgugguuguggaugagcacugcggauaccgcggccccagccuucggacaaccacagucaccggcaaaauuauccaugaaugguguugcagaucuuguacgcucccuccccugcgguuccgcggggaggacggaugcugguauggcauggagaucagaccggugaaggaaaaggaggaaaaccugguucggagcaugguguccgcugggagcggagaggucgacucuuuuucccucggcauucugugugugagcauccuuauugaagagguuaugagaucccgcuggucucggaaaaugcugaugacagggacccucgccguguuccugcugcuuaucaugggacagcugacauggaaugaucucauuagacugugcaucauggucggcgcgaacgcuagcgaccgcaugggcauggggaccaccuaccucgcccugauggccacauuuaagaugagaccuauguucgcugugggacuucuguuucggcgccucacguguagagaggugcugcugcuuaccgucggccugucccucguugccucuguggaacugcccaauagccucgaggaacugggggauggacuugcgaugggcauuaugaugcugaaacuccugacagacuuccaaccccaccagcuguggaccacacuucugucccucaccuuuauccggacgucucugagccucgauuaugcuuggaagacaauggccauggcccuguccaucgugagccuuuucccucugugccugucuaccaccucccagaaaacaaccuggcucccgguccugcuugggagcuuuggauguaagccccugacaauguuccucauuacggagaacaagaucuggggccgcaaaucuuggccuauuaacgaaggcaucauggcuguggggauuguuuccauccugcucagcucucugcuuaagaaugacgugccccuggccggaccucugaucgcuggcgggaugcucauugccugcuacgucaucuccggaagcuccgcggaucugagccuugagaaagccgcugaggugucuugggaagaggaagccgagcauagcggcaccucccacaacauucugguugaagugcaggacgaugggacaaugaagaucaaagacgaggagagagaugacacccucacaauucugcucaaggcuacccugcuugccgucucuggaguguaucccaugagcaucccugccacgcuguuugucugguacuucuggcaaaaaaagaagcagcgguccggcgugcugugggauacccccucuccgccugaaguugagcgcgcugugcucgacgacggcaucuauagaauucugcagcgggggcuucugggacgcagccaggucggcguggggguuuuccaagauggaguguuucauacaauguggcacgucaccagaggcgcggugcucaugcaccaggggaaacggcuggaacccuccugggccucugugaagaaagaccucaucagcuacggaggcggcuggagauuccagggguccuggaauacaggagaggagguucaggucauugcuguggaaccuggcaagaaccccaaaaaugugcaaaccacaccggggacguuuaagaccccugagggagaagucggcgccaucgcccuggauuucaagcccgggacaagcggaucuccuauugugaaccgcgagggcaaaaucguuggccuuuacgggaauggaguggucaccaccuccggcacauaugugagcgcuauugcccaggcgaaggcuacgcaggaagggccccugcccgagaucgaggacgaaguuuuuaaaaagcggaaccugaccaucauggaucuccauccuggaucuggcaaaacaagacgcuaccugccggccauugugcgggaggccaucaagagaaagcuucgcacccugauucucgcucccacacgggucguggccuccgaaauggcggaggcucugaaagggaugccuaucagauaucaaaccacggccguuaagagcgaacacacaggccgcgagauuguggaccugaugugucaugccaccuucaccaugcggcuccuuucccccgucagagugccuaauuacaacaugaucaucauggaugaggcucacuuuacagaccccgccucuauugcugcccggggauauaucagcacccgcgugggcaugggggaagcggccgcuauuuucaugacagccaccccuccgggauccgucgaggcuuuuccccagagcaaugccguuauccaggaugaagagagagacauuccugaacggucuuggaacuccggcuacgauuggaucacggacuuccccgggaaaacagugugguuugugccuagcaucaagucuggaaaugacauugccaacugccugcgcaaaaauggcaagagagucauccagcugagccggaagaccuucgauacagaguaucaaaaaaccaagaacaacgacugggauuacgugguuacgaccgacauuuccgagaugggggcuaauuucagagcggaucgcgugaucgacccccggagaugccucaaaccggucauucugaaggaaggcccugagcgcgugauccuugccggacccaugcccguuacaguggcuucugccgcccagcggagaggccgcauugggcggaaccagaauaaagaaggagaucaguacaucuauaugggccaaccucugaacaaugacgaggaucaugcucacuggaccgaggccaagaugcuccuggacaacaucaauacacccgaagggauuaucccugcgcuguuugagccggaaagagagaagagcgcugccauugauggagaauaccgccucagaggcgaggcccggaaaaccuucgucgagcuuaugcgcagaggggaccugcccguguggcuguccuauaaggucgcuucugaaggcuuucaguacagcgaucggcgcugguguuucgacggagagagaaacaaucaggugcucgaagagaacauggacguugaaaucuggacaaaagagggcgagcggaagaaacugagaccucgcuggcuugaugcccggaccuauuccgacccccuggcgcucagagaauuuaaggaguucgccgcugggcgccggagcgugucuggagaucugauucuggaaaucggcaaacucccucagcaccuuacgcugagagcccaaaaugcucuggacaaccucgugaugcugcauaauuccgagcaggggggaaaggccuaccggcacgcuauggaagagcuucccgauacaaucgagacccugaugcuccuggcccugauugcgguccucaccggcggcguuacacuuuuuuuccugagcgggaagggacugggcaaaaccuccaucgggcuccugugcgugauggccucuagcgcucuucuguggauggccuccguggaaccgcauuggauugcugccucuaucauucucgaguuuuuccugaugguccugcucaucccugaacccgaccgccagagaacaccucaggauaaccaacuugccuaugugguuaucggacugcuguuuaugauucucacgguggcugcgaaugagaugggccugcuugagaccacaaagaaagaccuggggaucggacacgucgccguggaaaaccaccaucacgcuaccaugcucgaugucgaccugcggcccgccagcgccuggacacuguacgcuguggccaccacgguuauuaccccuaugaugcgccauacaaucgagaacaccacagcgaauauuucccucaccgccaucgcuaaccaggccgcuauucuuaugggccuggauaagggcuggcccaucagcaaaauggacaucggggugccgcugcucgcccugggauguuacucucaggucaauccucuuacgcugacagcggccgugcucaugcugguugcucacuaugccauuaucggccccgggcugcaagcuaaggccaccagagaagcucagaagcggacagccgcgggaauuaugaaaaaccccaccguggauggcaucgucaccauugaccucgacccugugguguacgaugccaaguucgagaaacagcuugggcagaucaugcugcugauccucugcacaucccaaauucugcuuaugcgcacgaccugggcucugugugaaagcaucacacucgccaccggaccgcugacaacccugugggagggcucucccggcaaguuuuggaauacgacaauugcuguuuccauggccaacaucuucagagggagcuaucucgccggagcgggccuugcuuucucucugaugaaaagccuggggggaggccggcgcgggaccggagcccagggcgagacccucggcgaaaaguggaagagacagcugaaucagcuuuccaaaucugaguuuaacacauacaagaaaagcgggauuauggaagucgaccgguccgaggcuaaggaaggacugaaaagaggcgagaccacaaagcaugccgugagccgcgggacggccaagcuccggugguucguggagagaaaucuggucaaaccugaaggaaagguuaucgaucugggcugcgggcgcggaggcugguccuauuacugugcuggccucaaaaaggugaccgaggugaaaggguauacaaagggaggccccgggcacgaagagccuauccccauggccaccuacggauggaaccuugucaaacugcacucuggcaaggacguguuuuucacaccuccggaaaagugcgauacccugcucugugacauuggggagagcucccccaauccuacgaucgaggaaggacggacccugagaguucuuaaaaugguggagcccuggcugcgcggcaaccaauuuugcauuaagauccucaauccuuacaugcccucugucguggaaacacuggagcagaugcagcggaaacauggcgggaugcugguuagaaacccgcucagccgcaauuccacccacgagauguauugggugucuuguggaacaggcaacauugucagcgcggugaauaugaccucccggaugcugcuuaacagauucacaauggcccaucgcaagccuaccuacgaacgggauguggaccugggggcuggaacgagacacgucgccguugagcccgaaguggcuaaccucgauaucauuggccagcgcaucgagaauaucaaaaacgaacacaagagcacauggcaucacgacgaggauaaucccuauaagaccugggccuaccaugggucuuaugaggugaaaccuuccggaagcgcgucuuccauggucaacggcgugguuagacugcuuaccaagcccugggacgugauuccuauggucacacaaaucgccaugacggacaccacaccguuuggccagcagcggguguucaaagaaaagguugauacccgcacacccagagcuaaacgggggaccgcccaaauuauggaggugacagcuaaguggcuguggggauuucucagcagaaauaagaaaccucggaucugcacccgcgaagaguucacgagaaagguccggucuaacgccgcuauuggcgccguguuuguugacgaaaaucaguggaacuccgcgaaagaggccguggaggaugaacgcuucugggaccugguccacagagagcgggaacugcauaagcaggggaaaugcgcuaccuguguguacaauaugaugggaaagcgcgagaagaaacucggcgaauuugggaaggccaaaggcagcagagcuaucugguauauguggcugggagcccgguuccuugaguucgaggcccugggcuuuaugaacgaagaucacugguucucccgcgagaauagccucucuggggucgaaggagagggccugcacaagcuuggguacauccugagagacauuagcaaaauccccggaggcaacauguacgcggaugacacagcugggugggauacccggauuacagaggacgaucuccagaaugaagccaagaucaccgacauuauggagccugaacaugcccugcuggcuacguccaucuuuaaacucacauaucaaaacaaggugguucgcgugcagagacccgccaagucuggcaccgucauggaugugaucagccggcgcgaccagagaggauccggccagguggggacauacggacugaauaccuucacgaacauggagguucaacuuauucggcagauggaaucugagggcaucuuuagcccguccgagcuggaaaccccuaaccucgcuaaaaaggugcuggacuggcuugagaaacacggggccgaaagacugaagcgcauggcgauuucuggagaugacugcgucgugaaacccaucgaugaccgguucgccacagcucucaccgcccugaaugauaugggcaagguuagaaaggacauuccucagugggagcccagcaaaggguggaacgauuggcagcaagugccuuuuuguucccaucacuuccaccagcugaucaugaaggacggccgcgaaaucgucgugcccugccggaaucaggaugagcucgucggaagagcucgcgugagccagggcgccggguggucucugcgggagacagcgugucuuggaaaauccuaugcccaaauguggcagcugauguacuuucauagacgcgaccuccggcuggcugccaacgcuauuugcagcgccguuccgguggauugggucccuaccucuagaacaaccugguccauccacgcucaucaccaguggaugacgacagaagacaugcuuagcguguggaaucgcguuuggauugaggaaaaccccuggauggaggacaagacccauguguccucuugggaagagguccccuaucugggcaaacgggaggaucaauggugugggagccucaucggacugaccgccagagcgacaugggccaccaauauucagguggcuaucaaccaggugcggagacugauuggcaaugaaaacuaccucgacuauaugacauccaugaagcgcuucaagaaugagagcgauccugaaggggcccugugguga

SEQ ID NO: 19343 - RNA, 9879 nt, Artificial Sequence
  derived and/or modified CDS sequence (opt5) from DENV-1__KP188547__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcuauucuucggaagcugugcaucgaagccaaaauuucuaauaccacgacagacucccgcuguccgacccaaggagaggcgacccucguggaagagcaggaugccaacuucgugugcagacggacauuugucgaccgcggcuggggcaauggguguggacuguucggcaaggggagccuucugaccugcgcuaaguuuaaaugcgugacaaagcucgagggaaaaaucguucaguacgaaaaccugaaguauucugugaucgucacggugcacaccggcgaucagcaucaaguugggaaugagacaaccgaacacggaacaauugccaccaucacgccccaggcuccuaccuccgagauucagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggccagcacaucccaagagaccuggaaucggcaggaucugcuggugacauucaagaccgcucacgcgaagaaacaggaagucgugguucucggaucucaagagggcgccaugcacaccgcucugacaggggccacggaaauccagaccagcggaacaaccacaauuuuugccggccaucuuaagugccgccugaaaauggacaagcucacccugaaagggauguccuaugugauguguacgggcagcuucaagcuggagaaggaagucgcugagacacagcacggaaccgugcuuguucaggugaaauacgagggcaccgaugccccgugcaagaucccuuuccucacacaagacgaaaaaggggucacccagaacggaagacugaucacagcgaaucccauugugacggauaaggagaaaccugugaacaucgaaaccgagccccccuuuggcgagucuuauauuguugucggggcuggagaaaaggcccugaagcucuccugguucaaaaagggcagcucuaucgggaaaauguuugaggccacagcucggggcgccagacgcauggcuauucugggagacaccgccugggauuucggcagcaucgggggacuuuuuacauccgugggcaagcugauccaucagguguucgggaccgcguacggaguccucuuuucuggcgugagcuggacgaugaaaauugggaucggcauucugcugaccuggcuuggacucaauucccggagcacaucucuguccaugaccuguaucgccguuggcauggugacacuguaccucggggucauggugcaggcugacagcggaugcguuauuaacuggaagggcagagaacugaagugugggucuggaaucuucgugaccaacgagguccacacauggaccgaacaauauaaauuucaggccgauuccccuaagcgccuuagcgcugccauuggcaaagcgugggaggagggggugugcggcauccgguccgccacgagacuggaaaauaucauguggaagcagauuucuaacgagcucaauuacauccugcuggaaaacgacaugaaauucacaguuguggucggagacgugaauggcauucuugcucaggggaagaaaaugaucaagccgcaacccauggagcauaaguauagcuggaaauccuggggaaaggccaaaauuaucggcgcugauauccagaacaccaccuuuauuaucgacgggccugauacacccgaauguccugacgaucagcgcgccuggaauauuugggagguggaggacuacggauucggcaucuuuaccacgaacauuuggcucaagcugcgggauucucacacacagaugugcgaccacagacugaugagcgccgcuaucaaagauuccaaggcgguccaugccgacaugggcuauuggaucgaaagcgagaagaaugaaaccuggaaacucgcucgcgccucuuucauugagguuaagacauguaucuggcccaaaucccacacccuguggagcaacggggugcuugaaucugagauggugauuccgaagaucuacggaggcccuauuucccaacauaauuaucggcccggguacuucacacagaccgccggaccuuggcaccugggcaaacucgagcuggauuuugaccugugcgaagggacgaccgucgugguugaugagcacugcggauacagaggccccagccuucgcacaaccacagugaccggcaagaucauccaugaaugguguugccggucuuguacgcucccuccccugagauuccggggggaggacggaugcugguauggcauggagauucgcccggucaaggaaaaagaggaaaaccuggugagaagcaugguuuccgcugggagcggagagguggacucuuuuucccucggcauccugugugucagcauucuuaucgaagaggugaugcgguccagauggucucgcaagaugcugaugacagggacccucgccguuuuccugcugcuuauuaugggacagcugacauggaaugaucucauccggcugugcauuauggugggcgcgaacgcucucgacagaaugggcauggggaccaccuaccuggcccuuauggccacauuuaaaaugcgcccuauguucgcugucggacugcucuuuagacggcugacgagccgcgaggugcugcuucugaccgugggccucucccuggucgccucuguugaacuccccagcucccuggaggaacuuggggauggacuggcgaugggcaucaugaugcucaagcugcugacagacuuccaaccccaccagcuuuggaccacacugcucucucugaccuuuaucagaacgagccucucccuggauuaugcuuggaaaacaauggccauggcccuuagcauugugucucuguucccucugugucucuccaccaccagccagaagacaaccuggcugccggugcuucuggggucuuuuggaugcaagccccucacaauguuccugaucacggagaauaaaauuuggggccggaaguccuggccuaucaacgaaggcauuauggcugucgggaucgugagcauccuccugucuucccuucugaaaaacgacguuccccuggccggaccucucauugcuggcgggaugcugaucgccuguuacgugauuagcggauccagcgcggaucuuucucuggagaaggccgcugaggucagcugggaagaggaagccgagcauuccggcaccucucacaauauccucguggaaguucaggacgaugggacaaugaaaauuaaggacgaggagcgcgaugacacccugacaauccuccugaaagcuacccuucuggccgugagcggagucuaucccauguccaucccugccacgcuguuugugugguacuucuggcaaaagaagaaacagagaucuggcguccucugggauacccccagcccgccugaaguggagcgggcuguucuggacgacggcauuuaucgcauccuucagagagggcugcucggacggucccaggugggcgucgggguguuccaagauggaguuuuucauacaauguggcacgugacccgcggcgcgguccugauguaccaggggaagagacucgaacccucuugggccagcgugaaaaaggaccugauuuccuacggaggcggcuggcgguuccaggggagcuggaacacaggagaggaggugcagguuaucgcugucgaaccuggcaaaaaucccaagaacgugcaaaccacaccggggacguuuaagaccccugagggagaagugggcgccauugcccuugauuucaaacccgggacaucuggauccccuaucgucaauagagagggcaagauugugggccuguaugggaacggaguugugaccaccagcggcacauacgucucugcuaucgcccaggcgaaagcuacgcaggaagggacccugcccgagaucgaggacgaaguguuuaagaaacgcaaucucacaauuauggaucugcaccccggauccggcaagacccggagauaucuuccugccaucguucgcgaggccauuaagcggaaacugagaacacucauccuggcuccgacccgcguggucgccagcgaaauggcggaggcucugaaggggaugcccauucgguaccaaacgacagccgugaaauccgaacauaccggcagagagaucguugaccucaugugccacgccaccuucacaaugcgccuucugucuccugugcggguccccaacuauaauaugaucauuauggaugaggcucauuuuaccgacccugccagcaucgcugccagaggauacauuuccacacgggugggcaugggggaagcggccgcuaucuucaugaccgccacgcccccuggaagcguggaggcuuuuccgcagucuaacgccgucauucaggaugaagagcgcgacauccccgaaagauccuggaauagcggcuaugauuggaucacagacuucccugggaagaccguuugguuugugcccucuauuaaaagcggaaacgacaucgccaauugucugcggaagaacggcaagcgcgugauucagcucuccagaaaaacauucgauaccgaguaccaaaagacgaaaaauaacgacugggauuacgucgugaccacagacaucucugagaugggggcuaacuuccgggcggauagaguuauugacccucgccggugccugaagcccgugauccuuaaagaaggcccggagagagucauucuggccggaccuaugcccgugaccguugcuagcgccgcccagcgccggggcagaaucgggcgcaaucagaacaaggaaggagaucaguauaucuacaugggccaaccccucaauaacgacgaggaucacgcucauuggacagaggccaagaugcugcuggacaauauuaacaccccugaagggaucauucccgcgcucuuugagccugaacgggagaaauccgcugccaucgauggagaauauagacuucgcggcgaggccagaaagacauucguggagcugaugcggcgcggggaccugccggucuggcucucuuacaaaguggcuagcgaaggcuuucaguauuccgauagacgguggugcuucgacggagagcgcaauaaccagguccuggaagagaauauggacguggaaauuuggaccaaggagggcgagagaaaaaagcuucggcccagauggcuggaugcccgcacguacagcgacccucucgcgcugcgggaauuuaaagaguucgccgcugggagacgcucuguuuccggagaucugauccucgaaaucggcaagcuuccccagcaccugacacugcgggcccaaaacgcucucgacaaucuggugaugcuucacaacagcgagcaggggggaaaggccuauagacaugcuauggaagagcugccugauaccauugagacccucaugcugcuggcccucaucgcggugcuuacaggcggcgucacccuguuuuuccuguccgggaaaggacucggcaagacaucuauugggcugcuuuguguuauggccagcuccgcucugcucuggauggccucuguggaaccccacuggaucgcugccagcauuauccuggaguuuuuccugauggugcuccuuaucccggaaccugaccggcagcgcacgccccaggauaaucaacuggccuacgucgugauuggacugcucuuuaugauccugaccguugcugcgaacgagaugggccuucuggagacaaccaaaaaggaccucgggauuggacauguggccgucgaaaaucaccaccaugcuacaaugcuggauguggaccugagaccugccuccgccuggacccucuacgcugucgccacgaccgugaucacacccaugaugcggcacaccauugagaacacaaccgcgaacaucagccuuacggccauugcuaaucaggccgcuauccugaugggccuggauaaaggcuggccuaucucuaagauggacauugggguuccccuccuggcccuuggaugcuauucccaggugaacccgcugacacucaccgcggccguccugaugcugguggcucauuacgccaucauuggcccugggcuccaagcuaaggccacacgcgaagcucagaaaagaaccgccgcgggaaucaugaagaaucccaccguugauggcauugugacaaucgaccuugaccccgucguguaugaugccaaauucgagaagcagcuggggcagaucaugcugcucauucuguguacgagccaaauccuucugaugcggaccacaugggcucucugcgaaucuauuacccuggccacaggaccucugaccacgcucugggagggcuccccgggcaaauuuuggaacacaaccaucgcugugagcauggccaauauuuuccgcgggucuuaccuugccggagcgggccuggcuuucagccugaugaagucccucgggggaggcagacgggggaccggagcccagggcgagacacugggcgaaaaguggaaacgccagcuuaaccagcugucuaagagcgaguuuaauaccuauaaaaaguccgggaucauggaaguugacagaagcgaggcuaaagaaggacucaagcggggcgagacaacgaagcacgccgucuccagagggaccgccaaacugcgcugguucguggagcggaaccuggugaagcccgaaggaaaagucaucgaucucggcugugggagaggaggcuggucuuacuauugcgcuggccuuaagaaaguuacagaggugaagggguacaccaaaggaggcccugggcaugaagagcccauuccuauggccacauacggauggaaucuggugaagcugcacagcggcaaggacgucuuuuucacccccccugaaaaaugugauacgcuccugugcgacaucggggaguccucuccgaaccccaccauugaggaaggacgcacacuucgggugcugaagaugguugagccuuggcucagaggcaaucaauuuuguaucaaaauucugaaccccuauaugccuagcguggucgaaacccuggagcagaugcagcgcaagcacggcgggaugcucgugcggaauccccuguccagaaacucuacacaugagauguacuggguuagcugcggaaccggcaauaucguguccgcggucaacaugacaagccgcaugcuucugaaucgguucaccauggcccacagaaaaccgacguaugaacgcgauguggaccucggggcuggaacacggcauguggccgucgagccugaaguugcuaaccuggauauuaucggccagagaaucgagaacauuaagaaugaacacaagucuaccuggcacuacgacgaggauaaccccuauaaaaccugggccuaccauggguccuaugaggugaagcccagcggaucugcguccagcauggugaauggcgucgugcgccuucugacaaaaccuugggacguuauccccauggugacgcaaauugccaugaccgacacaaccccuuuuggccagcagagagucuucaaggaaaaaguggauacacggaccccgcgcgcuaagagagggacagcccaaaucauggagguuaccgcuaaguggcucuggggauuucugucucggaacaaaaagcccagaauuuguacgcgggaagaguucacccgcaaagugagauccaaugccgcuaucggcgccgucuuuguggacgaaaaccaguggaauagcgcgaaggaggccguugaggaugaacgguucugggaccuggugcaccgcgagagagaacuccauaaacaggggaagugcgcuacaugcgucuacaacaugaugggaaagcgggagaaaaagcugggcgaauuugggaaagccaagggcucccgcgcuaucugguacauguggcuuggagccagauuccuggaguucgaggcccucggcuuuaugaaugaagaucacugguucagccgggagaacucucugagcgggguggaaggagagggccuucauaaacugggguauauucuccgcgacaucuccaagauuccuggaggcaauauguacgcggaugacaccgcugggugggauacaagaaucaccgaggacgaucugcagaacgaagccaaaauuacggacaucauggagcccgaacacgcccugcucgcuacaucuaucuuuaagcugaccuaucaaaauaaggucgugcggguucagcgcccugccaaaagcggcacagugauggaugucauuuccagacgggaccagcgcggaucuggccagguggggaccuacggacuuaacacguucaccaauauggaggugcaacugaucagacagauggaaagcgagggcauuuuuucccccucugagcucgaaacaccgaaccuggcuaagaaaguucuugacuggcuggagaagcacggggccgaacggcucaaaagaauggcgaucagcggagaugacuguguggucaagccuauugaugaccgcuucgccaccgcucugacagcccugaacgauaugggcaaggugcggaaagacaucccccagugggagccuuccaagggguggaaugauuggcagcaaguucccuuuugcagccaucacuuccaucagcucaucaugaaagacggcagagaaauuguggucccuugucgcaaccaggaugagcuggugggacgggcuagagucucucagggcgccggguggucccuucgcgagaccgcgugccugggaaagagcuaugcccaaauguggcagcucauguacuuucaccggagagaccugcgccuugcugccaaugcuaucuguucugccgugcccguugauugggugccgacaucccggaccacguggagcauucacgcucaucaccaguggaugacaaccgaagacaugcuguccgucuggaacagaguguggaucgaggaaaauccuuggauggaggacaaaacccauguuucuagcugggaagaggugcccuaucucggcaagcgcgaggaucaauggugcgggucccugauuggacugacagcccgggcgaccugggccacaaacauccaggucgcuauuaaucaggugagacggcucaucggcaacgaaaauuaccuggacuacaugacgagcaugaagagauucaaaaacgagucugaucccgaaggggcccuuugguga

SEQ ID NO: 19344 - RNA, 9879 nt, Artificial Sequence
  derived and/or modified CDS sequence (opt5) from DENV-1__KP723473__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagugugauucccgcuggcuggacgcgcggacguauagcgauccccucgcccugagagaguuuaaagaguucgcugccgggcgccgguccgugucuggagaccuuauccuggagauuggcaagcucccucagcaccugacacugagagcucaaaaugcccucgauaaccuugugaugcugcacaauagcgaacaagggggaaaggcuuaccggcaugccauggaggaacugcccgacaccaucgagacccucaugcugcuugcgcugaucgccguccucacaggcggcguuacccuguuuuuccuguccgggaagggacucggcaagacaucuauugggcuucugugcgugauggcuagcuccgugcugcucuggauggccagcgucgagccucacuggaucgcugccucuauuauccuggaauuuuuccuuauggugcugcucauucccgagccggaucgccagagaacgccucaggacaaccaacuggccuauguugugaucggacugcucuuuaugauccuuaccgucgcugcgaacgaaaugggccugcuggagacaaccaaaaaggaucucgggauuggacauguggucgccgagaaucaccaccaugcuacaaugcuggacaucgaucuucaccccgccuccgccuggacccuguacgcuguggccacgaccauuaucacaccuaugaugcggcauaccauugaaaacacaaccgcgaauaucagccucacggccauugcuaaccaggccgcuauccugaugggccuggacaaaggcuggcccaucucuaagauggauauugggguuccucuccuugcccugggauguuacucccaggugaauccccugacacucaccgcggccguccugaugcuuguggcucacuaugccaucauuggcccggggcugcaagcuaaagccacacgcgaggcucagaagagaaccgccgcgggaaucaugaagaacccuaccguugacggcauuguggccaucgaccucgaucccgucguguacgacgcuaaauucgaaaagcagcuggggcagaucaugcugcucauucuuugcacaagccaaauccugcugaugcggacgaccugggcccucugugagucuauuacacuggcuaccggaccccuuacaacccugugggaaggcagcccuggcaaauuuuggaauacgacaaucgccguguccauggccaacauuuuccgcgggucuuaucucgcgggagcuggccuggccuucagccugaugaagucccucgggggaggcagacgggggaccggagcucagggcgagacccuuggcgagaaauggaagcgccagcugaaucagcugagcaaguccgaauuuaacacauacaaaagaucugggaucauggagguugaucggagcgaagccaaggagggacucaaaagaggcgaaaccacaaagcaugccgucucccgcgggacggcuaaacugcggugguucguggagagaaaucuugugaagccggagggaaaggucaucgaccugggcugcgggcgcggaggcuggucuuauuacugugccggccucaaaaagguuaccgaagugaaaggguauacaaagggaggccccgggcacgaggaaccuauucccauggcgaccuacggauggaacaucgugaaacugcacagcggccgggaugucuuuuucacaccucccgagaagugcgacacccugcucugugauauuggggaauccucuccuaauccgacgaucgaggagggaagaacccuucgcgugcugaaaaugguugaacccuggcugcggggcauucaauuuugcaucaagauucucaacccuuacaugcccagcguggucgagacacuggaacagaugcagagaaagcauggcgggaugcuugugcgcaauccucugucccggaacagcacccacgagauguauuggguuucuuguggaacaggcaauaucguguccgccgucaacaugaccagcagaaugcuccugaaccgcuucacaauggcucaucggaaacccaccuacgagagagacguggaucugggggccggaacgcgccacguggcugucgaaccggagaucgccaaucucgacauuaucggccagagaauugaaaacaucaagaaugagcacaaaucuacauggcauuaugaugaagacaacccuuacaagaccugggcguaucacggguccuacgagguuaaacccagcggaaccgccucuuccauggugaauggcgugguccggcugcuuacaaagcccugggacgugauuccuaugguuacgcaaaucgcuaugaccgauacaacccccuuuggccagcagcgcguguucaaggagaaagucgacacaagaaccccucggccgaagagagggacagcccaaaucauggaagugaccgcuaaauggcuguggggauuucucagccggaacaagaaaccccgcauuugcacgagagaggaguucacccggaagguucgcuccaaugccgcuaucggcgccguguuugucgaugagaaccaguggaauagcgcgaaggaagccguggaggacgagagauucugggaucugguucaucgggaacgcgagcuucacaaacaggggaagugcgcuacauguguguauaacaugaugggaaaaagagaaaagaaacugggcgaguuugggaaggccaagggcucucgggcuauuugguacauguggcucggagcccgcuuccuggaguucgaggcccugggcuuuaugaaugaggaccauugguucagcagagaaaacucccucucuggggucgagggagaaggccugcacaaacuuggguacauccugcgggauauuagcaagaucccuggaggcaauauguaugcggacgauaccgcugggugggacacacgcaucaccgaggaugaccuccagaacgaggccaaaauuacggauaucauggaacccgagcacgcccugcuugcuacauccauuuuuaagcugaccuaccaaaauaaaguggucagagugcagcggccugccaagucuggcacaguuauggacgugaucagccgcagagaccagcggggauccggccaggucgggaccuauggacucaacacguucaccaacauggaagugcaacugauuagacagauggagucugaaggcaucuuuagccccuccgagcuggagaauagcaaccucgcugaacgcgugcuggauuggcuugagaaacaugggguugaacggcugaagagaauggccaucucuggagacgauugcguggucaagccgacagacgaucgcuucgcgaccgcccucacagcucugaaugacaugggcaaagugcggaaggauauuccucagugggagcccuccaaaggguggaacgacuggcagcaaguuccuuuuuguagccaccauuuccaccagcuuaucaugaaggauggcagagaaauugugguccccugccgcaaucaggacgagcuggugggacgggccagagucucucagggcgcuggguggucccuccgcgagaccgccugucugggaaaaagcuacgcgcaaauguggcagcugauguauuuucaccggagagaucuccgccuggccgcuaacgccaucugcuccgcugugccuguuaauugggugcccacaucucggaccacguggagcauucaugcccaccaucaguggaugacaaccgaagacaugcuuuccgucuggaacagaguguggaucgaggaaaauccguggauggaggacaagacccacguuagcucuugggaagaugugccuuaccugggcaagcgggaggaccaauggugugggucccucauuggacugacagcuagagccaccugggcgacaaacauccaggucgccaucaaucaggugcgccggcuuauuggcaacgagaauuaucuggauuacaugacgagcaugaaaagauucaagaacgaaucugaccccgagggggcucucugguga

SEQ ID NO: 19345 - RNA, 9879 nt, Artificial Sequence
  derived and/or modified CDS sequence (opt5) from DENV-1__KT187564__SS-prME
agcgugaccaugcugcucaugcugaugcccacagcucuugcuuuccaccugacgaccagaggaggggagccucauaugaugguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauccagcggguugaaacaugggcucugcgccaccccggcuucaccgugauugcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugaucacaugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggggaaauccuggcugguccauaagcagugguuucucgaucugccucuucccuggacaagcggagcuuccaccucucaagagacauggaaucgccaggaccugcucgugaccuucaaaaccgcgcacgccaagaagcaggaggucgugguucugggcagccaagaaggggcuaugcacacagcccugacgggagccaccgagauccagacauccggcaccacaaccauuuuugcugggcaucucaaaugcagacugaagauggauaaacuuacgcugaagggcaugagcuaugugauguguacaggaucuuucaaacucgaaaaggaggucgccgaaacccagcacggcaccgugcugguucagaucaaguacgaggggacagacgcgccgugcaaaauuccuuucuccacccaagaugagaagggagugacacagaacggccggcugaucacggcuaaucccaucgucaccgacaaagaaaagccugugaacauugaggccgaaccgcccuuuggggagagcuauaucgugauuggagccggcgagaaagcucuuaagcucucuugguucaagaaagggagcuccaucggcaagauguuugaagccacagcuagaggagcccgccggauggcgauucugggcgauaccgccugggacuucgggucuaucggaggcguuuuuacaagcgucgggaaacuggugcaucagaucuucggaaccgcuuacggcgugcucuuuuccggggucagcuggacgaugaagauuggcaucggagugcugcuuaccuggcugggccucaauucuagauccacaagccugucuaugaccuguauugccguugggcuggugacacuuuaccucggagucauggugcaggcugauuccggcugcguuaucaacuggaaagggcgcgagcugaaguguggaagcggcauuuucgugaccaaugaaguccacacauggaccgagcaauauaaguuucaggccgacuccccuaaacggcugucugcggccaucgggaaggcuugggaagagggcgugugcggaauuagaagcgccacgcgccucgagaacaucauguggaaacagaucuccaacgaacugaaucauauucuucuggagaacgacaugaaguucacaguuguggucggcgauguggcugggauccucgcccagggcaagaagaugauucggccgcaacccauggaauacaaauauucuuggaaaagcuggggcaaggccaaaaucauuggggcugacgugcagaauaccaccuuuaucaucgauggaccuaacacacccgaguguccugacgaucagagagcguggaauauuugggaagucgaggacuacggcuucggcaucuuuaccacgaacauuuggcugaagcugcgcgauuccuauacacagguuugcgaccaccggcuuaugagcgccgcuaucaaagauucuaaggccgugcacgccgacaugggguacuggauugaguccgaaaagaaugagaccuggaagcucgcuagagccagcuucaucgaagugaagacauguaucuggcccaaaucucauacccugugguccaacggaguccuggagagcgaaaugauuaucccgaagauuuauggcgggccuaucucucaacacaauuaccgccccggauacuucacacagaccgcgggcccuuggcaucucgggaaacuggagcuugauuuugaccugugcgagggaacgaccgugguuguggaugaacacugcggcaaccggggccccagccucagaacaaccacagucaccgggaagauuauccacgagugguguugccgguccuguacgcugccuccccugcgcuucagaggagaagacggcugcugguaugggauggagauccggccggugaaagagaaggaagagaaucuuguuaagagcauggugucugcuggauccggcgaagucgacagcuuuucccucgggcugcuguguauuucuaucaugauugaggaagugaugagaagccgcuggucccggaaaaugcucaugaucggaacacuggccguuuucuuucuucugauuaugggccagcucaccuggaacgaucugaucagacugugcauuauggugggcgccaaugcuucugaccgcauggggaugggaacaaccuaccuugcccugauggcgaccuucaagaugagaccuauguuugcugucggccuccuguuccggcgccucacaagcagagaggugcugcuucugacgaucgggcucucccugguggccucugccgagcugcccaacagccuugaagaacugggagauggccucgcuauggggaucaugauucugaaacuccugaccgacuuucaaucccaucagcuuugggccacacugcucagccugaccuucaucaagacaaccuuuucucugcacuaugcuuggaaaacgauggccaugguccuuuccauuguuagccuguucccccucugucugucuacaaccucccagaagaccacauggcucccugugcugcuuggaagccugggcugcaagccgcugaccauguuucucaucgcggaaaauaaaauuuggggccggaagucuuggccccugaacgaggggaucauggccgugggaaucgucuccauucuucugagcucccuccugaaaaacgaugugccucucgcuggcccccugaucgccgggggaaugcuuauugcuuguuacguuaucagcggcucuagcgccgaccugucccuggaaaaggccgcugaggugucuugggaggaagaggcggaacauagcggggccucccacaauauucucgucgaggugcaggaugacggaacaaugaaaaucaaggaugaagaaagagacgauacgcugaccauccuucugaaagcuacacuccuggccguuucuggcguguucccucucagcauucccgccacccuguucgucugguauuuuuggcaaaagaagaaacagagauccggcgugcuuugggacacaccuucucccccggaggucgaacgggcugugcuggaugacgggaucuaccgcauuaugcagagaggacugcucggccggagccagguuggggugggagucuuccaagagaacguguuucauaccauguggcacguuacgcgcggcgccgugcugauguaucaggggaagagacuugaaccuuccugggcgagcgucaaaaaggaccugaucucuuacggaggcggcuggcggcuccagggguccuggaauaccggagaggagguccaggugauugcuguugaacccggcaaaaacccuaagaauguccaaacagcccccgggaccuucaagacaccggagggagaagugggcgccaucgcucuggauuuuaaaccugggaccagcggaucucccauugugaacagagagggcaagaucgucggccucuacgggaauggagugguuacaacguccggcaccuaugugagcgccaucgcgcaggcuaaagccucccaggaagggccucugcccgagauugaggacgaagucuuccgcaagcggaaccuuacaaucauggaucugcaccccggaucuggcaaaaccagacgcuaccugccugccauugugcgggaggcuaucaagagaaagcuccgcacccugauucuugccccgacacggguuguggcuagcgaaauggccgaggcgcugaaagggaugcccaucagauaucaaacgaccgccgucaaguccgaacauacaggcaaagagaucguggaccucaugugccacgcuaccuuuacaaugcgccugcugagcccuguucgggugcccaauuacaacaugauuaucauggaugaggcccauuucaccgacccuucuuccauugcugccagaggauauaucagcacgcgggucggcaugggggaagccgcugcgauuuuuaugacagccacacccccuggaucuguggaggcuuucccgcagagcaaugccgugauccaggaugaggaacgcgacauccccgaaagauccuggaacucuggcuacgaguggauuaccgauuuuccugggaagacagucugguucguucccagcaucaaauccggaaaugacauugccaacugucuccggaagaauggcaagcgcgugauccagcuuucuagaaaaaccuucgauacagaguaucaaaagaccaaaaacaacgacugggacuacguggucacgacagauauuagcgaaaugggggcuaauuuucgggccgacagagugaucgauccucgccggugccugaagcccguuauucugaaagacggcccggagagagugauccucgcgggaccuaugcccgucaccguggcuuccgccgcccagcgccggggcagaaucgggcgcaaccacaauaaggaaggagaucaguacauuuauaugggccagccccugaacaaugacgaggaucaugcucacuggacagaggccaagaugcuucuggacaacaucaauaccccugaagggauuauccccgcccuguucgagccugaacgggagaaaagcgccgcuauugauggagaauacagacugcgcggcgaggccagaaagacguuuguugagcugaugcggcgcggggaccucccgguguggcuuucuuauaaagucgcuuccgaaggcuuccaauacagcgauagacgguggugcuuugacggagagcgcaacaaucaggugcuggaagagaacauggaugucgaaaucuggaccaaggagggcgagcgcaagaagcugcggcccagauggcucgacgcccgcacauauuccgacccucuggcccuucgggaguucaaagaguuugccgcggggagacgcucugugagcggagaucugauccucgaaauuggcaagcugccccagcaccugacccagcgggcccaaaaugcucucgacaaccuuguuaugcugcauaauuccgagcaagggggcagagcguaccggcacgcuauggaggaacugccugauacaaucgagacccucaugcugcuugcccugauugccgugcucacaggaggcgugacccuguucuuucugucugggcgcggacucggcaagacgagcaucgggcuucugugugucauggcuuccagcguucugcucuggauggcgucuguggaaccccauuggauugccgcuuccaucauccuggaguucuuucuuauggugcugcucauuccggaaccugacagacagcggacaccccaggauaaccaacuggccuaugucgugaucggacuccucuucaugauucuuaccguugccgcuaaugagaugggccugcuggagaccaccaaaaaggaccucgggaucggacacguggccgucgaaaaccaccaucacgcggccaugcuggauguggaccuucauccugcuagcgccuggacccuguacgcugucgccacaacgauuaucacccccaugaugcgccacacaauugagaacaccacagcgaauaucucucucaccgccaucgcuaaccaggccgcuauucugaugggccuggauaaaggcuggccuaucuccaagauggacauuggggugccccuccuugcccugggaugcuacagccagguuaauccgcugacgcucaccgcugccgugcugaugcuugucgcgcauuaugccaucauuggcccugggcugcaagcuaaagccacaagagaagcucagaagcggaccgccgccggaaucaugaagaaccccacaguggauggcaucguugcgauugaccucgaucccguggucuacgacgcuaaauuugagaagcagcuggggcagaucaugcugcucauucuuuguaccucucaaauccugcugaugcgcacgacaugggcccucugcgaaagcauuacccuggcuacaggaccucuuaccacccugugggagggcuccccgggcaaauucuggaauacaacgaucgccgugucuauggccaacaucuucagagggagcuaucucgcuggagccggccuggcguuuucccugaugaaaagccucgggggaggccggcgcgggaccggagcccagggcgagacacuuggcgaaaaauggaagagacggcugaaucagcuguccaagucugaguucaacaccuacaaaagaagcgggauuauggaaguggaccgcuccgaggcuaaggaaggacucaaacggggcgagacaaccaagcacgccguuucuagagggacggcuaaacugcgcugguuugucgagcggaaucuugugaagcccgaaggaaaggugaucgaucugggcugugggagaggaggcuggagcuauuacugcgccggccucaaaaaggucacagagguuaaaggguauaccaagggaggcccugggcacgaggagcccauuccuauggcgaccuacggauggaaccuggugaaacugcauuccggcaaggacguguucuuuauucccccugaaaaaugugauacacuccuuugcgacauuggggagucuagcccgaaucccaccaucgaggaaggacgcacacugcggguccugaagaugguggagccuuggcucagaggcaaccaguucuguauuaagauccugaaucccuacaugccuuccguuguggaaacgcuugagcaaaugcagcgcaaacacggcgggaugcugguccggaacccccucagcagaaauucuacccaugagauguauuggguguccugcggaacaggcaacaucguuagcgccgugaauaugaccucucgcaugcugcugaaccgguuuacaauggcucacagaaagccgaccuacgaacgcgaugucgaccucggggccggaacgagacacguggcuguggagccugaagucgccaaccuggauauuaucggccagcggauugagaauaucaaacaugaacacaaguccaccuggcauuaugacgaggauaaccccuacaaaacaugggcuuaucacgggagcuacgagguuaagcccucuggauccgccagcuccauggugaauggcguggucaaacuucugaccaaaccuugggacgugauucccaugguuacacagaucgcgaugaccgauacaaccccuuucggccaacagcgcguguuuaaggaaaaagucgacacgagaacaccgaaggccaaacgggggaccgcucagaucauggaggugaccgccagauggcucuggggauuccugagccggaacaagaagccccgcauuuguacaagagaagaguuuacgcggaaaguucgcucuaaugcugccaucggcgccguguucauugacgaaaaccaauggaauagcgcgaaggaggcugucgaggaugaaagauuuugggaccuugugcaucgggagcgcgaacugcacaaacaggggaagugcgcuaccugcguuuauaacaugaugggaaaaagagagaagaagcucggcgaguucgggaaagccaagggcucccgggcuaucugguacauguggcugggagcccgcuuccuggaguuugaggcucucggcuucaugaaugaagaucacugguuuucuagagagaacagccuguccgggguggaaggagagggccuucauaaacugggguacauucuccgggacaucucuaagaucccuggaggcaauauguaugccgaugacacagcggggugggauacccgcauuacagaggacgaucugcagaacgaagccaaaaucaccgacauuauggagcccgaacacgcccuucuggccaaggcuaucuucaaacucacauaccagaauaaggucgugagaguccaacggccugccaagaacggcaccgugauggauguuauuagccgcagagaccagcggggauccggccagguggggacguauggacugaauaccuuuacaaacauggaggcgcagcugaucagacaaauggaaucugagggcaucuucagccccuccgagcucgaaaccccgaaccuggccgagcgcguccuugauuggcuggggaaauacggaguggaacggcucaagagaauggcuauuagcggcgacgacugugugguuaaaccuaucgaugaccgcuuugccacagcucugaccgcccuuaaugauauggggaaggugcggaaagacauuccccagugggagccuucuaagggcuggaacgauuggcagcagguccccuucugcucccaucacuuucaccaacugaucaugaaggacggaagagaaauugugguuccuugucgcaaucaggaugagcucgugggccgggcuagagucagccagggggccggauggucucugcgcgagacggcgugccugggcaaauccuaugcccagauguggcaacucauguacuuccaucggagagaccugcgccuugcugccaacgccaucuguagcgcugugcccgucgauugggugccgacaucccggaccacauggucuauucacgcccaucaccaguggaugaccacggaagacaugcugagcguuuggaauagaguguggaucgaggaaaacccuuggauggaggauaagacccauaucuccaauugggaagacguccccuaucucgggaaacgggaggaccaguggugcggaagccugauuggccuuacagcgagagcuaccugggccacaaacauccaaguggccauuaaucagguucgccggcugaucgggaacgagaauuaccucgauuacaugaccucuaugaagagauuuaaaaacgaauccgaccccgagggcgcucugugguga

SEQ ID NO: 19346 - RNA, 9879 nt, Artificial Sequence
  derived and/or modified CDS sequence (opt5) from DENV-1__KT187560__SS-prME
agcgugaccaugcugcugaugcugcuucccacagcccuggcuuuccaccucacgacccggggcggggagccucauaugaucgucuccaagcaggaacggggaaagucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcuggggucccucggaugcaaaccgcugacaauguuucuuauuaccgagaauaagaucuggggcagaaagagcuggccccugaacgaaggcauuauggccguugggaucgugucuauucuccuguccagccuccugaaaaaugaugucccucuugcuggaccccugaucgccggcgggaugcugaucgcuuguuaugugauuuccggaagcucugccgaccucagccuggagcgggcggccgagguuuccugggaagaggaagcugagcauucuggcgccagccacaacauccuuguggaaguccaggaugacgggacaaugaagauuaaagaugaggagcgcgacgauacccugacgauccuccugaaggcuacccuccuggccguguccggagucuacccuaugucuauucccgccacacuuuucgugugguauuuuuggcagaagaagaaacagagaagcggcguucugugggacaccccuagcccucccgaaguggagcgggcuguccuggaugacggcaucuaccgcauccuccagagagggcugcuuggacggucucaggugggcguugggguguuccaagacggagucuuccauacaauguggcacgugaccagaggcgcggugcugauguaucaggggaaacgccucgaacccagcugggccuccguuaagaaagaucugauuagcuacggaggcggcuggcgguuucaggggucuuggaauacaggagaggagguccaggugaucgcuguggaacccggcaagaacccuaaaaauguccaaacgacccccgggacauucaagaccccggagggagaagugggcgccauugcccucgacuuuaaaccugggaccuccggaagccccaucguuaacagagagggcaagauugugggccuguacgggaauggagucgugacaacgucuggcaccuauguuuccgcuaucgcccaggcgaaggcuagccaggaagggccucuucccgagauugaggaugaaguguucaaaaagcgcaaccugacaaucauggaccugcaccccggauccggcaaaacccggagauaccucccugccaucguccgcgaggccauuaagcggaaacugagaacacuuauccuggcuccgacccgcgugguugccucugaaauggcggaggcucucaaggggaugcccauucgguaucaaacgacagccgugaaguccgaacauaccggcaaagagaucgucgaucugaugugccacgccaccuuuacaaugagacugcucuccccugugcgggugcccaauuacaacaugauuaucauggacgaggcucauuucaccgauccugccagcaucgcugcccgcggauauauuucuacaagagucggcaugggggaagcggccgcuaucuuuaugaccgccacgcccccuggauccguugaggcuuucccgcagagcaaugccgugauucaggacgaagaacgggauauccccgaacgcucuuggaacagcggcuacgacuggauuacagauuuuccugggaagaccgugugguucguccccuccaucaaaucuggaaaugacaucgccaacugucuuagaaagaacggcaaacgggugauucagcugagcagaaagacauuugacaccgaguaucaaaagacgaaaaauaacgauugggacuacguugugaccacagauaucuccgagaugggggcuaauuuccgcgcggaccgggucauugauccuagacgcugccugaagcccgugauccucaaagacggcccggaacggguuauucuggccggaccuaugcccgugaccgcugccucugccgcucagagacgcggccggaucgggagaaaccagaauaaggagggagaucaguacauuuauaugggccaaccccuuaacaaugacgaagaucacgcccauuggacagaggcgaaaaugcugcucgacaacaucaauaccccugaggggaucauucccgcucuguucgaaccugagcgcgaaaagagcgccgccaucgauggagaguacagacugcggggcgaagcucgcaagacauuugucgagcucaugagaagaggggaccuuccgguguggcuguccuauaaagucgccagcgagggcuuccaguacucugaucgcagauggugcuuugacggagaacggaacaaucaggugcuggaggaaaacauggacguugagauuuggaccaaggaaggcgagcgcaagaagcuccgcccccgguggcuggaugcgagaacguauuccgacccucuugcccugcgcgaguucaaagaauuugcugccgggcggagaagcguguccggagaucucauccuggagauuggcaagcugccccagcaccucacacuucgggcucaaaaugcccuggacaaccuggugaugcuccacaauucugaacaagggggaaaggcuuaccgccaugccauggaggaacugccugauaccaucgagacccuuaugcugcucgcgcugaucgccguccugacaggcggcguuacccucuucuuucuuagcgggaagggacugggcaagacauccauugggcugcucugugugauggcuucuagcgugcugcuuuggauggccuccgucgagccccacuggaucgcugccagcauuauccuggaguucuuucucauggugcugcugauuccggagccugacagacagcggacgccccaggauaaccaacucgccuauguugugaucggacuucuguucaugauccugaccgucgcugcgaacgaaaugggccuccuggagacaaccaaaaaggaccuugggauuggacauguggucgccgagaaucaccaccaugcuacaaugcuggauaucgaccuccacccugccucugccuggacccuguacgcuguggccacgaccauuaucacacccaugaugcgccauaccauugaaaacacaaccgcgaauaucucccugacggccauugcuaaccaggccgcuauccucaugggccuugauaaaggcuggccuaucagcaagauggacauugggguuccccugcuggcccucggaugcuacucucaggugaauccgcugacacuuaccgcggccguccugaugcucguggcucacuaugccaucauuggcccugggcugcaagcuaaagccacaagagaggcucagaagcggaccgccgcgggaaucaugaagaaccccaccguugauggcauuguggccaucgaccuggaccccgucguguacgaugcuaaauuugaaaagcagcucgggcagaucaugcuucugauucuguguacaucccaaauccuccugaugcgcacgaccugggcccuuugcgagagcauuacacuggcuaccggaccucucacaacccugugggaaggcucuccgggcaaauucuggaauacgacaaucgccgugagcauggccaacauuuuuagaggguccuaucuggcgggagcuggccucgccuucucucuuaugaaaagccucgggggaggccggcgcgggaccggagcucagggcgagacccugggcgagaaauggaagagacagcucaaucagcuguccaagagcgaguucaacacauacaaacgguccgggaucauggagguugacagaucugaagccaaggagggacuuaaacgcggcgaaaccacaaagcaugccgucagccgggggacggcuaaacugagaugguuuguggagcgcaaucucgugaagcccgagggaaaggucaucgaucugggcugugggcggggaggcugguccuauuacugcgccggccugaaaaagguuaccgaagugaaaggguauacaaagggaggcccugggcacgaggaacccauuccuauggcgaccuacggauggaacaucgugaaacuccacucuggcagagacgucuucuuuacacccccugagaagugugauacccuucugugcgacauuggggaaagcuccccgaaucccacgaucgaggagggacgcacccugcgggugcucaaaaugguugaaccuuggcugagaggcaaccaauucuguauuaagauccuuaaucccuacaugccuucuguggucgagacacuggaacagaugcagcgcaagcauggcgggaugcucgugcggaacccccugagcagaaauuccacccacgagauguauuggguuagcugcggaacaggcaacauugugucugccgucaacaugaccucccgcaugcugcucaaucgguuuacaauggcucauagaaaaccgaccuacgagcgcgauguggaccugggggccggaacgagacacguggcugucgaaccugagaucgccaaccuugauaucauuggccagcggaucgaaaauauuaagaacgagcacaaaagcacauggcauuaugacgaagauaaucccuacaagaccugggcguaucacgggucuuacgagguuaaacccuccggaagcgccucuuccauggugaacggcgugguccgccugcucaccaagccuugggacgugauccccaugguuacacaaauugcuaugacggacaccacaccuuucggccagcagagaguguuuaaggagaaagucgauacccggacaccgagacccaagcgggggaccgcccaaaucauggaagugacagcuaaauggcuguggggauuccuuagccgcaauaagaaaccuagaaucuguacccgggaggaauuuacgcgcaagguuagauccaacgccgcuauuggcgccguguucgucgacgagaaucaguggaacagcgcgaaggaagccguggaggaugagcgguuuugggaccugguucaucgcgaaagagagcuccacaaacaggggaagugcgcuaccugcguguauaauaugaugggaaaacgggaaaagaaacugggcgaguucgggaaggccaagggcucucgcgcuaucugguacauguggcugggagccagauuucucgaguucgaggcccugggcuucaugaacgaggaucauugguuuagccgggaaaauucccuuucuggggucgagggagaaggccugcacaaacucggguacauucugcgcgacaucagcaagauucccggaggcaacauguaugcggaugacacagcugggugggauaccagaaucacagaggacgaucuucagaaugaggccaaaaucaccgacauuauggaaccugagcacgcccugcucgcuacguccaucuucaagcugacauaccaaaacaaagugguccgggugcagcgccccgccaagucuggcaccguuauggaugugauuagcagacgggaccagagaggauccggccaggucgggacauauggacugaacaccuuuacgaauauggaagugcaacucauccgccagauggagucugaaggcauuuucagcccguccgagcuggagaacagcaaucuugcugaacgggugcuggacuggcucgagaaacaugggguugaaagacugaagcgcauggccaucucuggagaugacuguguggucaagccuaccgaugaccgguuugcgacagcccuuaccgcucugaacgauaugggcaaagugagaaaggacaucccccagugggagccuuccaaaggguggaaugauuggcagcaaguucccuucugcagccaccauuuucaccagcucauuaugaaggacggccgcgaaaucguggucccuugucggaaccaggaugagcuggugggacgggcccgcgucucucagggcgcuggguggucccugcgggagacagccugccucggaaaaagcuacgcgcaaauguggcagcugauguauuuccacagacgcgaccuucggcuggccgcuaaugccauuuguuccgcugugcccguuaacugggugccgaccucuagaacaaccuggagcauccaugcccaccaucaguggaugacgacagaagauaugcucuccgucuggaaucggguguggauugaggaaaacccuuggauggaggacaagacccacguuagcucuugggaagacgugcccuaccugggcaagagagaggaucaauggugcgggucccuuaucggacugaccgcucgcgccacaugggcgaccaauauucaggucgccaucaaccaggugcggagacucaucggcaaugagaacuaucuggacuacaugacaagcaugaaacgcuuuaagaaugaaucugaucccgagggggcucugugguga

SEQ ID NO: 19347 - RNA, 9879 nt, Artificial Sequence
  derived and/or modified CDS sequence (opt5) from DENV-1__KT187561__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagaacaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggguguccuaugucauguguacgggcagcuucaaacuggagaaggaaguggccgagacacagcacggaaccguucuggugcaggucaaguacgagggcaccgaugcgccgugcaaaauuccuaucucuacacaagacgaaaagggggugacccagaacggacggcuuaucacagcuaaucccauugugacggauaaagagaagccuguuaacaucgaaaccgagccgcccuuuggcgaguccuauauugucaucggggccggagaaaaagcccucaagcugagcugguucaagaaaggcucuagcauugggaagauguuugaggcuacagccagaggcgcucgccggauggccauccugggagacaccgcgugggauuucggcuccaucgggggaguguuuacaucugugggcaaacucguccaucagguguucgggaccgccuacggaguucuguuuagcggcguguccuggacgaugaagauugggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcuguccgccgcgauuggcaaggccugggaggagggggugugcggcaucagaucugcuacgcgccucgaaaauaucauguggaaacagauuagcaacgagcugaaucauauccuucuggaaaacgacaugaaguucacagucguggugggagacgccaauggcauucucacccaggggaaaaagaugauccggccgcaacccauggagcacaaauacuccuggaagucuuggggaaaggcuaaaauuaucggcgccgauacccagaacacaaccuuuaucauugacgggccugauacgcccgaauguccugacgaucagagagccuggaauaucugggaggucgaggacuauggauucggcguuuuuacaaccaacauuuggcugaagcugcgcgauagcuacacacagaugugcgaccaccggcuuauguccgcugcgaucaaagauagcaaggccgugcaugcugacaugggcuauuggauugaaucugagaaaaaugaaaccuggaagcucgccagagccuccuucaucgaggugaagacauguaucuggccccgcagccacacccuguggucuaacgggguccuggaauccgagaugauuaucccgaaaauuuacggaggcccuaucagccaacauaauuaucggcccggguacuucacgcagaccgcuggaccuuggcaccucggcaagcuggagcuugauuuuaaccugugcgaagggacaaccgugguuguggacgagcacugcggaaauagaggccccucucuccggacaaccacggucacaggcaaaauuauccaugaaugguguugccgcagcuguacccugccuccccugagauucagaggggaagauggaugcugguacggcauggagaucagaccggugaaggaaaaagaggaaaaccuuguucgcuccauggugagcgccgggucuggagaggucgacuccuuuagccucggccugcuguguguguccauuaugaucgaagagguuaugcggucuagauggagccgcaagaugcucaugacagggacccuggcgguguucuuucuucugauuaugggacagcucaccuggaaugaccugaucagacugugcauuauggucggcgcuaacguguccgaucggaugggcauggggacaacguaucuugcccugauggccaccuucaagaugcgcccuauguuugcugugggacuccuguucagacggcucacaucucgcgagguccugcuucugaccaucggccucagccugguugccuccguggaacugcccaacucucuugaggaacugggggacggacucgcgaugggcauuaugaugcugaaacuccugacagauuuucaaagccaccagcuuuggaccacgcugcucucccugacauucaucaagaccacccugagccuugacuacgcuuggaaaacaauggccauggugcugucuaucgucucccucuuuccccugugucucagcaccacaucucagaagacgaccuggcugccugugcuucugggguccuucggaugcaaaccgcugacaauguuucucauuaccgagaauaagaucuggggcagaaagagcuggccccugaacgaaggcauuauggccguugggaucgugucuauucuucuguccagccuccugaaaaaugaugucccucucgcuggaccccugaucgccggcgggaugcuuaucgcuuguuaugugauuuccggaagcucugccgaccugagccuggagcgggcggccgagguuuccugggaagaggaagcugagcauucuggcgccagccacaacauccucguggaaguccaggaugacgggacaaugaagauuaaagaugaggagcgcgacgauacccugacgauccuucugaaggcuacccuccuggccguguccggagucuacccuaugucuauucccgccacacucuucgugugguauuucuggcagaagaagaaacagagaagcggcguucugugggacaccccuagcccucccgaaguggagcgggcuguccuugaugacggcaucuaccgcauccugcagagagggcugcucggacggucucaggugggcguugggguguuucaagacggagucuuccauacaauguggcacgugaccagaggcgcggugcugauguaucaggggaaacgccuugaacccagcugggccuccguuaagaaagaucugauuagcuacggaggcggcuggcgguuucaggggucuuggaauacaggagaggagguccaggugaucgcuguggaacccggcaagaacccuaaaaauguccaaacgacccccgggacauucaagaccccggagggagaagugggcgccauugcccucgacuuuaaaccugggaccuccggaagccccaucguuaacagagagggcaagauugugggccuguacgggaauggagucgugacaacgucuggcaccuauguuuccgcuaucgcccaggcgaaggcuagccaggaagggccucuccccgagauugaggaugaaguguucaaaaagcgcaaccugacaaucauggaccuucaccccggauccggcaaaacccggagauaccugccugccaucguccgcgaggccauuaagcggaaacugagaacacucauccuggcuccgacccgcgugguugccucugaaauggcggaggcucuuaaggggaugcccauucgguaucaaacgacagccgugaaguccgaacauaccggcaaagagaucgucgaucugaugugccacgccaccuuuacaaugagacuccuguccccugugcgggugcccaauuacaacaugauuaucauggacgaggcucauuucaccgauccugccagcaucgcugcccgcggauauauuucuacaagagucggcaugggggaagcggccgcuaucuuuaugaccgccacgcccccuggauccguugaggcuuucccgcagagcaaugccgugauucaggacgaggaacgggauauccccgaacgcucuuggaacagcggcuacgacuggauuacagauuuuccugggaagaccgugugguucguccccuccaucaaaucuggaaaugacaucgccaacugucugagaaagaacggcaaacgggugauucagcucagcagaaagacauucgacaccgaguaucaaaagacgaaaaauaacgauugggacuacguugugaccacagauaucuccgagaugggggcuaauuuucgcgcggaccgggucauugauccuagacgcugccuuaagcccgugauccugaaagacggcccggaacggguuauucuggccggaccuaugcccgugaccgcugccucugccgcucagagacgcggccggaucgggagaaaccagaauaaggagggagaucaguacauuuauaugggccaaccccucaacaaugacgaagaucacgcccauuggacagaggcgaaaaugcugcuugacaacaucaauaccccugaggggaucauucccgcucuguucgaaccugagcgcgaaaagagcgccgccaucgauggagaguacagacuccggggcgaagcucgcaagacauuugucgagcugaugagaagaggggaccugccgguguggcucuccuauaaagucgccagcgagggcuuccaguacucugaucgcagauggugcuuugacggagaacggaacaaucaggugcuugaggaaaacauggacguugagauuuggaccaaggaaggcgagcgcaaaaagcugcgcccccgguggcuggaugcgagaacguauuccgacccucucgcccugcgcgaguucaaagaauuugcugccgggcggagaagcguguccggagaucuuauccuggagauuggcaagcucccccagcaccugacacugcgggcucaaaaugcccucgacaaccuugugaugcugcacaauucugaacaagggggaaaggcuuaccgccaugccauggaggaacugccugauaccaucgagacccucaugcugcuugcgcugaucgccguccucacaggcggcguuacccuguucuuucugagcgggaagggacucggcaagacauccauugggcuucugugugugauggcuucuagcgugcugcucuggauggccuccgucgagccccacuggaucgcugccagcauuauccuggaguucuuucuuauggugcugcucauuccggagccugacagacagcggacgccccaggauaaccaacuggccuauguugugaucggacuccuguuccuuauccugaccgucgcugcgaacgaaaugggccugcucgagacaaccaaaaaggaccuggggauuggacauguggucgccgagaaucaccaccaugcuacaaugcuugauaucgaccugcacccugccucugccuggacccucuacgcuguggccacgaccauuaucacacccaugaugcgccauaccauugaaaacacaaccgcgaauaucucccugacggccauugcuaaccaggccgcuauccugaugggccucgauaaaggcuggccuaucagcaagauggacauugggguuccccuucuggcccugggaugcuacucucaggugaauccgcucacacugaccgcggccguccuuaugcugguggcucacuaugccaucauuggcccugggcuccaagcuaaagccacaagagaggcucagaagcggaccgccgcgggaaucaugaagaaccccaccguugauggcauuguggccaucgaccuggaccccgucguguacgaugcuaaauuugaaaagcagcuggggcagaucaugcuccuuauucuguguacaucccaaauccugcucaugcgcacgaccugggcccugugcgagagcauuacacuugcuaccggaccucugacaacccucugggaaggcucuccgggcaaauucuggaauacgacaaucgccgugagcauggccaacauuuucagaggguccuaucuggcgggagcuggccuggccuuuucucucaugaaaagccuugggggaggccggcgcgggaccggagcucagggcgagacccugggcgagaaauggaagagacagcugaaucagcucuccaagagcgaguucaacacauacaaacgguccgggaucauggagguugacagaucugaagccaaggagggacugaaacgcggcgaaaccacaaagcaugccgucagccgggggacggcuaaacuuagaugguuuguggagcgcaaucuggugaagcccgagggaaaggucaucgaucucggcugugggcggggaggcugguccuauuacugcgccggccugaaaaagguuaccgaagugaaaggguauacaaagggaggcccugggcacgaggaacccauuccuauggcgaccuacggauggaacaucgugaaacugcacucuggcagagacgucuucuuuacacccccugagaagugugauacccuccuuugcgacauuggggaaagcuccccgaaucccacgaucgaggagggacgcacccugcgggugcugaaaaugguugaaccuuggcucagaggcaaccaauucuguauuaagauccugaaucccuacaugccuucuguggucgagacacuugaacagaugcagcgcaagcauggcgggaugcuggugcggaacccccucagcagaaauuccacccacgagauguauuggguuagcugcggaacaggcaacauugugucugccgucaacaugaccucccgcaugcugcugaaucgguuuacaauggcucauagaaaaccgaccuacgagcgcgauguggaccucggggccggaacgagacacguggcugucgaaccugagaucgccaaccuggauaucauuggccagcggaucgaaaauauuaagaacgagcacaaaagcacauggcauuaugacgaagauaaucccuacaagaccugggcguaucacgggucuuacgagguuaaacccuccggaagcgccucuuccauggugaacggcgugguccgccuucugaccaagccuugggacgugauccccaugguuacacaaauugcuaugacggacaccacaccuuucggccagcagagaguguuuaaggagaaagucgauacccggacaccgagacccaagcgggggaccgcccaaaucauggaagugacagcuaaauggcucuggggauuccugagccgcaauaagaaaccuagaaucuguacccgggaggaauuuacgcgcaagguuagauccaacgccgcuauuggcgccguguucgucgacgagaaucaguggaacagcgcgaaggaagccguggaggaugagcgguuuugggaccuuguucaucgcgaaagagagcugcacaaacaggggaagugcgcuaccugcguguauaauaugaugggaaaacgggaaaagaaacucggcgaguucgggaaggccaagggcucucgcgcuaucugguacauguggcugggagccagauuccuggaauuugaggcccucggcuucaugaacgaggaucauugguuuagccgggaaaauucccugucuggggucgagggagaaggccuucacaaacugggguacauucuccgcgacaucagcaagauucccggaggcaacauguaugcggaugacacagcugggugggauaccagaaucacagaggacgaucugcagaaugaggccaaaaucaccgacauuauggaaccugagcacgcccuucuggcuacguccaucuucaagcucacauaccaaaacaaagugguccgggugcagcgccccgccaagucuggcaccguuauggaugugauuagcagacgggaccagagaggauccggccaggucgggacauauggacugaacaccuuuacgaauauggaagugcaacugauccgccagauggagucugaaggcauuuucagcccguccgagcucgagaacagcaaucuggcugaacgggugcuugacuggcuggagaaacaugggguugaaagacucaagcgcauggccaucucuggagaugacuguguggucaagccuaccgaugaccgguuugcgacagcccugaccgcucuuaacgauaugggcaaagugagaaaggacaucccccagugggagccuuccaaaggguggaaugauuggcagcaaguucccuucugcagccaccauuuucaccagcugauuaugaaggacggccgcgaaaucguggucccuugucggaaccaggaugagcucgugggacgggcccgcgucucucagggcgcuggguggucccugcgggagacagccugccugggaaaaagcuacgcgcaaauguggcagcucauguauuuccacagacgcgaccugcggcuugccgcuaaugccauuuguuccgcugugcccguuaacugggugccgaccucuagaacaaccuggagcauccaugcccaccaucaguggaugacgacagaagauaugcuguccgucuggaaucggguguggauugaggaaaacccuuggauggaggacaagacccacguuagcucuugggaagacgugcccuaccucggcaagagagaggaucaauggugcgggucccugaucggacuuaccgcucgcgccacaugggcgaccaauauucaggucgccaucaaccaggugcggagacugaucggcaaugagaacuaucucgacuacaugacaagcaugaaacgcuuuaagaaugaaucugaucccgagggggcucugugguga

SEQ ID NO: 19348 - RNA, 9879 nt, Artificial Sequence
  derived and/or modified CDS sequence (opt5) from DENV-1__KT187562__SS-prME
agcgugaccaugcugcucaugcugcuucccacagcccuggcuuuccaccucacgacccggggcggggaaccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagagaagacacugaagcugagcugguuuaagaaaggcucuagcauugggaagauguucgaggccaccgcuagaggcgcccgccggauggcuauccucggagacacagccugggauuuuggcuccaucgggggaguguucaccucugugggcaaacugguccaucagguguuugggacggcguacggaguucuuuucagcggcguguccuggaccaugaagauugggaucggcauucugcucacauggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuuugugacaaacgagguucacaccuggacggaacaauauaaguuccaggccgauagcccuaaacggcucuccgcugccauuggcaaggcgugggaggagggggugugcggcaucagaucugccacacgccuggaaaauaucauguggaaacagauuagcaacgagcuuaaucauauccugcucgaaaacgacaugaaguuuaccgucguggugggagacgcuaauggcauucugacccaggggaaaaagaugauccggccgcaacccauggagcacaaauacuccuggaagucuuggggaaaggccaaaauuaucggcgcugauacacagaacaccacguucaucauugacgggccugauacacccgaauguccugacgaucagagagccuggaauaucugggaggucgaggacuauggauuuggcguuuucaccacaaacauuuggcugaaacuucgcgauagcuacacccagaugugcgaccaccggcucauguccgccgcuaucaaagauagcaaggcggugcaugccgacaugggcuauuggauugaaucugagaaaaaugaaacauggaagcuggcuagagccuccuuuaucgaggugaagaccuguaucuggccccgcagccacacgcuguggucuaacgggguccucgaauccgagaugauuaucccgaaaauuuacggaggcccuaucagccaacauaauuaucggcccggguacuucacccagacagccggaccuuggcaccugggcaaacuugagcuggauuucaaccucugcgaagggaccacagugguuguggacgagcacugcggaaauagaggccccucucugcggaccacgacagucaccggcaaaauuauccaugaaugguguugccgcagcuguacacugccuccccuuagauuuagaggggaagauggaugcugguacggcauggagaucagaccggugaaggaaaaagaggaaaaccucguucgcuccauggugagcgcugggucuggagaggucgacuccuucagccugggccugcucuguguguccauuaugaucgaagagguuaugcggucuagauggagccgcaagaugcugaugaccgggacccuugccguguuuuuccugcucauuaugggacagcugacauggaaugaccugaucagacuuugcauuauggucggcgcgaacguguccgaucggaugggcauggggacgaccuaucuggcucucauggccacauuuaagaugcgcccuauguucgccgugggacugcucuuuagacggcugaccucucgcgagguccuucugcucacaaucggccugagccugguugcuuccguggaacuucccaacucucuggaggaacucggggacggacuggccaugggcauuaugaugcucaaacugcuuaccgauuuccaaagccaccagcuguggacgacacuccugucccugaccuuuaucaagaccacacuuagccuggacuacgcguggaaaaccauggcuauggugcucucuaucgucucccuguucccccucugucugagcacaacgucucagaagaccacauggcuuccugugcugcugggguccuuuggaugcaaaccgcucaccauguuccugauuacagagaauaagaucuggggcagaaagagcuggccccuuaacgaaggcauuauggccguugggaucgugucuauucugcucuccagccugcucaaaaaugaugucccucuggccggaccccuuaucgcuggcgggaugcugaucgccuguuaugugauuuccggaagcucugcugaccugagccucgagcgggccgcggagguuuccugggaagaggaagccgagcauucuggcgcuagccacaacauccugguggaaguccaggaugacgggaccaugaagauuaaagaugaggagcgcgacgauacgcuuaccauccugcucaaggccacacugcucgcuguguccggagucuacccuaugucuauucccgccacccuguuugugugguauuucuggcagaagaagaaacagagaagcggcguucuuugggacacaccuagcccucccgaaguggagcgggccguccuggaugacggcaucuaccgcauccugcagagagggcuccugggacggucucaggugggcguugggguguuccaagacggagucuuucauaccauguggcacgugacaagaggcgcugugcuuauguaucaggggaagcgccuggaacccagcugggcguccguuaagaaagaucucauuagcuacggaggcggcuggcgguuccaggggucuuggaauacgggagaggagguccaggugaucgccguggaacccggcaagaacccuaaaaauguccaaaccacacccgggaccuuuaagaccccggagggagaagugggcgcuauugcccuggacuucaaaccugggacauccggaagccccaucguuaacagagagggcaagauugugggccucuacgggaauggagucgugacgaccucuggcacauauguuuccgccaucgcucaggccaaggcgagccaggaagggccucugcccgagauugaggaugaaguguuuaaaaagcgcaaccuuaccaucauggaccugcaccccggauccggcaaaacacggagauaccugccugcuaucguccgcgaggccauuaagcggaaacucagaacccugauccuugccccgacgcgcgugguugcuucugaaauggccgaggcgcugaaggggaugcccauucgguaucaaacaaccgcugugaaguccgaacauaccggcaaagagaucgucgaucucaugugccacgccacauucaccaugagacugcuguccccugugcgggugcccaauuacaacaugauuaucauggacgaggcccauuuuacagauccugcuagcaucgccgcucgcggauauauuucuaccagagucggcaugggggaagccgcggccaucuucaugacggcuacacccccuggauccguugaggccuuuccgcagagcaaugcugugauucaggacgaagaacgggauauccccgaacgcucuuggaacagcggcuacgacuggauuaccgauuucccugggaagacagugugguuuguccccuccaucaaaucuggaaaugacaucgccaacugucucagaaagaacggcaaacgggugauucagcuuagcagaaagaccuucgacacggaguaucaaaagaccaaaaauaacgauugggacuacguugugacaaccgauaucuccgagaugggggccaauuuccgcgcugaccgggucauugauccuagacgcugccugaagcccgugauccugaaagacggcccggaacggguuauucucgcgggaccuaugcccgugacagccgcuucugccgcccagagacgcggccggaucgggagaaaccagaauaaggagggagaucaguacauuuauaugggccaaccccugaacaaugacgaagaucacgcucauuggaccgaggccaaaaugcuucuggacaacaucaauacaccugaggggaucauucccgcgcucuuugaaccugagcgcgaaaagagcgcugccaucgauggagaguacagacugcggggcgaagcccgcaagaccuucgucgagcugaugagaagaggggaccucccgguguggcuuuccuauaaagucgcuagcgagggcuuucaguacucugaucgcagauggugcuucgacggagaacggaacaaucaggugcuggaggaaaacauggacguugagauuuggacgaaggaaggcgagcgcaagaagcugcgcccccgguggcucgaugccagaacauauuccgacccucuggcgcuucgcgaguuuaaagaguucgccgcugggcggagaagcguguccggagaucugauccucgagauuggcaagcugccccagcaccugacccuccgggcccaaaaugcucuugacaaccuggugaugcugcacaauucugaacaagggggaaaagccuaccgccaugcuauggaggaacucccugauaccaucgagacacugaugcuucuggcccucaucgcgguccugaccggcggcguuacacuguuuuuccucagcgggaagggacuuggcaagacguccauugggcugcugugugugauggccucuagcgugcuccuguggauggcuuccgucgagccccacuggaucgccgcuagcauuauccuugaauuuuuccugauggugcuccugauuccggagccugacagacagcggacaccccaggauaaccaacuggccuauguugugaucggacuccuuuuuaugauccugacagucgccgcuaacgaaaugggccugcucgagaccaccaaaaaggaccuggggauuggacauguggucgcggagaaucaccaccaugccaccaugcuugauaucgaccugcacccugcuucugccuggacgcucuacgccguggcuaccacaauuaucacccccaugaugcgccauacaauugaaaacaccacggccaauaucucccugacagcgauugccaaccaggcugccauccugaugggccucgauaaaggcuggccuaucagcaagauggacauugggguuccccuucuggcucugggaugcuacucucaggugaauccgcucacccugacagccgcgguccuuaugcugguggcccacuaugcuaucauuggcccugggcuccaagccaaagcuaccagagaggcccagaagcggaccgcugccggaaucaugaagaaccccacaguugauggcauuguggcgaucgaccuggaccccgucguguacgaugccaaauucgaaaagcagcuggggcagaucaugcuccuuauucuguguacgucccaaauccugcucaugcgcaccacaugggcucugugcgagagcauuacccuugccacaggaccucugaccacgcucugggaaggcucuccgggcaaauuuuggaauacaaccaucgcugugagcauggccaacauuuucagaggguccuaucuggccggagcgggccuggcuuucucucucaugaaaagccuugggggaggccggcgcgggaccggagcccagggcgagacacugggcgagaaauggaagagacagcugaaucagcucuccaagagcgaauuuaacaccuacaaacgguccgggaucauggagguugacagaucugaagcuaaggagggacugaaacgcggcgaaacaacgaagcaugccgucagccgggggaccgccaaacuuagaugguucguggagcgcaaucuggugaagcccgagggaaaggucaucgaucucggcugugggcggggaggcugguccuauuacugcgcuggccugaaaaagguuacagaagugaaaggguauaccaagggaggcccugggcacgaggaacccauuccuauggccacauacggauggaacaucgugaaacugcacucuggcagagacgucuuuuucacgcccccugagaagugugauacccuccuuugcgacauuggggaaagcuccccgaaucccaccaucgaggagggacgcacacugcgggugcugaaaaugguugaaccuuggcucagaggcaaccaauuuuguauuaagauccugaaucccuacaugccuucuguggucgagacccuugaacagaugcagcgcaagcauggcgggaugcuggugcggaacccccucagcagaaauuccacacacgagauguauuggguuagcugcggaaccggcaacauugugucugcggucaacaugacaucccgcaugcugcugaaucgguucaccauggcccauagaaaaccgacguacgagcgcgauguggaccucggggcuggaacaagacacguggccgucgaaccugagaucgcuaaccuggauaucauuggccagcggaucgaaaauauuaagaacgagcacaaaagcaccuggcauuaugacgaagauaaucccuacaagaccugggccuaucacgggucuuacgagguuaaacccuccggaagcgcgucuuccauggugaacggcgugguccgccuucugacaaagccuugggacgugauccccaugguuacgcaaauugccaugaccgacacaaccccuuuuggccagcagagaguguucaaggagaaagucgauacacggaccccgagacccaagcgggggacagcucaaaucauggaagugaccgccaaauggcucuggggauuucugagccgcaauaagaaaccuagaaucuguacgcgggaggaguucacccgcaagguuagauccaacgcugccauuggcgcuguguuugucgacgagaaucaguggaacagcgccaaggaagcgguggaggaugagcgguucugggaccuuguucaucgcgaaagagagcugcacaaacaggggaagugcgccacaugcguguauaauaugaugggaaaacgggaaaagaaacucggcgaguuugggaaggcuaagggcucucgcgccaucugguacauguggcugggagcuagauuccuggaguucgaggcccucggcuuuaugaacgaggaucauugguucagccgggaaaauucccugucuggggucgagggagaaggccuucacaaacugggguacauucuccgcgacaucagcaagauucccggaggcaacauguaugccgaugacaccgcggggugggauacaagaaucaccgaggacgaucugcagaaugaggcuaaaaucacggacauuauggaaccugagcacgcccuucuggccacauccaucuuuaagcucaccuaccaaaacaaagugguccgggugcagcgccccgcuaagucuggcacaguuauggaugugauuagcagacgggaccagagaggauccggccaggucgggaccuauggacugaacacguucaccaauauggaagugcaacugauccgccagauggagucugaaggcauuuuuagcccguccgagcucgagaacagcaaucuggccgaacgggugcuugacuggcuggagaaacaugggguugaaagacucaagcgcauggcuaucucuggagaugacuguguggucaagccuacagaugaccgguucgccaccgcgcugacagcccuuaacgauaugggcaaagugagaaaggacaucccccagugggagccuuccaaaggguggaaugauuggcagcaaguucccuuuugcagccaccauuuccaccagcugauuaugaaggacggccgcgaaaucguggucccuugucggaaccaggaugagcucgugggacgggcucgcgucucucagggcgccggguggucccugcgggagaccgcuugccugggaaaaagcuacgcccaaauguggcagcucauguauuuucacagacgcgaccugcggcuugcggccaaugcuauuuguuccgccgugcccguuaacugggugccgacaucuagaaccacguggagcauccaugcucaccaucaguggaugacaaccgaagauaugcuguccgucuggaaucggguguggauugaggaaaacccuuggauggaggacaagacccacguuagcucuugggaagacgugcccuaccucggcaagagagaggaucaauggugcgggucccugaucggacuuacagcccgcgcuaccugggccacaaauauucaggucgcgaucaaccaggugcggagacugaucggcaaugagaacuaucucgacuacaugacgagcaugaaacgcuucaagaaugaaucugaucccgagggggcccugugguga

SEQ ID NO: 19349 - RNA, 9879 nt, Artificial Sequence
  derived and/or modified CDS sequence (opt5) from DENV-1__JQ045628__SS-prME
agcgugaccaugcugcugaugcugaugcccacagcucuugcuuuccaccugacgaccagaggcggggagccucauaugauuguguccaagcaggaacggggaaagucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgccuuuuuccuugcccaugcgauugggaccucuaucacccagaagggaaucauuuuuauccugcucaugcuggucacaccuagcauggccaugagaugcgugggcauugggucccgggauuucguugagggacuuagcggcgcuacguggguggacgucgugcuggagcacgggucuugugugaccacaauggccaaggauaaacccacccucgacaucgaacugcugaagacagaggucaccaacccugcuauucuccgcaaacugugcaucgaagccaagauuuccaauacgacaaccgauagcagauguccgacccaaggagaggcgacacuuguugaagaacaagacgccaacuuugugugccggcgcaccuucguggauagaggcuggggcaauggguguggacuguuuggcaaagggucucucaucacaugcgcuaaguucaagugcgucacgaaacuggagggaaagaucgugcaguacgaaaaccuuaaauauuccguuauugugaccguccacacaggcgaccagcaucaaguggggaaugagagcaccgaacacggaacaaccgccacgaucacaccccaagcuccuaccaccgagauucagcugacagacuacggcgcccucacccuggauuguucuccccggacgggccuggacuuuaacgaaaugguucuccugacaaugaaggagaaauccuggcuugugcauaagcagugguuccuggaucucccucugcccuggaccagcggggccuccacaucucaagagaccuggaaucgccaggaccuucuggucaccuuuaaaacagcucacgcgaagaagcaggaaguggucgugcucggaagccaagagggcgccaugcacacggcucugaccggggccacagaaauccagaccuccggaacaaccacgauuuucgccggccaucugaaaugcagacucaagauggauaaacugacacuuaaggggaugagcuauguuauguguaccggcucuuucaaacuggagaaggaaguggcugagacccagcacggaacaguccucgugcagaucaaguacgagggcaccgacgccccgugcaaaaucccuuuuuccacacaagaugaaaaggggguuacgcagaacggacggcugauuaccgcgaaucccaucgugacagacaaagagaagccugucaacauugaagcugagccgcccuucggcgagagcuauaucgugauuggggccggagaaaaagcccugaaacuuucuugguuuaagaaaggcagcuccaucgggaagauguucgaggcuaccgccagaggcgcucgccggauggccauccucggagauacagcgugggacuuuggcucuauugggggaguguucaccagcguuggcaaacugguccaucagaucuuugggacggccuacggagugcuguucuccggcgugagcuggaccaugaagauugggaucggcguccuccugacauggcuuggacucaauucuagauccaccagccucucuaugacauguauugcugugggccugguuacccuguaccuuggggugaugguccaggccgauuccggaugcgugaucaacuggaaaggccgcgaacucaagugugggagcggaauuuuuguuacaaaugaggugcacaccuggacggaacaauauaaguuccaggcugacuccccuaaacggcugucugccgcgaucggcaaggccugggaggagggggucugcggcaucagaagcgcuacacgccuggaaaacauuauguggaaacagaucuccaacgagcucaaucauauucugcuugaaaacgacaugaaguuuaccgugguugugggagaugucgccggcauccuggcucaggggaaaaagaugauucggccgcaacccauggaguacaaauauucuuggaaaagcuggggaaaggccaagaucaucggcgccgacgugcagaauaccacauucauuaucgaugggccuaacacccccgaauguccugacgaucagagagcuuggaauauuugggagguggaggacuacggauuuggcaucuucacgacaaacauuuggcucaagcugcgcgauuccuauacccaggucugcgaccaccggcugaugagcgcggccaucaaagauucuaaggcuguucacgccgacaugggcuacuggaucgaauccgagaaaaaugaaacauggaaacuugccagagcuagcuucauugaggugaagaccuguaucuggcccaaaucucauacacucugguccaacggggugcuggaaagcgagaugauuaucccgaagauuuauggaggcccuaucucucaacacaauuaccgccccggguacuuuacccagacggccggaccuuggcaucugggcaaacucgagcuggauuucgaccuuugcgaagggaccacagucgugguugaugagcacugcggaaaccggggccccagccugagaaccacaaccgugacgggcaagaucauucacgaaugguguugccgguccuguacacucccuccccugcgcuuuagaggggaggacggaugcugguauggcauggagauccggccggucaaagaaaaggaggaaaaucuggucaagagcaugguuucugcgggguccggagagguggacagcuucucccuuggccuccuguguauuucuaucaugauugaagaggucaugagaagccgcuggucccggaaaaugcugaugaccgggacacucgcuguguuucugcuucugaucaugggacagcucaccuggaacgaucugauuagacugugcaucaugguuggcgccaaugccucugaccgcaugggcauggggaccacauaccuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaucagcuuugggccacacugcucagccugaccuucauuaagacgacauuuucucugcacuaugcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuacguuauuagcggaucuagcgccgaccugucccuggagaaagcugccgaggugucuugggaagaggaagccgagcauagcggcgcuucccacaauauccucgucgaagugcaggaugacgggaccaugaagaucaaagaugaggagagagacgauacacugaccauucuucugaaggcgacacuccuggccguuucuggaguguauccucucagcauccccgcuacccuguucgucugguacuucuggcagaagaagaagcagcgguccggcgugcuuugggacacgccuucucccccggaagucgagcgcgccgugcuggaugacggcauuuauagaaucaugcagcgggggcugcucggacgcagccagguuggcgugggggucuuucaagaaaacguguuccauaccauguggcacguuacaagaggagccgugcugauguaccagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacaacccccggcacauuuaagacgcuggaaggggaggugggagcgauugcucucgauuucaagccgggcaccagcgggucuccuaucgugaaccgcgaaggaaaaaucgucggccuguauggcaauggggugguuacaaccuccggaaccuacgugagcgccauugcccaggcuaaggccucccaggagggcccccuuccugagaucgaagacgaggucuuucggaaaagaaaccugacaauuauggaucugcaccccgggucuggaaagacgcgccgguaucuccccgcgaucgugagagaagcuauuaaacgcaagcugcggacccuuauccuggccccuacaagaguuguggccagcgagauggcugaagcccucaagggcaugccgauccgcuaccaaaccacagcugucaaauccgagcauaccgggaaggagauuguggaccugaugugccacgccacguucacaaugcggcugcucagccccguuagagugccuaauuauaacaugaucauuauggaugaagcgcauuuuaccgaccccucuuccaucgccgcucggggcuacauuagcacccgcgucggaaugggcgaggccgcugccaucuucaugacagccaccccucccgggucuguggaggcuuuuccucagagcaaugcggugauccaggaugaagaaagagacauuccggagcgguccuggaacucuggauaugaguggaucacagauuuccccggcaaaaccgucugguuuguuccuagcauuaaguccgggaaugacaucgccaacugucuucgcaaaaauggaaagagagugauucagcugucucggaagacguucgauacagaauaccagaagaccaagaacaacgacugggacuacguggucacaaccgauaucagcgagaugggcgcuaauuucagagccgaccgcgugauugauccccggagaugccugaaaccuguuauccucaaggacgggcccgaacgcgugauccuggccggcccgaugccugucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacacccgagggcaucauuccugcccuguuugaacccgagagagaaaagagcgcugccaucgauggggaguaucgccugagaggagaggcgcggaaaaccuucguugaacucaugcgcagaggcgaccuuccuguguggcugucuuacaaggucgccuccgagggguuucaauauagcgaucggcgcuggugcuucgacggcgaaagaaacaaucaggugcuggaggaaaacauggaugucgagaucuggacaaaagagggagaacggaagaaacucagaccgcgcuggcuggacgcucggaccuacuccgacccccuugcccugagagaguuuaaggaguucgcugccggccgccggucugugagcggggaucucauucuggagaucggaaaacugccucagcaccucacacagagagcucaaaaugcccuugacaaccugguuaugcugcauaauuccgaacagggcgggcgggcguaucgccacgccauggaggagcuccccgauaccauugaaacgcugaugcuucuggcucucaucgccgugcugacaggaggcgugacccuguuuuuccucucuggcagagggcuuggaaagaccagcauuggccugcugugugucaucgcuuccagcguucuccuguggauggccucuguggagccucauuggaucgccgcuuccauuauccuugaauuuuuccugauggugcuccugauucccgagccggaccggcagcgcacaccucaggauaaccaacuggcguacgucgugaucgggcuccuuuuuaugauucugaccguugccgcuaaugagaugggacugcucgaaacaacgaagaaagaccugggcaucgggcacguggccgucggaaaccaccaucacgccgcuaugcuugauguggaccugcaucccgccagcgcguggacccucuacgccgucgcuacaaccauuaucacaccuaugaugagacacaccaucgagaacacgaccgccaauauuucucugacagcuaucgccaaccaggcggccauucugaugggccucgauaagggcuggcccaucuccaaaauggacauuggggugccucuucuggcucugggaugcuauagccagguuaauccccucacccugacagccgcugugcuuaugcuggucgcccauuacgcuaucaucggcccggggcuccaagccaaggcgacccgggaagcccagaaacgcacggcugccggaauuaugaagaacccuacaguggauggcaucguugcuauugaccuggaucccguggucuaugacgccaaguucgagaaacagcuggggcagaucaugcuccuuauucuguguaccucucaaauccugcucaugagaacaaccugggcccugugcgaaagcaucacccuugcgacaggaccccugacgacccucugggagggcuccccuggcaaguuuuggaauacaaccauugcugugucuauggccaacaucuuccgggggagcuaccuggcuggagccggccuggccuucucccucaugaaaagccuugggggaggccgcagagggacaggagcucagggcgagacccugggcgaaaaguggaaacggcagcugaaucagcucuccaagucugaguuuaacacguauaagagaagcgggauuauggaaguggaccgcuccgaggccaaagaaggacugaagcggggcgagacaaccaaacacgcgguuucuagagggaccgccaaacuucgcugguucgucgagcggaaucuggugaaaccggaaggaaaggugaucgaucucggcugugggagaggaggcuggagcuacuauugcgcuggccugaagaaagucacagagguuaagggguacaccaaaggaggccccgggcacgaggaaccuauucccauggccacauacggauggaaccuggugaagcuccauuccggcaaagacguguuuuucaucccucccgaaaagugugauacgcuucugugcgacauuggggagucuagcccuaauccgaccaucgaggaaggacgcacacugcggguccucaaaaugguggagcccuggcugagaggcaaccaauuuuguaucaagauucuuaauccuuauaugcccuccguuguggaaacccuggagcagaugcagcgcaagcacggcgggaugcucguccggaacccucugagcagaaauucuacacaugagauguacuggguguccugcggaaccggcaacaucguuagcgcugugaauaugacgucucgcaugcugcucaaccgguucaccauggcccacagaaaacccacauaugaacgcgaugucgaccugggggcgggaaccagacacguggccguggagccggaagucgcuaaccuugauauuaucggccagcggauugagaauaucaagcaugaacacaaauccacauggcauuacgacgaggauaacccuuauaagaccugggccuaccacgggagcuaugagguuaaacccucuggauccgcuagcuccauggugaauggcguggucaagcugcucacaaagcccugggacgugaucccuaugguuacccaaauugccaugacggauacaacccccuuuggccagcagcgcguguucaaagaaaaggucgacaccagaacaccuaaagcuaagcgggggacggcccaaaucauggaggugaccgcgaaauggcuguggggauuucuuagcagaaacaagaagccgcggauuuguacacgcgaagaguucaccagaaaaguucggucuaaugccgcuaucggcgccguguuugucgacgaaaaccaguggaauagcgcuaaggaggccguggaggaugaacgcuucugggaccugguucauagagagcgggaacuccacaaacaggggaagugcgccacaugcguguacaacaugaugggaaaacgcgagaagaagcugggcgaauuugggaaagcgaagggcuccagagcuauuugguacauguggcugggagcccgguuccucgaguucgaggcccugggcuuuaugaaugaagaucacugguucucucgcgagaacagccuuuccggggucgaaggagagggccugcauaaacucggguauauccugagagacaucucuaagauucccggaggcaauauguacgcugaugacaccgccgggugggauacacggaucaccgaggacgaucuucagaacgaagcucgcauuacggacaucauggagccugaacacgcccugcucgcgaaaagcauuuuuaagcugaccuaucaaaauaaaguggucagagugcagcggcccgccaagaacggcacaguuauggaugugaucucccgcagagaccagcggggaucuggccaggucgggaccuacggacugaauacauucaccaacauggaggcucaacucaucagacagauggaaagcgagggcaucuuuuccccuagcgagcuggaaacgcccaaccuugccgagcgcgugcuggauuggcucgaaaaguaugggguggagcggcugaaaagaauggcuaucucuggagacgacuguguugugaagccgauugaugaccgcuucgccacagcgcuuaccgcccugaaugauaugggcaaaguccggaaggacaucccucagugggaacccuccaaaggguggaacgauuggcagcaagugccuuuuugcagccaucacuuccaccagcucauuaugaaggacggcagagagaucguugugcccugucgcaaucaggaugagcuggucggacgggcuagagugucucagggcgccggguggucccugcgcgaaacagcuugccucggaaagagcuacgcccaaauguggcagcugauguauuuucaucggagagaccuucgccuggcugccaacgcgauuuguuccgccgucccuguggauuggauccccaccucucggacgaccuggagcauccacgcucaucaccaguggaugacaaccgaggacaugcucuccguuuggaauagaguguggauugaagagaacccguggauggaagauaaaacacauaucagcucuuggggcgacgucccuuaccuggggaagcgggaggaccaauggugcggaucccuuauuggccugaccgccagagccacaugggcuaccaauauccagguggccauuaaccagguucgccggcucaucgggaaugagaacuaccuggauuauaugacgagcaugaaaagauucaagaaugaaucugaccccgagggcgcgcugugguga

SEQ ID NO: 19350 - RNA, 9879 nt, Artificial Sequence
  derived and/or modified CDS sequence (opt5) from DENV-1__JQ045629__SS-prME
agcgugaccaugcugcucaugcugaugcccacagcccuugcuuuccaccugacgaccagaggcggggaaccucauaugaugguguccaagcaggaacgggggaaaucucuccuguuuaagacaagcgccggcguuaacaugugcacccuuauugcgauggaccugggggagcucugugaagauacaaugaccuacaaaugcccccgcauuacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauccagcggguugaaaccugggcccugcgccaccccggcuucacagugauugcucuuuuucuggcccaugcgaucgggaccucuauuacccagaagggaaucaucuucauucuccugaugcuugucacaccuagcauggccaugagaugcgugggcaucgggucccgggauuuuguugagggacugagcggcgcuacguggguggacgucgugcucgagcacgggucuugugugaccacaauggccaaggauaaacccacccuggacauugaacugcucaagacagaggucaccaacccugcuguucugcgcaaacuuugcaucgaagccaagauuuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugaucacaugcgcuaaguuuaagugcgugacgaaacuugagggaaagauuguucaguacgaaaaccugaaauauuccgugaucgucaccgugcacacaggcgaccagcaucaaguugggaaugagagcaccgaacacggaacaaccgccacgaucacaccccaagcuccuaccaccgagauucagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauccagaccuccggaacaaccacgauuuuugccggccaucucaaaugcagacugaagauggauaaacuuacacugaaggggaugagcuaugugauguguaccggcucuuucaaacucgagaaggaacuggcugagacccagcacggaacaguccuggugcagaucaaguacgagggcaccgacgccccgugcaaaauuccuuucuccacacaagaugaaaaggggguuacgcagaacggacggcuuaucaccgcgaaucccaucgugacagacaaagagaagccugucaacauugaagcugagccgcccuuuggcgagagcuauaucgugauuggggccggagaaaaagcccucaagcugucuugguucaagaaaggcagcuccaucgggaagauguuugaggcuaccgccagaggcgcucgccggauggccauucugggagauacagcgugggacuucggcucuaucgggggaguguuuaccagcguuggcaaacucguccaucagaucuucgggacggccuacggagugcuguuuuccggcgugagcuggaccaugaagauugggaucggcguccuucugacauggcucggacucaauucuagauccaccagccugucuaugacauguauugcugugggccuuguuacccucuaccugggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcucucugccgcgaucggcaaggccugggaggagggggucugcggcauuagaagcgcuacacgccuggaaaacaucauguggaaacagaucuccaacgagcuuaaucauauucugcucgaaaacgacaugaaguucaccgugguugugggagaugucgccggcauccuggcucaggggaaaaagaugauucggccgcaacccauggaguacaaauauucuuggaaaagcuggggaaaggccaagaucauuggcgccgacgugcagaauaccacauuuaucaucgaugggccuaacacccccgaauguccugacgaucagagagcuuggaauauuugggagguggaggacuacggauucggcaucuuuacgacaaacauuuggcugaaacuucgcgauucccacacccaggucugcgaccaccggcucaugagcgcggccaucaaagauucuaaggcuguucaugccgacaugggcuauuggauugaauccgagaaaaaugaaacauggaagcuggccagagcuagcuucaucgaggugaagaccuguaucuggcccaaaucucacacacugugguccaacggggugcucgaaagcgagaugauuaucccgaagauuuacggaggcccuaucucucaacauaauuaucgccccggguacuucacccagacggccggaccuuggcaccugggcaaacuugagcuggauuuugaccucugcgaagggaccacagucgugguugaugagcacugcggaaaccggggccccagccugagaaccacaaccgugacgggcaagauuauccaugaaugguguugccgguccuguacacugccuccccuucgcuucagaggggaggacggaugcugguacggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugaccgggacacuugcuguguucuuucugcucaucaugggacagcugaccuggaacgaucugauuagacuuugcaucaugguuggcgccaaugccucugaccgcaugggcauggggaccacauaucuggcucucauggccacguucaagaugagaccuauguuugcggugggacugcuguuccggcgccugaccagcagagagguccuucugcucacaauuggccugucccugguggcuucuguggaacuucccaacagccuggaggaacucggggauggacuggccaugggcaucaugauccucaaacugcuuaccgacuuucaaucccaccagcugugggccacacuccugagccugaccuucauuaagacgacauuuucucuucauuacgcuuggaaaaccauggccaugguccuguccaucguuagccucuucccccugugucucucuaccacaucccagaagaccacauggcugccugugcuucuggggagccugggaugcaagccgcucacgauguuucugauugcugagaauaaaaucuggggccggcgcucuuggccccuuaacgaaggcauuauggccguggggaucgucuccauccugcucagcucccugcucaagaacgaugugccucuggcgggaccccuuauugccggcgggaugcugaucgcuuguuauguuauuagcggaucuagcgccgaccugucccucgagaaagcugccgaggugucuugggaagaggaagccgagcacagcggcgcuucccauaauauccuggucgaagugcaggaugacgggaccaugaagauuaaagaugaggagagagacgauacacuuaccauccugcucaaggcgacacugcucgccguuucuggaguguacccucugagcauccccgcuacccuuuucgucugguauuucuggcagaagaagaagcagcgguccggcgugcugugggacacgccuucucccccggaagucgagcgcgccgugcuggaugacggcauuuacagaaucaugcagcgggggcuccugggacgcagccagguuggcgugggggucuuucaagaaaacguguuccacaccauguggcacguuacaagaggagccgugcuuauguaucagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacagcgcccggcaccuuuaagacaccggaaggggaggugggagcuauugcccucgauuucaagccuggcacgagcgggucucccaucgugaaccgcgaaggaaaaauugucggccuguacggcaauggggugguuaccacauccggaaccuaugugagcgccaucgcucaggccaaggcgucccaggagggcccucuucccgagaucgaagacgaggucuuucggaaaagaaaccugaccauuauggaucugcaucccgggucuggaaagacacgccgguaccucccugcuaucgugagagaagccauuaaacgcaagcugcggacgcuuauccuggccccgaccagaguuguggcuagcgagauggccgaagcucucaagggcaugcccauucgcuaucaaacaaccgccgucaaauccgagcacacagggaaggagaucguggaccugaugugccaugcgaccuucacgaugcggcugcucagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauucaggaugaggaaagagacauccccgagcgguccuggaacucuggauacgaguggaucaccgauuucccuggcaaaacagucugguuuguucccagcauuaaguccgggaaugacaucgcuaacugucuucgcaaaaauggaaagagagugauucagcugucucggaagaccuucgauacggaauaucagaagaccaagaacaacgacugggacuacguggucaccacagauaucagcgagaugggcgccaauuucagagccgaccgcgugauugauccucggagaugccugaaacccguuauccucaaggacgggccggaacgcgugauucuggcuggcccuaugcccgucaccguggccuccgcggcucagcggagaggacgcaucggccggaaccauaauaaagagggggaucaguacaucuauaugggacagccccuuaacaaugacgaggaucacgcccacuggacggaagccaagaugcugcucgacaacauuaauaccccugagggcaucauucccgcucuguuugaaccugagagagaaaagagcgccgcgaucgauggggaguaccgccugagaggagaggcccggaaaacauucguugaacucaugcgcagaggcgaccuuccgguguggcugucuuauaaggucgcuuccgagggguuucaauacagcgaucggcgcuggugcuucgacggcgaaagaaacaaucaggugcuggaggaaaacauggaugucgagauuuggaccaaagagggagaacggaagaaacucagaccccgcuggcuggacgcccggacauauuccgacccucuugcucugagagaguuuaaggaguucgccgcuggccgccggucugugagcggggaucucauccuggagaucggaaaacugccccagcaucucacccagagagcccaaaaugcgcuugacaaccugguuaugcugcacaauuccgaacagggcgggcgggccuaccgccaugcuauggaggagcucccugauacaauugaaacccugaugcuucuggcccucaucgcugugcugacgggaggcgugacacuguuuuuccucucuggcagagggcuuggaaagaccagcauuggccugcugugugucauggccuccagcguucuccuguggauggccucuguggagccccacuggaucgcugcguccauuauccuugaauuuuuccugauggugcuccugaucccggagccugaccggcagcgcacaccccaggauaaccaacuggccuaugucgugauugggcuccuuuuuaugauccugacaguugcugccaaugagaugggacugcucgaaaccacaaagaaagaccugggcauugggcacguggccgucgagaaccaucaccaugcugccaugcuugauguggaccugcacccugcgagcgccuggacgcucuacgcugucgccaccacaaucauuacccccaugaugagacauacaaucgaaaacaccacggcuaauauuucucugaccgccaucgcgaaccaggccgcuauccugaugggacucgauaagggcuggccuauuuccaaaauggacaucggcgugccccuucuggcccuggggugcuacagccagguuaauccgcucacacugaccgcugccgugcuuaugcuggucgcucacuaugccauuaucggaccuggccuccaagcgaaggccacacgggaggcucagaaacgcaccgccgcugggauuaugaagaaccccacgguggauggaaucguugccaucgaccuggaucccguggucuacgacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaauugccgugucuauggcuaacaucuuccggggcagcuaucuggccggggccggacuggcuuucucccucaugaaaagccuuggcgggggacgcagaggcaccggggcccagggagaaacacugggcgagaaguggaaacggcagcugaaucagcucuccaagucugaauuuaacaccuacaagagaagcggcaucauggagguggaccgcuccgaagcgaaagaggggcugaagcggggagagacgacaaaacacgccguuucuagaggcaccgcuaaacuucgcugguucgucgaacggaaucuggugaaacccgaggggaaggugauugaucucggauguggcagagggggauggagcuauuacugcgccggccugaagaaagucaccgaaguuaagggcuauacaaaagggggaccuggccaugaggaacccaucccuauggcuaccuacggguggaaccuggugaagcuccacuccggaaaagacguguuuuucauucccccugagaagugugauacacuucugugcgacaucggcgagucuagcccgaaucccacgauugaagaggggcgcacccugcggguccucaaaaugguggaaccuuggcugagaggaaaccaauuuuguaucaagauucuuaaucccuacaugccuuccguuguggagacacuggagcagaugcagcgcaagcauggcggcaugcucguccggaacccccugagcagaaauucuacccacgaaauguauuggguguccugcgggacaggaaacaucguuagcgccgugaauaugaccucucgcaugcugcucaaccgguucacgauggcgcacagaaaaccgaccuacgagcgcgaugucgaccugggcgccgggacaagacauguggcuguggaaccugaggucgccaaccuugauaucauuggacagcggaucgaaaauauuaagcacgagcauaaauccaccuggcacuaugacgaggauaaccccuacaagacaugggcuuaucauggcagcuacgaaguuaaacccucuggguccgccagcuccauggugaauggaguggucaagcugcucaccaagccuugggacgugauccccaugguuacacaaauugcuaugaccgauacgacaccuuuuggccagcagcgcguguucaaagagaaggucgacaccagaaccccgaaagccaagcggggcacagcgcaaaucauggaagugacggccaaauggcuguggggguuucuuagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccugguucacagagaacgggagcuccacaaacagggcaagugcgcgaccugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcgucgagggggagggacugcacaaacucggcuacauucugagagacaucucuaagauuccugggggaaauauguaugccgaugacacagcuggcugggauacccggaucacagaagacgaucuucagaacgaggcccgcaucaccgacauuauggaacccgagcaugcgcugcucgccaaaagcaucuuuaagcugacguaccaaaauaaaguggucagagugcagcggccugcuaagaacgggaccguuauggaugugauuucccgcagagaccagcggggcucuggacaggucggcacauaugggcugaauaccuucacaaacauggaagcccaacucaucagacagauggagagcgagggaaucuuuucccccagcgaacuggagaccccgaaccuugcugaacgcgugcuggauuggcucgagaaguacggcguggaacggcugaaaagaauggccaucucuggggacgacuguguugugaagccuaucgaugaccgcuucgcgacggcccuuacagcucugaaugauaugggaaaaguccggaaggacauuccccagugggagccuuccaaaggcuggaacgauuggcagcaagugcccuuuugcagccaccacuuccaucagcucaucaugaaggacgggagagagauuguugugccuugucgcaaucaggaugaacuggucggccgggccagagugucucagggagcuggcuggucccugcgcgagaccgccugccucggaaagagcuaugcucaaauguggcagcugauguacuuucaccggagagaccuucgccuggccgcgaacgccaucuguuccgcuguccccguggauuggauuccgacaucucggaccacguggagcauccaugcccaccaucaguggaugaccacagaagacaugcucuccguuuggaauagaguguggauugaggaaaacccuuggauggaggauaaaacccacaucagcucuuggggagacguccccuaucugggcaagcgggaggaccaauggugcgggucccuuaucggacugacagccagagcuaccugggccacaaauauucagguggcgaucaaccagguucgccggcucauuggcaaugaaaacuaccuggauuacaugaccagcaugaaaagauucaagaaugagucugaccccgaaggggcucugugguga

SEQ ID NO: 19351 - RNA, 9879 nt, Artificial Sequence
  derived and/or modified CDS sequence (opt5) from DENV-1__JQ045630__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacaacccccggcacauucaagacgccggaaggggaggugggagcgauugcucucgauuuuaagccuggcaccagcgggucucccaucgugaaccgcgaaggaaaaaucgucggccuguauggcaauggggugguuacaaccuccggaaccuacgugagcgccauugcccaggcuaaggccucccaggagggcccucuucccgagaucgaagacgaggucuuccggaaaagaaaccugacaauuauggaucugcaccccgggucuggaaagacgcgccgguaucucccugcgaucgugagagaagcuauuaaacgcaagcugcggacccuuauccuggccccgacaagaguuguggccagcgagauggcugaagcccucaagggcaugcccauccgcuaccaaaccacagcugucaaauccgagcauaccgggaaggagauuguggaccugaugugccacgccacguuuacaaugcggcugcucagcccuguuagagugcccaauuauaacaugaucauuauggaugaagcgcauuucaccgacccuucuuccaucgccgcucggggcuacauuagcacccgcgucggaaugggcgaggccgcugccaucuuuaugacagccacacccccugggucuguggaggcuuucccgcagagcaaugcggugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacguuugauacagaauaccagaaaaccaagaacaacgacugggacuacguggucacaaccgauaucagcgagaugggcgcuaauuucagagccgaccgcgugauugauccucggagaugccugaaacccguuauccucaaggacgggccggaacgcgugauccuggccggcccuaugcccgucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacaccugagggcaucauucccgcccuguucgaaccugagagagaaaagagcgcugccaucgauggggaguaucgccugagaggagaggcgcggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcucaaaaugcccuugacaaccugguuaugcugcauaauuccgaacagggcgggcgggcguaucgccacgccauggaggagcucccugauaccauugaaacgcugaugcuucuggcucucaucgccgugcugacaggaggcgugacccuguucuuucucucuggcagagggcuuggaaagaccagcauuggccugcugugugucaucgcuuccagcguucuccuguggauggccucuguggagccccauuggaucgccgcuuccauuauccuugaguucuuucugauggugcuccugauuccggagccugaccggcagcgcacaccccaggauaaccaacuggcguacgucgugaucgggcuccuuuucaugauucugaccguugccgcuaaugagaugggacugcucgaaacaacgaagaaagaccugggcaucgggcacguggccgucggaaaccaccaucacgccgcuaugcuugauguggaccugcauccugccagcgcguggacccucuacgccgucgcuacaaccauuaucacacccaugaugagacacaccaucgagaacacgaccgccaauauuucucugacagcuaucgccaaccaggcggccauucugaugggccucgauaagggcuggccuaucuccaaaauggacauuggggugccccuucuggcucugggaugcuauagccagguuaauccgcucacccugacagccgcugugcuuaugcuggucgcccauuacgcuaucaucggcccugggcuccaagccaaggcgacccgggaagcccagaaacgcacggcugccggaauuaugaagaaccccacaguggauggcaucguugcuauugaccuggaucccguggucuaugacgccaaguuugagaaacagcuggggcagaucaugcuccuuauucuguguaccucucaaauccugcucaugagaacaaccugggcccugugcgaaagcaucacccuugcgacaggaccucugacgacccucugggagggcuccccgggcaaguucuggaauacaaccauugcugugucuauggccaacaucuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggauuauggaaguggaccgcuccgaggccaaagaaggacugaagcggggcgagacaaccaaacacgcgguuucuagagggaccgccaaacuucgcugguuugucgagcggaaucuggugaaacccgaaggaaaggugaucgaucucggcugugggagaggaggcuggagcuacuauugcgcuggccugaagaaagucacagagguuaagggguacaccaaaggaggcccugggcacgaagaacccauuccuauggccacauacggauggaaccuggugaagcuccauuccggcaaagacguguucuuuauucccccugaaaagugugauacgcuucugugcgacauuggggagucuagcccgaaucccaccaucgaggaaggacgcacacugcggguccucaaaaugguggagccuuggcugagaggcaaccaauucuguaucaagauucuuaaucccuauaugccuuccguuguggaaacccuggagcagaugcagcgcaagcacggcgggaugcucguccggaacccccugagcagaaauucuacacaugagauguacuggguguccugcggaaccggcaacaucguuagcgcugugaauaugacgucucgcaugcugcucaaccgguuuaccauggcccacagaaaaccgacauaugaacgcgaugucgaccugggggcgggaaccagacacguggccguggagccugaagucgcuaaccuugauauuaucggccagcggauugagaauaucaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaauugccaugacggauacaaccccuuucggccagcagcgcguguuuaaagaaaaggucgacaccagaacaccgaaagcuaagcgggggacggcccaaaucauggaggugaccgcgaaauggcuguggggauuccuuagcagaaacaagaagccccggauuuguacacgcgaagaguuuaccagaaaaguucggucuaaugccgcuaucggcgccguguucgucgacgaaaaccaguggaauagcgcuaaggaggccguggaggaugaacgcuuuugggaccugguucauagagagcgggaacuccacaaacaggggaagugcgccacaugcguguacaacaugaugggaaaacgcgagaagaagcugggcgaguucgggaaagcgaagggcuccagagcuauuugguacauguggcugggagcccgguuucucgaguucgaggcccugggcuucaugaaugaagaucacugguuuucucgcgagaacagccuuuccggggucgaaggagagggccugcauaaacucggguauauccugagagacaucucuaagauuccuggaggcaauauguacgcugaugacaccgccgggugggauacacggaucaccgaggacgaucuucagaacgaagcucgcauuacggacaucauggagcccgaacacgcccugcucgcgaaaagcauuuucaagcugaccuaucaaaauaaaguggucagagugcagcggccugccaagaacggcacaguuauggaugugaucucccgcagagaccagcggggaucuggccaggucgggaccuacggacugaauacauuuaccaacauggaggcucaacucaucagacagauggaaagcgagggcauuuucucccccagcgagcuggaaacgccgaaccuugccgagcgcgugcuggauuggcucgaaaaguaugggguggagcggcugaaaagaauggcuaucucuggagacgacuguguugugaagccuauugaugaccgcuuugccacagcgcuuaccgcccugaaugauaugggcaaaguccggaaggacaucccccagugggaaccuuccaaaggguggaacgauuggcagcaagugcccuucugcagccaucacuuucaccagcucauuaugaaggacggcagagagaucguugugccuugucgcaaucaggaugagcuggucggacgggcuagagugucucagggcgccggguggucccugcgcgaaacagcuugccucggaaagagcuacgcccaaauguggcagcugauguauuuccaucggagagaccuucgccuggcugccaacgcgauuuguuccgccguccccguggauuggaucccgaccucucggacgaccuggagcauccacgcucaucaccaguggaugacaaccgaggacaugcucuccguuuggaauagaguguggauugaagagaacccuuggauggaagauaaaacacauaucagcucuuggggcgacguccccuaccuggggaagcgggaggaccaauggugcggaucccuuauuggccugaccgccagagccacaugggcuaccaauauccagguggccauuaaccagguucgccggcucaucgggaaugagaacuaccuggauuauaugacgagcaugaaaagauuuaagaaugaaucugaccccgagggcgcgcugugguga

SEQ ID NO: 19352 - RNA, 9879 nt, Artificial Sequence
  derived and/or modified CDS sequence (opt5) from DENV-1__JQ045632__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccgagaaucacagagaccgaacccgacgauguggacuguuggugcaaugcuacggauaccugggugacauauggaaccuguucccaaacaggcgagcaccggcgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuuccuuacacaagaugaaaaggggguuacgcagaacggacggcucaucaccgcgaaucccauugugacagacaaagagaagccugucaacaucgaagcugagccgcccuuuggcgaguccuauauugugaucggggccggagaaaaagcccugaagcugagcugguucaagaaaggcucuagcauugggaagauguuugaggcuaccgccagaggcgcucgccggauggccauccucggagauacagcgugggacuucggcuccaucgggggaguguuuaccucuauuggcaaacugguucaucagaucuucgggacggccuacggaguccuuuuuagcggcguguccuggaccaugaagauugggaucggcgugcugcucacauggcugggacugaauagcagaucuaccucccuuagcaugacauguauugcugucggccucgugacccuguaccuggggguuauggugcaggccgauucuggaugcgucaucaacuggaaaggccgcgaacucaaguguggguccggaauuuucgugacaaaugagguucacaccuggacggaacaauauaaguuucaggcugacagcccuaaacggcuguccgccgcgaucggcaaggccugggaggagggggugugcggcaucagaucugcuacacgccuugaaaacauuauguggaaacagaucagcaacgagcugaaucauauucuccuggaaaacgacaugaaguucaccgucgugguuggagauguggccggcauccuggcucaggggaaaaagaugauucggccgcaacccauggagcacaaauacuccuggaagucuuggggaaaggccaaaaucaucggcgccgacguccagaauaccacauuuauuaucgaugggccuaacacccccgaauguccugacgaucagagagcuuggaauauuugggagguggaggacuauggauucggcaucuuuacgacaaacauuuggcuuaagcuccgcgauagcuacacccaggugugcgaccaccggcugauguccgcggccaucaaagauagcaaggcuguccaugccgacaugggcuauuggaucgaaucugagaaaaaugaaacauggaagcuggccagagcuuccuucauugagguuaagaccuguaucuggcccaaaagccacacacucuggucuaacggggugcuggaauccgagaugauuaucccgaagauuuacggaggcccuaucagccaacauaauuaucgccccggguacuucacccagacggccggaccuuggcaccuuggcaaacuggagcucgauuuugaccugugcgaagggaccacaguggucguggaugagcacugcggaaaccggggccccucucugagaaccacaaccguuacgggcaagaucauucaugaaugguguugccggagcuguacacuuccuccccuccgcuucagaggggaggacggaugcugguacggcauggagauccggccggugaaagaaaaggaggaaaaucuggucaaguccauggugagcgcggggucuggagagguugacuccuuuagccugggccuccuguguauuuccaucaugauugaagaggugaugagaucucgcuggagccggaaaaugcuuaugaccgggacacuggcugucuucuuucuccugaucaugggacagcugaccuggaacgaucuuauuagacugugcaucauggugggcgccaaugccuccgaccgcaugggcauggggaccacauaucucgcucugauggccacguucaagaugagaccuauguuugcgguuggacuccuguuccggcgccuuaccucuagagaggugcugcuccugacaaucggccugagccuugucgcuuccguggaacugcccaacucucucgaggaacugggggauggacucgccaugggcauuaugauccugaaacuucugaccgacuuucaaagccaccagcucugggccacacugcugucccuuaccuucauuaagacgacauuuagccugcauuacgcuuggaaaaccauggccauggugcucucuaucgucucccuguucccccucugucugagcaccacaucucagaagaccacauggcuuccuguucugcuggggucccucggaugcaagccgcugacgauguuucuuauugcugagaauaaaaucuggggccggcgcagcuggccccugaacgaaggcaucauggccguggggauugugucuauccuccuguccagccuccugaagaacgaugucccucuugcgggaccccugauugccggcgggaugcugaucgcuuguuaugugauuuccggaagcucugccgaccucagccuggagaaagcugccgagguuuccugggaagaggaagccgagcacucuggcgcuagccauaauauccuuguggaaguccaggaugacgggaccaugaagaucaaagaugaggagagagacgauacacugaccauucuccugaaggcgacacuccuggccguguccggaguuuacccucuuucuauccccgcuacccuguucgugugguauuucuggcagaagaagaagcagcggagcggcguccugugggacacgccuagcccucccgaaguggagcgcgccguccucgaugacggcauuuacagaaucaugcagcgggggcugcuuggacgcucucaggugggcguugggguguuucaagaaaacgucuuccacaccauguggcacgugacaagaggagccguucugauguaucagggcaaacggcucgagcccagcugggcuuccgugaagaaagaccugauuagcuacgggggaggcuggagacuccagggcucuuggaauaccggggaggaaguccaggugaucgccguggagcccggaaagaacccuaaaaauguucaaacagcgcccggcaccuuuaagacaccggaaggggaggucggagcuauugcccuggauuucaagccuggcacguccgggagccccaucgugaaccgcgaaggaaaaaucgugggccuuuacggcaauggggucgugaccacaucuggaaccuauguuuccgccauugcucaggccaaggcgagccaggagggcccucugcccgagaucgaagacgagguguuucggaaaagaaaccugaccauuauggaucuccaucccggguccggaaagacacgccgguaccugccugcuaucgucagagaagccauuaaacgcaaacuucggacgcugauccucgccccgaccagagugguugcuucugagauggccgaagcucugaagggcaugcccauccgcuaucaaacaaccgccgugaaaagcgagcacacagggaaggagauugucgaccugaugugccaugcgaccuucacgaugcggcuccuuuccccugugagaguucccaauuacaacaugaucauuauggaugaagcccacuuuacagacccuagcucuaucgcugcccggggcuauauuuccacccgcgugggaaugggcgaggcugccgccaucuucaugaccgcuacacccccugggagcgucgaagcguuuccgcagucuaaugccgugauccaggaugaggaaagagacauucccgagcggagcuggaacuccggauacgaguggaucaccgauuucccuggcaaaacagugugguuuguccccucuauuaagagcgggaaugacaucgcuaacugucugaaaaagaauggaaagcgcguuauucagcuguccagaaaaaccuucgauacggaauaucaaaagaccaagaauaacgacugggacuacguggugaccacagauaucucugagaugggcgccaauuuccgggccgacagagucauugauccucgccggugccucaagcccgugauccugaaagacgggccggaaagaguuauccuugcuggcccuaugcccgugaccgucgccagcgcggcucagcgccggggaagaauuggccgcaaccauaauaaggagggggaucaguacaucuauaugggacagccccugaacaaugacgaggaucacgcccacuggacggaagccaagaugcuccuggacaacauuaauaccccugagggcaucauucccgcucuguuugaaccugagcgggaaaaauccgccgcgaucgauggggaguacagacuccgcggagaggccagaaagacauucguggaacuuaugcggcgcggcgaccugccgguuuggcugagcuauaaaguggcuucugagggguuucaauacuccgauagacgguggugcuucgacggcgaacgcaacaaucagguccucgaggaaaacauggauguggagaucuggaccaaggagggagaacgcaaaaagcugcggcccagauggcuugacgcccgcacauauagcgacccucuggcucuccgggaguuuaaagaguucgccgcuggcagacgcuccgucucuggggaucugauucuggagaucggaaagcucccccagcaucuuacccagcgggcccaaaaugcgcuggacaaccuggugaugcuccacaauagcgaacagggcgggagagccuaccggcaugcuauggaggagcugccugauacaauugaaacccuuauccugcucgcccugauugcuguucugacgggaggcgugacacucuuuuuccuuuccggccgcgggcugggaaagaccucuaucggccugcucugugugauggccagcuccguccugcuuuggauggccagcguugagccccacuggaucgcugcgucuauuauccuggaauuuuuccucauggugcugcugauuccggagccugacagacagcggacaccccaggauaaccaacucgccuauguggucaucgggcuucuguuuaugauucugacaguggcugccaaugagaugggacuccuggaaaccaccaaaaaggaccuuggcaucgggcacguugccguggagaaccaucaccaugcugccaugcuggaugucgaccuccacccugcguccgccuggacgcuguacgcuguggccaccacaauuaucacccccaugaugcgccauacaaucgaaaacaccacggcuaauauuagccugaccgccaucgcgaaccaggccgcuauucucaugggacuugauaaaggcuggccuaucucuaagauggacauuggcgucccccugcuggcccucgggugcuacucccaggugaauccgcugacacuuaccgcugccguucugaugcucguggcucacuaugccaucaucggaccuggccugcaagcgaaagccacaagagaggcucagaagcggaccgccgcugggauuaugaagaaccccacggucgauggaaucguggccauugaccuggaucccguuguguacgacgccaaauucgaaaagcagcucggccagaucaugcuucugauucuguguacaagccaaauccuccugaugcgcaccacaugggcgcuuugcgagucuaucacccuggcuaccgggccucucacaacgcugugggagggaagcccgggcaaauuuuggaauaccacaauugccgucuccauggcuaacaucuucagaggcucuuaucuggccggggccggacucgcuuucagccuuaugaagucccugggcgggggacggcgcggcaccggggcccagggagaaacacugggcgagaaauggaagagacagcucaaucagcugagcaaguccgaauuuaacaccuacaaacggucuggcauuauggagguggacagaagcgaagcgaaggaggggcuuaaacgcggagagacgacaaagcacgccgugucccggggcaccgcuaaacugagaugguucguugaacgcaaucucgucaagcccgaggggaaggugaucgaucugggauguggcagagggggauggucuuauuacugcgccggccugaaaaaggugaccgaagucaaaggcuauacaaaagggggaccuggccaugaggaacccauuccuauggcuaccuacggguggaaccucguuaaacuucacagcggaaaggacguguuuuucauucccccugagaaaugugauacacugcugugcgacauuggcgaguccucuccgaaucccacgaucgaagaggggagaacccuccgcgugcugaagauggucgaaccuuggcuucggggaaaccaauuuuguaucaaggugcugaaucccuacaugccuagcguuguggagacacucgagcagaugcagagaaaacauggcggcaugcugguccgcaacccccugucccggaauagcacccacgaaauguauugggugucuugcgggacaggaaacauuguuuccgccgugaauaugaccagcagaaugcuccugaaccgcuucacgauggcgcaccggaagccgaccuacgagagagaugucgaccuuggcgccgggacacgccauguggcuguggaaccugaggucgccaaccuggauaucauuggacagagaaucgaaaauauuaaacacgagcauaagucuaccuggcacuaugacgaggauaaccccuacaaaacaugggcuuaucauggcuccuacgaaguuaagcccagcgggucugccuccagcauggugaauggaguggucaagcuccugaccaaaccuugggacgugauccccaugguuacacaaaucgcuaugaccgauacgacaccuuuuggccagcagcggguguucaaggagaaagucgacacccgcaccccgaaggccaaaagaggcacagcgcaaauuauggaagugacggccaaguggcuuuggggguuucugucccggaacaagaaacccagaaucuguacccgggaggaguucacacgcaagguuagaagcaaugcugccauuggagcuguguuugucgacgagaaccaguggaacucugccaaagaggccguggaagaugagcgguucugggaccucguucaccgcgaaagagagcugcacaagcagggcaaaugcgcgaccugcguguauaacaugauggggaagcgggaaaagaaacugggagaguuuggcaaggcuaaagggagccgcgccaucugguacauguggcucggcgccagauuccuggaguucgaagcucuuggauuuaugaaugaggaucauugguucucccgggaaaacucucugagcggcgucgagggggagggacuccacaagcugggcuacauucuucgcgacaucuccaaaaucccugggggaaauauguaugccgaugacacagcuggcugggauaccagaauuacagaagacgaucugcagaacgaggcccggaucaccgacauuauggaacccgagcaugcgcuccuggccaagucuaucuuuaaacugacguaccaaaauaaggugguccgcgugcagagaccugcuaagaacgggaccguuauggaugugauuagccggcgcgaccagagaggcuccggacaggucggcacauaugggcucaauaccuucacaaacauggaagcccaacugauccggcagauggagucugagggaaucuuuagccccuccgaacuugagaccccgaaccuggcugaaagagugcucgauuggcuggagaaauacggcguggaacgccuuaagcggauggccauuagcggggacgacuguguugugaaaccuaucgaugacagauucgcgacggcccugacagcucucaaugauaugggaaagguccgcaaagacauuccccagugggagccuucuaagggcuggaacgauuggcagcaagugcccuuuugcucccaccacuuccaucagcugaucaugaaggacgggcgggagauuguugugccuuguagaaaucaggaugaacuggucggccgcgcccgggugagccagggagcuggcuggucucucagagagaccgccugccuggggaaauccuaugcucaaauguggcagcuuauguacuuucaccgccgggaccugagacucgccgcgaacgccaucuguagcgcuguccccguggauuggauuccgacaucccgcaccacguggucuauccaugcccaccaucaguggaugaccacagaagacaugcugagcguuuggaaucggguguggaucgaggaaaacccuuggauggaggauaagacccacauuuccagcuggggagacguccccuaucuuggcaaaagagaggaccaauggugcgggucucugaucggacucacagcccgggcuaccugggccacaaauauucagguggcgaucaaccagguuagacgccugauuggcaaugaaaacuaccuggauuacaugaccuccaugaagcgguucaaaaaugagagcgaccccgaaggggcucucugguga

SEQ ID NO: 19353 - RNA, 9879 nt, Artificial Sequence
  derived and/or modified CDS sequence (opt5) from DENV-1__JQ045633__SS-prME
agcgugaccaugcugcugaugcugaugcccaccgcccuugcuuuccaccugacgaccagaggcggggaaccucauaugaucguguccaagcaggaacgggggaagucucuccuguuuaagacaagcgccggcguuaacaugugcacccuuauugcgauggaccugggggagcucugugaagauacaaugaccuacaagugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaagcagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucgccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaaggggguuacacagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcguuggcaaacucguccaucagauuuucggggcugccuacggagugcuguuuuccggcgugagcuggaccaugaagaucgggauuggcguccuucugacguggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacagaacaauauaaguuucaggcggacuccccuaaacggcucucugccgcuauuggcaaggccugggaggagggggucugcggcaucagaagcgcuacccgccuggaaaacaucauguggaaacagauuuccaacgagcuuaaucauauccugcucgaaaacgacaugaaguucacggugguugugggagaugucgccggcauucuggcccaggggaaaaagaugauccggccgcaacccauggaguacaaauauucuuggaaaagcuggggaaaggcuaagauuaucggcgcggacgugcagaauacaaccuuuaucauugaugggcagaacaccccugaaugucccgacgaucagagagccuggaauaucugggagguggaggacuacggauucggcauuuuuacaaccaacaucuggcugaaacuucgcgauuccuauacgcaagucugcgaccaccggcucaugagcgcugccauuaaagauucuaaggccguucacgcugacaugggcuacuggaucgaauccgagaaaaaugaaacauggaagcuggccagagcgagcuucaucgaggugaagaccuguauuuggccuaaaucucauacacugugguccaacggggugcucgaaagcgagaugaucauucccaagaucuauggaggcccgauuucucagcacaauuaccgcccuggguacuucacccagacagcuggacccuggcaucugggcaaacuugagcuggauuuugaccucugcgaagggaccacggucgugguugaugagcacugcggaaaccggggcccuagccugagaaccacaaccgugacaggcaagaucauccacgaaugguguugccgguccuguacccugcccccucuucgcuucagaggggaggacggaugcugguauggcauggagauucggcccgucaaagaaaaggaggaaaaucucgucaagagcaugguuucugccggguccggagagguggacagcuuuucccugggccugcucuguaucucuauuaugaucgaagaggucaugagaagccgcuggucccggaaaaugcugaugacggggacacuugccguguuccugcuccugauuaugggacaacugaccuggaacgaucuuaucagacugugcauuaugguuggcgcuaaugccucugaccgcaugggcauggggacaaccuaccucgcgcugauggcuaccuuuaagaugagaccgauguucgccgugggacuccuguuucggcgccuuacaagcagagagguccugcuccugacgaucggccugucccuuguggccucuguggaacugccuaacagccucgaggaacugggggauggacucgcuaugggcaucaugauucugaaacuucugaccgacuuccagucccaucagcucugggccacacugcugagccuuaccuuuaucaagacaaccuucucucugcacuaugcuuggaaaacgauggccaugguccucuccauuguuagccuguuuccccucugucugucuacaaccucccagaagaccacauggcuucccgugcugcuggggagccucggaugcaagccucugaccauguuccuuaucgcggagaauaaaauuuggggccggcgcucuuggccgcugaacgaaggcaucauggccguggggaucgucuccauucuccugagcucccuccugaagaacgaugugccccuugcuggaccucugaucgccggcgggaugcugauugcuuguuacguuaucagcggaucuagcgccgaccucucccuggagaaagccgcugaggugucuugggaagaggaagcggagcauagcggcgccucccacaauauucuugucgaagugcaagaugacgggacaaugaagaucaaagaugaggagagagacgauacgcugaccauccuccugaaggcuacacuccuggccguuucuggaguguauccccuuagcauuccugccacccuguuugucugguacuucuggcagaaaaagaagcagcgguccggcgugcugugggacacacccucuccucccgaagucgagcgcgcugugcucgaugacggcaucuauagaauuaugcagcgggggcugcuuggacgcagccaaguuggcgugggggucuuccaggaaaacguguuucauaccauguggcacguuacgagaggagccgugcugauguaccagggcaaacggcucgagccguccugggcgagcgucaagaaagaccugaucucuuacgggggaggcuggagacuccagggcuccuggaauaccggggaggaagugcaagugauugcuguugagccuggaaagaaccccaaaaauguccagacagccccuggcaccuucaagacacccgaaggggaggugggagccaucgcucuggauuuuaagccgggcaccagcgggucuccuauugugaaccgcgaaggaaaaaucgucggccuuuauggcaauggggugguuacaacguccggaaccuacgugagcgccaucgcgcaggcuaaggucucccaagagggcccccugccugagauugaagacgagguguuccggaaaagaaaccugacaaucauggaucuccaccccgggucuggaaagacccgccgguaucugcccgccauuguuagagaagccaucaaacgcaaacuucggacccugauucucgcuccuacaagaguggucgccagcgagauggcugaagcccugaagggcaugccgauccgcuaccagacgaccgcggugaaauccgagcauacagggaaggagaucguugaccugaugugccacgccaccuuuacaaugcggcuccuuagccccgugagagucccuaauuauaacaugauuaucauggaugaagcucauuucaccgaccccucuuccauugccgcucggggcuacaucagcacgcgcgugggaaugggcgaggccgccgcuauuuuuaugacagcgaccccucccgggucuguggaagccuucccucagagcaaugcugucauccaggaugaggaaagagacaucccggagcgguccuggaacucuggauaugaguggauuaccgauuuucccggcaaaacaguuugguucgugccuagcaucaaguccgggaaugacauugccaacugucugcgcaaaaauggaaagagagugauccaacugucucggaagaccuuugauacagaauaccagaaaaccaagaacaacgacugggacuacgucgugacgacagauauuagcgagaugggcgccaauuucagagcugaccgcguuaucgauccccggagaugccucaaaccugugauucugaaggacgggcccgaacgcgucauccuugccggcccgaugccugugaccguugcguccgcugcccagcggagaggacgcaucggccggaaccacaauaaagagggggaucaguauauuuacaugggacaaccccugaacaaugacgaggaucaugcccacuggacagaagcuaagaugcuccuggacaacaucaauacccccgagggcauuaucccugcccuguucgaacccgagagagaaaagagcgcggccauugauggggaguaucgccucagaggagaggcucggaaaacguuuguggaacuuaugcgcagaggcgaccugccugucuggcugucuuacaagguggccuccgagggguuccaguauagcgaucggcgcuggugcuuugacggcgaaagaaacaaucagguccucgaggaaaacauggauguggagaucuggaccaaagagggagaacggaagaaacugagaccgcgcuggcuugacgcucggacauacuccgacccccuggcccucagagaguucaaggaauuugcugccggccgccggucuguuagcggggaucugauccuggagauuggaaaacucccucagcaccuuacccaaagagcgcagaaugcccuggacaaccuggugaugcuccauaauuccgaacagggcgggcgggcuuaucgccacgccauggaggagcugcccgauacaaucgaaacccuuaugcugcucgcucugauugccgugcugacaggaggcgucacccucuucuuucuuucuggcagagggcugggaaagacgagcaucggccugcucuguguuauggccuccagcgugcugcuuuggauggcuucuguggagccucauuggauugcggccuccaucauccuggaguucuuucucaugguccugcugauucccgagccggaccggcagcgcacaccucaagauaaccagcucgcuuacgugguuaucgggcuucuguucaugauucugaccguggccgccaaugagaugggacuccuggaaaccacaaagaaagaccuuggcaucgggcacgucgcuguggagaaccaccaucacgccgcgaugcuggaugucgaccuccaucccgccagcgcuuggacccuguacgccguggcuacaacgauuaucaccccuaugaugagacacacaauugaaaacaccacagccaauaucucucugaccgcgaucgccaaccaggcugccauucucaugggacuugauaagggcuggcccaucuccaaaauggacauuggcguuccucugcuggcucucgggugcuauagccaagugaauccccugacgcuuaccgccgcuguccugaugcucguggcccauuacgcgaucauuggaccgggccugcaggccaaggcuacacgggaggcccagaaacgcaccgcugccgggaucaugaagaacccuacaguugauggaaucguggccauugaccuggaucccgucguguaugacgcgaaguuugaaaaacagcucggccaaaucaugcuucugauucuguguaccucucagauccuccugaugagaacgacaugggcucuuugcgagagcauuacccuggccacagggccccucaccacccugugggagggauccccuggcaaguucuggaauacaacgaucgcugugucuauggccaacaucuuucggggcagcuaccuggccggggcuggacucgccuucucccuuaugaaaagccugggcgggggacgcagaggcaccggggcgcagggagaaacacugggcgagaaguggaaacggcagcucaaucaacuguccaagucugaguucaacaccuauaagagaagcggcauuauggagguugaccgcuccgaagccaaagaggggcuuaagcggggagagacaaccaaauacgcugucucuagaggcacggccaagcugcgcugguuuguggaacggaaucucgugaaaccggaggggaaggucaucgaucugggauguggcagagggggauggagcuauuacugcgcuggccugaagaaaguuacagaagugaagggcuacaccaaagggggacccggccacgaggaaccuauucccauggccaccuauggguggaaccucgugaaacuucacuccggaaaagacgucuucuuugugccucccgagaagugugauacacugcugugcgacaucggcgagucuagcccuaauccgaccauugaagaggggcgcacacuccggguucugaaaaugguggaacccuggcuuagaggaaaccaguucuguaucaagauucugaauccuuacaugcccuccgucguggagacgcucgagcagaugcagcgcaagcauggcggcaugcugguucggaacccucugagcagaaauucuacccacgaaauguauuggguguccugcgggacaggaaacaucgucagcgcggugaauaugaccucucgcaugcuccugaaccgguuuacaauggcccauagaaaacccaccuacgagcgcgauguggaccuuggcgcugggacgagacacgucgccguugaaccggagguggcuaaccuggauaucauuggacaacggaucgaaaauauuaagcacgagcauaaauccaccuggcacuaugacgaggauaacccuuacaagacaugggccuaucauggcagcuacgaagugaaacccucuggguccgcuagcuccauggucaauggagugguuaagcuccugaccaagcccugggacgugaucccuauggucacacagauugccaugaccgauacaacccccuucggccagcaacgcguguuuaaagagaagguugacacgagaacaccuaaagcgaagcggggcaccgcccagaucauggaagugaccgcuaaauggcuuuggggguuccugagcagaaacaagaagccgcggaucuguacacgcgaggaauuuacgagaaaaguccggucuaaugccgcuauuggagccguguucguugacgagaaccaguggaauagcgccaaggaggcgguggaagaugagcgcuuuugggaccucguccacagagaacgggagcugcauaaacagggcaagugcgcuaccugcguguacaacaugauggggaaacgcgaaaagaagcugggagaguucggcaaagccaagggguccagagccaucugguauauguggcucggcgcucgguuucuggaguucgaagcccuuggauucaugaaugaggaucacugguuuucucgcgaaaacagccuguccggcgucgagggggagggacuccacaaacugggcuacauucuuagagacaucucuaagauucccgggggaaauauguaugcugaugacacagccggcugggauacccggaucacagaagacgaucugcaaaacgaggcgcgcaucaccgacauuauggaaccugagcaugcccuccuggcuaaaagcaucuucaagcugacauaccagaauaaagugguuagagugcagcggcccgccaagaacgggaccgucauggaugugauuucccgcagagaccagcggggcucuggacaagugggcacguaugggcucaauaccuuuacaaacauggaagcucagcugaucagacagauggagagcgagggaauuuucuccccuagcgaacuugagacccccaaccuggccgaacgcguucucgauuggcuggagaaguacggcguggaacggcuuaaaagaauggcgaucucuggggacgacugugucgugaagccgaucgaugaccgcuuugccacagcucugaccgcccucaaugauaugggaaaaguucggaaggacauuccucagugggagcccuccaaaggcuggaacgauuggcaacaggugccuuucugcagccaccauuuucaccagcugaucaugaaggacgggagagagauugucgugcccugucgcaaucaggaugaacuggucggccgggcuagagugucucaaggagccggcuggucccuccgcgagacggcuugccugggaaagagcuaugcccagauguggcagcuuauguacuuccaccggagagaccugcgccucgcggccaacgcuaucuguuccgccguuccuguggauuggauucccacaucucggaccacauggagcauccaugcccaccaucaauggaugaccacggaagacaugcuguccgucuggaauagaguguggauugaggaaaacccguggauggaggauaaaacccacaucagcucuuggggagacguuccuuaccuuggcaagcgggaggaccaguggugcgggucccugaucggacucacagcuagagccaccugggcgacaaauauucagguggcuaucaaccagguccgccggcugauuggcaaugaaaacuaucuggauuacaugaccagcaugaaaagauuuaagaaugagucugaccccgaaggggcccucugguga

SEQ ID NO: 19354 - RNA, 9879 nt, Artificial Sequence
  derived and/or modified CDS sequence (opt5) from DENV-1__JQ045634__SS-prME
agcgugaccaugcugcugaugcugaugcccaccgcccuugcuuuccaccugacgaccagaggcggggaaccucauaugaucguguccaagcaggaacggggaaagucucuccuguuuaagacaagcgccggcguuaauaugugcacccuuauugccauggaccugggggagcucugugaagauacaaugaccuacaagugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaagcagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucgccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaaggggguuacacagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcguuggcaaacucguccaucagauuuucggggcugccuacggagugcuguuuuccggcgugagcuggaccaugaagaucgggauuggcguccuucugacguggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacagaacaauauaaguuucaggcggacuccccuaaacggcucucugccgcuauuggcaaggccugggaggagggggucugcggcaucagaagcgcuacccgccuggaaaacaucauguggaaacagauuuccaacgagcuuaaucauauccugcucgaaaacgacaugaaguucacggugguugugggagaugucgccggcauucuggcccaggggaaaaagaugauccggccgcaacccauggaguacaaauauucuuggaaaagcuggggaaaggcuaagauuaucggcgcggacgugcagaauacaaccuuuaucauugaugggcagaacaccccugaaugucccgacgaucagagagccuggaauaucugggagguggaggacuacggauucggcauuuuuacaaccaacaucuggcugaaacuucgcgauuccuauacgcaagucugcgaccaccggcucaugagcgcugccauuaaagauucuaaggccguucacgcugacaugggcuacuggaucgaauccgagaaaaaugaaacauggaagcuggccagagcgagcuucaucgaggugaagaccuguauuuggccuaaaucucauacacugugguccaacggggugcucgaaagcgagaugaucauucccaagaucuauggaggcccgauuucucagcacaauuaccgcccuggguacuucacccagacagcuggacccuggcaucugggcaaacuugagcuggauuuugaccucugcgaagggaccacggucgugguugaugagcacugcggaaaccggggcccuagccugagaaccacaaccgugacaggcaagaucauccacgaaugguguugccgguccuguacccugcccccucuucgcuucagaggggaggacggaugcugguauggcauggagauucggcccgucaaagaaaaggaggaaaaucucgucaagagcaugguuucugccggguccggagagguggacagcuuuucccugggccugcucuguaucucuauuaugaucgaagaggucaugagaagccgcuggucccggaaaaugcugaugacggggacacuugccguguuccugcuccugauuaugggacaacugaccuggaacgaucuuaucagacugugcauuaugguuggcgcuaaugccucugaccgcaugggcauggggacaaccuaccucgcgcugauggcuaccuuuaagaugagaccgauguucgccgugggacuccuguuucggcgccuuacaagcagagagguccugcuccugacgaucggccugucccuuguggccucuguggaacugccuaacagccucgaggaacugggggauggacucgcuaugggcaucaugauucugaaacuucugaccgacuuccagucccaucagcucugggccacacugcugagccuuaccuuuaucaagacaaccuucucucugcacuaugcuuggaaaacgauggccaugguccucuccauuguuagccuguuuccccucugucugucuacaaccucccagaagaccacauggcuucccgugcugcuggggagccucggaugcaagccucugaccauguuccuuaucgcggagaauaaaauuuggggccggcgcucuuggccgcugaacgaaggcaucauggccguggggaucgucuccauucuccugagcucccuccugaagaacgaugugccccuugcuggaccucugaucgccggcgggaugcugauugcuuguuacguuaucagcggaucuagcgccgaccucucccuggagaaagccgcugaggugucuugggaagaggaagcggagcauagcggcgccucccacaauauucuugucgaagugcaagaugacgggacaaugaagaucaaagaugaggagagagacgauacgcugaccauccuccugaaggcuacacuccuggccguuucuggaguguauccccuuagcauuccugccacccuguuugucugguacuucuggcagaaaaagaagcagcgguccggcgugcugugggacacacccucuccucccgaagucgagcgcgcugugcucgaugacggcaucuauagaauuaugcagcgggggcugcuuggacgcagccaaguuggcgugggggucuuccaggaaaacguguuucauaccauguggcacguuacgagaggagccgugcugauguaccagggcaaacggcucgagccguccugggcgagcgucaagaaagaccugaucucuuacgggggaggcuggagacuccagggcuccuggaauaccggggaggaagugcaagugauugcuguugagccuggaaagaaccccaaaaauguccagacagccccuggcaccuucaagacacccgaaggggaggugggagccaucgcucuggauuuuaagccgggcaccagcgggucuccuauugugaaccgcgaaggaaaaaucgucggccuuuauggcaauggggugguuacaacguccggaaccuacgugagcgccaucgcgcaggcuaaggucucccaagagggcccccugccugagauugaagacgagguguuccggaaaagaaaccugacaaucauggaucuccaccccgggucuggaaagacccgccgguaucugcccgccauuguuagagaagccaucaaacgcaaacuucggacccugauucucgcuccuacaagaguggucgccagcgagauggcugaagcccugaagggcaugccgauccgcuaccagacgaccgcggugaaauccgagcauacagggaaggagaucguugaccugaugugccacgccaccuuuacaaugcggcuccuuagccccgugagagucccuaauuauaacaugauuaucauggaugaagcucauuucaccgaccccucuuccauugccgcucggggcuacaucagcacgcgcgugggaaugggcgaggccgccgcuauuuuuaugacagcgaccccucccgggucuguggaagccuucccucagagcaaugcugucauccaggaugaggaaagagacaucccggagcgguccuggaacucuggauaugaguggauuaccgauuuucccggcaaaacaguuugguucgugccuagcaucaaguccgggaaugacauugccaacugucugcgcaaaaauggaaagagagugauccaacugucucggaagaccuuugauacagaauaccagaaaaccaagaacaacgacugggacuacgucgugacgacagauauuagcgagaugggcgccaauuucagagcugaccgcguuaucgauccccggagaugccucaaaccugugauucugaaggacgggcccgaacgcgucauccuugccggcccgaugccugugaccguugcguccgcugcccagcggagaggacgcaucggccggaaccacaauaaagagggggaucaguauauuuacaugggacaaccccugaacaaugacgaggaucaugcccacuggacagaagcuaagaugcuccuggacaacaucaauacccccgagggcauuaucccugcccuguucgaacccgagagagaaaagagcgcggccauugauggggaguaucgccucagaggagaggcucggaaaacguuuguggaacuuaugcgcagaggcgaccugccugucuggcugucuuacaagguggccuccgagggguuccaguauagcgaucggcgcuggugcuuugacggcgaaagaaacaaucagguccucgaggaaaacauggauguggagaucuggaccaaagagggagaacggaagaaacugagaccgcgcuggcuugacgcucggacauacuccgacccccuggcccucagagaguucaaggaauuugcugccggccgccggucuguuagcggggaucugauccuggagauuggaaaacucccucagcaccuuacccaaagagcgcagaaugcccuggacaaccuggugaugcuccauaauuccgaacagggcgggcgggcuuaucgccacgccauggaggagcugcccgauacaaucgaaacccuuaugcugcucgcucugauugccgugcugacaggaggcgucacccucuucuuucuuucuggcagagggcugggaaagacgagcaucggccugcucuguguuauggccuccagcgugcugcuuuggauggcuucuguggagccucauuggauugcggccuccaucauccuggaguucuuucucaugguccugcugauucccgagccggaccggcagcgcacaccucaagauaaccagcucgcuuacgugguuaucgggcuucuguucaugauucugaccguggccgccaaugagaugggacuccuggaaaccacaaagaaagaccuuggcaucgggcacgucgcuguggagaaccaccaucacgccgcgaugcuggaugucgaccuccaucccgccagcgcuuggacccuguacgccguggcuacaacgauuaucaccccuaugaugagacacacaauugaaaacaccacagccaauaucucucugaccgcgaucgccaaccaggcugccauucucaugggacuugauaagggcuggcccaucuccaaaauggacauuggcguuccucugcuggcucucgggugcuauagccaagugaauccccugacgcuuaccgccgcuguccugaugcucguggcccauuacgcgaucauuggaccgggccugcaggccaaggcuacacgggaggcccagaaacgcaccgcugccgggaucaugaagaacccuacaguugauggaaucguggccauugaccuggaucccgucguguaugacgcgaaguuugaaaaacagcucggccaaaucaugcuucugauucuguguaccucucagauccuccugaugagaacgacaugggcucuuugcgagagcauuacccuggccacagggccccucaccacccugugggagggauccccuggcaaguucuggaauacaacgaucgcugugucuauggccaacaucuuucggggcagcuaccuggccggggcuggacucgccuucucccuuaugaaaagccugggcgggggacgcagaggcaccggggcgcagggagaaacacugggcgagaaguggaaacggcagcucaaucaacuguccaagucugaguucaacaccuauaagagaagcggcauuauggagguugaccgcuccgaagccaaagaggggcuuaagcggggagagacaaccaaauacgcugucucuagaggcacggccaagcugcgcugguuuguggaacggaaucucgugaaaccggaggggaaggucaucgaucugggauguggcagagggggaugggcuuauuacugcgccggccugaagaaaguuacagaagugaagggcuacaccaaagggggacccggccacgaggaaccuauucccauggcgaccuauggguggaaccucgugaaacuucacagcggaaaagacgucuucuuugugccucccgagaagugugauacacugcugugcgacaucggcgaguccucuccuaauccgaccauugaagaggggcgcacacuccggguucugaaaaugguggaacccuggcuuagaggaaaccaguucuguaucaagauucugaauccuuacaugcccagcgucguggagacgcucgagcagaugcagcgcaagcauggcggcaugcugguucggaacccucuguccagaaauagcacccacgaaauguauugggugucuugcgggacaggaaacaucgucuccgccgugaauaugaccagccgcaugcuccugaaccgguuuacaauggcucauagaaaacccaccuacgagcgcgauguggaccuuggcgccgggacgagacacgucgcuguugaaccggagguggccaaccuggauaucauuggacaacggaucgaaaauauuaagcacgagcauaaaucuaccuggcacuaugacgaggauaacccuuacaagacaugggcuuaucauggcuccuacgaagugaaacccagcgggucugccuccagcauggucaauggagugguuaagcuccugaccaagcccugggacgugaucccuauggucacacagauugcgaugaccgauacaacccccuucggccagcaacgcguguuuaaagagaagguugacacgagaacaccuaaagccaagcggggcaccgcucagaucauggaagugaccgccaaauggcuuuggggguuccuguccagaaacaagaagccgcggaucuguacacgcgaggaauuuacgagaaaaguccggagcaaugcugccauuggagccguguucguugacgagaaccaguggaacucugcgaaggaggcuguggaagaugagcgcuuuugggaccucguccacagagaacgggagcugcauaaacagggcaagugcgcgaccugcguguacaacaugauggggaaacgcgaaaagaagcugggagaguucggcaaagccaaggggagcagagcuaucugguauauguggcucggcgcccgguuucuggaguucgaagcucuuggauucaugaaugaggaucacugguuuucccgcgaaaacucucugagcggcgucgagggggagggacuccacaaacugggcuacauucuuagagacaucuccaagauucccgggggaaauauguaugccgaugacacagcgggcugggauacccggaucacagaagacgaucugcaaaacgaggcccgcaucaccgacauuauggaaccugagcaugcucuccuggccaaaucuaucuucaagcugacauaccagaauaaagugguuagagugcagcggcccgcuaagaacgggaccgucauggaugugauuagccgcagagaccagcggggcuccggacaagugggcacguaugggcucaauaccuuuacaaacauggaagcccagcugaucagacagauggagucugagggaauuuucagcccuuccgaacuugagacccccaaccuggcggaacgcguucucgauuggcuggagaaguacggcguggaacggcuuaaaagaauggccaucagcggggacgacugugucgugaagccgaucgaugaccgcuuugcuacagcccugaccgcucucaaugauaugggaaaaguucggaaggacauuccucagugggagcccucuaaaggcuggaacgauuggcaacaggugccuuucugcucccaccauuuucaccagcugaucaugaaggacgggagagagauugucgugcccugucgcaaucaggaugaacuggucggccgggccagagugagccaaggagcuggcuggucucuccgcgagacggccugccuggggaaguccuaugcgcagauguggcagcuuauguacuuccaccggagagaccugcgccucgccgcuaacgccaucuguagcgccguuccuguggauuggauucccacaucccggaccacauggucuauccaugcucaccaucaauggaugaccacggaagacaugcugagcgucuggaauagaguguggauugaggaaaacccguggauggaggauaaaacccacaucuccagcuggggagacguuccuuaccuuggcaagcgggaggaccaguggugcgggucucugaucggacucacagccagagcgaccugggcuacaaauauucagguggccaucaaccagguccgccggcugauuggcaaugaaaacuaucuggauuacaugaccuccaugaaaagauuuaagaaugagagcgaccccgaaggggcccucugguga

SEQ ID NO: 19355 - RNA, 9879 nt, Artificial Sequence
  derived and/or modified CDS sequence (opt5) from DENV-1__JQ045636__SS-prME
agcgugaccaugcugcugaugcugaugcccacagcucuugcuuuccaccugacgacccggggaggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccauugcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgccaggaccuucuggugaccuuuaaaacagcgcacgccaagaagcaggaagucgugguucucggaucccaagagggcgcuaugcacaccgcccugaccggggccacagaaauccagacgagcggaaccacaaccauuuucgcuggccaucugaaaugcagacucaagauggauaaacugacacuuaaggggaugucuuaugugauguguaccggcuccuucaaacuggagaaggaagucgccgagacgcagcacggaacagugcucguucagaucaaguacgagggcaccgacgcgccgugcaaaaucccuuuuagcacccaagaugaaaagggggcuacacagaacggacggcugauuaccgccaaucccaucgugacagacaaagagaagccugucaacauugaagccgagccgcccuucggcgagucuuauaucgugauuggggcuggagaaaaagcccugaaacuuagcugguuuaagaaaggcuccucuaucgggaagauguucgaggcuacggccagaggcgcgcgccggauggccauccucggagauaccgcuugggacuuuggcagcauugggggaguguucacauccguuggcaaacugguccaucagaucuuugggaccgccuacggagugcuguucagcggcgugucuuggacaaugaagauugggaucggcguccuccugaccuggcuuggacucaauuccagaagcacgucucucuccaugaccuguauugcugugggccugguuacacuguaccuuggggugaugguccaggccgauagcggaugcgugaucaacuggaaaggccgcgaacucaaguguggguccggaauuuuuguuaccaaugaggugcacacauggaccgaacaauauaaguuccaggcggacucuccuaaacggcugagcgccgcuaucggcaaggccugggaggagggggucugcggcaucagauccgcuacacgccuggaaaacauuauguggaaacagaucucuaacgagcucaaucauauucugcuugaaaacgacaugaagcugaccgugguugugggagaugucgccggcauccucgcccaggggaaaaagaugauucggccgcaacccauggaguacaaauauagcuggaaguccuggggaaaggcuaaaaucaucggcgcggacgugcagaauacgacauuuauuaucgaugggccuaacacccccgaauguccugacgaucagagagccuggaauauuugggagguggaggacuacggauucggcaucuuuaccacaaacauuuggcugaagcugcgcgauagcuauacccaggucugcgaccaccggcuuaugucugcugccaucaaagauuccaaggccguucacgcugacaugggcuacuggaucgaaagcgagaaaaaugaaacguggaagcucgccagagcgucuuucauugaggugaagacauguaucuggcccaaaucccauacccuguggagcaacggggugcuggaaucugagaugauuaucccgaagauuuauggaggcccuaucagccaacacaauuaccgccccggguacuucacacagaccgcuggaccuuggcaucucggcaaacuggagcuugauuuugaccugugcgaagggacaaccgucgugguugaugagcacugcggaaaccggggccccucccucagaacgaccacagugaccggcaagaucauucacgaaugguguugccggagcuguacacugccuccccugcgcuucaaaggggaggacggaugcugguauggcauggagaucagaccggucaaggaaaaggaggaaaaucuugugaaaucuaugguuuccgccgggagcggagagguggacuccuuuucucucggccugcuguguauuagcaucaugauugaagaggucaugcgguccagauggucucgcaagaugcucaugaccgggacgcuggccguguucuuucuucugaucaugggacagcucacauggaacgaucugauucggcugugcaucaugguuggcgcugacgccagcgauagaaugggcauggggaccacauaccuugcgcugauggcuaccuucaaaaugcgcccuauguuugccgugggacuccuguucagacggcucaccucccgcgagguccugcuucugacaaucggccucucucugguggccagcguggaacugcccaauucccuugaggaacugggggacggacucgcuaugggcauuaugauccugaagcuccugacggauuuucaaagccaucagcuuugggccacccugcucucucugacauucauuagaaccacauuuucccugcacuaugcuuggaaaaccauggccaugguccuuagcaucguuucucuguucccccucugucuguccacgacaagccagaagaccaccuggcucccugugcugcuugggucucugggaugcaagccgcugacaauguuucucauugcggagaacaaaaucuggggccggaaguccuggccccugaaugaaggcaucauggccguggggauugucagcauccuucuguccagccuccugaaaaacgacgugccucucgcuggaccccugauugccggcgggaugcuuaucgcuuguuacguuauuucuggaagcuccgccgaucugucucuggagaaggccgcuguggucagcugggaggaagaggcggaacauuccggcgccucucacaacauccucguggagguucaggacgaugggaccaugaaaaucaaggacgaagaaagagaugacacacugacgauucuucugaaagcuacccuccuggccgugagcggagucuauccucucuccauccccgccacacuguucgugugguacuucuggcaaaagaagaaacagagaucuggcguccuuugggauaccccuuccccucccgagguggaacgggcuguucuggacgacggcauuuaucgcaucaugcagagagggcugcucggacggucccaggugggcgucgggguguuucaagagaauguuuuccauacaauguggcacgugacccgcggagccguccugauguaccagggcaagagacuugaacccagcugggcgucugugaaaaaggaucugauuuccuacgggggaggcuggcggcuccagggcagcuggaacacgggggaggaggugcagguuaucgcugucgaacccggcaagaauccuaagaacgugcaaaccgcccccggcacauuuaagaccucugagggggaagugggagccauugcucuggacuucaaaccgggcacauccgggagcccuaucgucaauagagagggaaagaucgugggccucuauggcaacgggguugugaccacauccggaacguacgucucugccauugcgcaggcuaaagccagccaggaaggcccccugccugagaucgaggaugaaguguuucgcaagcggaaucuuaccauuauggaccugcaccccggguccggaaaaacaagacgcuaucugcccgccaucguucgggaggcuauuaagagaaagcuccgcacccugauccuugccccuacccggguggucgcuagcgaaauggccgaggcgcugaaaggcaugccgaucagauaccaaacaacggccgugaagucugaacauaccgggaaagagauuguugaucucaugugccacgcuacauucaccaugcgccugcugucccccgugcgggucccuaacuauaauaugaucauuauggacgaggcccauuuuacagaucccagcucuaucgcugccagaggcuacauuagcacccgggugggaaugggcgaagccgcugcgaucuucaugacggccacaccucccggguccguggaggcuuuuccucagucuaacgccgucauccaggacgaagaacgcgauauuccggaaagaagcuggaacuccggauaugaguggaucaccgacuuccccggcaagaccguuugguuugugccuucuauuaaaagcgggaacgauaucgccaauugucuccggaagaacggaaagcgcgugauucagcuuuccagaaaaacauucgacaccgaguaccaaaagaccaagaauaacgacugggauuacgucgugaccacggacaucagcgaaaugggcgcuaacuuccgggccgauagaguuauugacccccgccggugccugaagccugugauccugaaagaugggcccgagagagucauccucgcgggcccgaugccugugacaguugcuucugccgcccagcgccggggaagaauuggccgcaaucacaacaaggaaggggaccaguauaucuacaugggacagccccugaauaacgaugaggaccaugcucacuggaccgaggccaagaugcuucuggauaauauuaacacacccgaaggcaucauuccugcgcucuuugaccccgagcgggaaaaauccgccgcuaucgauggggaguauagacugcgcggagaagccagaaagaccuucguggagcugaugcggcgcggcgaccucccugucuggcuuagcuacaaaguggcuuccgagggguuucaauauucugauagacgguggugcuucgacggcgaacgcaauaaccagguccuggaggaaaauauggacguggagaucuggacgaaggaaggagagcgcaagaagcugcggccgagauggcucgaugcccgcaccuacagcgacccccuggcccuucgggaguuuaaagaguucgccgcgggcagacgcuccguuucuggggaucugauucucgagaucggaaagcugccucagcaccugacacagcgggcccaaaacgcucucgacaaucuugugaugcugcauaacagcgaacagggcgggagagccuaucggcacgcuauggaggaacugcccgauaccauugagacacucaugcugcuugcccugaucgccgugcucaccggaggcgucacacuguuuuuccuguccggccgcgggcucggaaagaccagcauuggccuucuguguguuauggcuucuuccgugcugcucuggauggcgagcguggagccucauuggaucgccgcuucuaucauucuggaauuuuuccuuaugguccugcucauccccgagccggacagacagcggacgccucaggauaaucaacuggccuacgugguuauugggcugcucuuuaugauccuuacaguggccgcuaacgaaaugggacugcuggagaccaccaaaaaggaccucggcauugggcacgucgccguggagaaucaccaucacgcggccaugcuggaugucgaccuucaucccgcuuccgccuggacacuguacgcuguggccaccacaaucauuacgccuaugaugcgccacaccaucgaaaacacaaccgcgaacaucagccucacagccauugcuaaucaggccgcuauccugaugggacuggauaaaggcuggcccauuucuaagauggacaucggcguuccucuccuugcccuggggugcuauagccaggugaacccccugacccucacggcugccguccugaugcuuguggcgcauuacgccauuaucggaccgggccugcaagcuaaagccaccagagaggcucagaagcggacagccgccgggaucaugaagaauccuaccguugauggaauuguggcgaucgaccucgaccccgucguguaugaugcuaaauucgaaaagcagcugggccagauuaugcugcucauccuuuguacaucccaaauucugcugaugcgcaccacgugggcccucugcgagucuaucacacuggcuaccgggccccuuacaacccugugggaaggaagcccuggcaaauuuuggaacaccacaaucgccguguccauggccaauauuuucagaggcagcuaccucgcuggggccggacuggcguucucccugaugaagucucucggcgggggacggcgcggcacgggggcccagggagagacccuuggcgagaaauggaagagacagcugaaccagcugagcaaguccgaauuuaauacauauaaacggucuggcaucauggagguugacagaagcgaagcuaaggaggggcucaaacgcggagaaaccacaaagcacgccgucucccggggcaccgcuaaacugagaugguucguggagcgcaaccuugugaagccggaggggaaggucauugaucugggauguggcagagggggauggucuuacuauugcgccggccucaaaaagguuacggaagugaaaggcuacacaaaagggggacccggccacgaggaaccuauccccauggcgaccuacggguggaaucuggugaaacugcauagcggaaaggacgucuuuuucauuccucccgagaaaugugauacccuccuuugcgacaucggcgaauccagcccuaacccgacaauugaggaggggagaacccugcgcgugcugaagaugguugaacccuggcuccggggaaaucaauuuuguaucaagauccugaacccuuauaugcccucuguggucgagacacuugaacagaugcagagaaaacacggcggcaugcuggugcgcaauccucucucccggaacagcacgcaugagauguacuggguuucuugcgggaccggaaauauuguguccgccgucaacaugacaagcagaaugcugcugaaucgcuucaccauggcucaccggaagcccacauaugagagagauguggaccucggcgccgggacccgccacguggcugucgaaccggagguugccaaccuggauaucauuggacagagaaucgaaaacauuaaacaugagcacaagucuacguggcauuacgacgaagauaauccuuauaaaaccugggcuuaccacggcuccuaugaggugaagcccagcggguccgccagcucuauggugaacggagucgugaaacuucugacaaaacccugggacguuaucccuauggugacccaaaucgcgaugacagacaccacacccuuuggccagcagcgggucuucaaggagaaaguggauacccgcacgccuaaggccaaaagaggcacagcucaaauuauggaaguuaccgccaaguggcucuggggguuucugagccggaauaagaaaccgagaaucuguacccgggaggaguucacacgcaaggugagauccaacgcugccauuggagccgucuuuguggacgagaaucaguggaacucugcgaaagaagcuguugaggaugagcgguucugggaccuugugcaucgcgaaagagagcugcacaagcagggcaaaugcgccacgugcgucuacaauaugauggggaagcgggaaaagaaacucggagaguuuggcaaggccaaagggagccgcgcuaucugguacauguggcugggcgccagauuccuggaguucgaggcucucggauuuaugaacgaggaucacugguucucccgggaaaauucucugagcggcguggagggggaaggacuucauaagcugggcuauauucuccgcgacaucuccaaaauccccgggggaaacauguacgccgaugacaccgcgggcugggauacaagaauuaccgaggacgaucugcagaaugaggccaagaucacagacauuauggaaccugagcacgcccuucuggccaaaucuaucuuuaagcucaccuaucaaaacaaggucgugcggguucagcgccccgcuaaaaaugggacagugauggaugucauuagcagacgggaccagcgcggcuccggacaggugggcaccuacgggcugaacacguucaccaauauggaagcccaacugaucagacagauggagagcgaaggaaucuuuucuccuuccgagcucgagacacccaaccuggcgggccgggugcuugacuggcuggaaaagcaugggguugagagacucaaacgcauggccauuagcggagaugacuguguggucaagccgaucgaugaccgguucgcuaccgcccugacagcucuuaacgauaugggcaaagugagaaaggacauuccucagugggaacccucuaagggguggaaugauuggcagcaaguuccuuuuugcucccaccacuuccaucagcugaucaugaaagacggccgcgagauugugguccccugucggaaccaggaugaacucgugggcagagcucgcgucagccagggagcuggguggucccugcgggagaccgccugccugggaaagucuuaugcgcaaauguggcagcucauguacuuucacagacgcgaccugcggcuugccgcuaaugccaucuguagcgccgugccuguugauugggugcccacguccagaacaaccuggagcauucaugcucaccaucaguggaugacaaccgaggacaugcugucugucuggaaccgcguguggaucgaagagaauccguggauggaagacaaaacgcacaucuccagcuggggcgauguuccuuaucucgggaagcgggaggaccaauggugcggaucucugauuggccuuaccgccagagcgacaugggcuaccaacauccagguggccauuaaucagguccggagacugcucgggaacgaaaauuaccuggauuacaugacaagcaugaaacgcuucaagaacgaguccgaccccgagggcgcccugugguga

SEQ ID NO: 19356 - RNA, 9879 nt, Artificial Sequence
  derived and/or modified CDS sequence (opt5) from DENV-1__JQ045635__SS-prME
agcgugaccaugcugcugaugcugaugcccacagcucuugcuuuccaccugacgacccggggaggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccauugcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgccaggaccuucuggugaccuuuaaaacagcgcacgccaagaagcaggaagucgugguucucggaucccaagagggcgcuaugcacaccgcccugaccggggccacagaaauccagacgagcggaaccacaaccauuuucgcuggccaucugaaaugcagacucaagauggauaaacugacacuuaaggggaugucuuaugugauguguaccggcuccuucaaacuggagaaggaagucgccgagacgcagcacggaacagugcucguucagaucaaguacgagggcaccgacgcgccgugcaaaaucccuuuuagcacccaagaugaaaagggggcuacacagaacggacggcugauuaccgccaaucccaucgugacagacaaagagaagccugucaacauugaagccgagccgcccuucggcgagucuuauaucgugauuggggcuggagaaaaagcccugaaacuuagcugguuuaagaaaggcuccucuaucgggaagauguucgaggcuacggccagaggcgcgcgccggauggccauccucggagauaccgcuugggacuuuggcagcauugggggaguguucacauccguuggcaaacugguccaucagaucuuugggaccgccuacggagugcuguucagcggcgugucuuggacaaugaagauugggaucggcguccuccugaccuggcuuggacucaauuccagaagcacgucucucuccaugaccuguauugcugugggccugguuacacuguaccuuggggugaugguccaggccgauagcggaugcgugaucaacuggaaaggccgcgaacucaaguguggguccggaauuuuuguuaccaaugaggugcacacauggaccgaacaauauaaguuccaggcggacucuccuaaacggcugagcgccgcuaucggcaaggccugggaggagggggucugcggcaucagauccgcuacacgccuggaaaacauuauguggaaacagaucucuaacgagcucaaucauauucugcuugaaaacgacaugaagcugaccgugguugugggagaugucgccggcauccucgcccaggggaaaaagaugauucggccgcaacccauggaguacaaauauagcuggaaguccuggggaaaggcuaaaaucaucggcgcggacgugcagaauacgacauuuauuaucgaugggccuaacacccccgaauguccugacgaucagagagccuggaauauuugggagguggaggacuacggauucggcaucuuuaccacaaacauuuggcugaagcugcgcgauagcuauacccaggucugcgaccaccggcuuaugucugcugccaucaaagauuccaaggccguucacgcugacaugggcuacuggaucgaaagcgagaaaaaugaaacguggaagcucgccagagcgucuuucauugaggugaagacauguaucuggcccaaaucccauacccuguggagcaacggggugcuggaaucugagaugauuaucccgaagauuuauggaggcccuaucagccaacacaauuaccgccccggguacuucacacagaccgcuggaccuuggcaucucggcaaacuggagcuugauuuugaccugugcgaagggacaaccgucgugguugaugagcacugcggaaaccggggccccucccucagaacgaccacagugaccggcaagaucauucacgaaugguguugccggagcuguacacugccuccccugcgcuucaaaggggaggacggaugcugguauggcauggagaucagaccggucaaggaaaaggaggaaaaucuugugaaaucuaugguuuccgccgggagcggagagguggacuccuuuucucucggccugcuguguauuagcaucaugauugaagaggucaugcgguccagauggucucgcaagaugcucaugaccgggacgcuggccguguucuuucuucugaucaugggacagcucacauggaacgaucugauucggcugugcaucaugguuggcgcugacgccagcgauagaaugggcauggggaccacauaccuugcgcugauggcuaccuucaaaaugcgcccuauguuugccgugggacuccuguucagacggcucaccucccgcgagguccugcuucugacaaucggccucucucugguggccagcguggaacugcccaauucccuugaggaacugggggacggacucgcuaugggcauuaugauccugaagcuccugacggauuuucaaagccaucagcuuugggccacccugcucucucugacauucauuagaaccacauuuucccugcacuaugcuuggaaaaccauggccaugguccuuagcaucguuucucuguucccccucugucuguccacgacaagccagaagaccaccuggcucccugugcugcuugggucucugggaugcaagccgcugacaauguuucucauugcggagaacaaaaucuggggccggaaguccuggccccugaaugaaggcaucauggccguggggauugucagcauccuucuguccagccuccugaaaaacgacgugccucucgcuggaccccugauugccggcgggaugcuuaucgcuuguuacguuauuucuggaagcuccgccgaucugucucuggagaaggccgcuguggucagcugggaggaagaggcggaacauuccggcgccucucacaacauccucguggagguucaggacgaugggaccaugaaaaucaaggacgaagaaagagaugacacacugacgauucuucugaaagcuacccuccuggccgugagcggagucuauccucucuccauccccgccacacuguucgugugguacuucuggcaaaagaagaaacagagaucuggcguccuuugggauaccccuuccccucccgagguggaacgggcuguucuggacgacggcauuuaucgcaucaugcagagagggcugcucggacggucccaggugggcgucgggguguuucaagagaauguuuuccauacaauguggcacgugacccgcggagccguccugauguaccagggcaagagacuugaacccagcugggcgucugugaaaaaggaucugauuuccuacgggggaggcuggcggcuccagggcagcuggaacacgggggaggaggugcagguuaucgcugucgaacccggcaagaauccuaagaacgugcaaaccgcccccggcacauuuaagaccucugagggggaagugggagccauugcucuggacuucaaaccgggcacauccgggagcccuaucgucaauagagagggaaagaucgugggccucuauggcaacgggguugugaccacauccggaacguacgucucugccauugcgcaggcuaaagccagccaggaaggcccccugccugagaucgaggaugaaguguuucgcaagcggaaucuuaccauuauggaccugcaccccggguccggaaaaacaagacgcuaucugcccgccaucguucgggaggcuauuaagagaaagcuccgcacccugauccuugccccuacccggguggucgcuagcgaaauggccgaggcgcugaaaggcaugccgaucagauaccaaacaacggccgugaagucugaacauaccgggaaagagauuguugaucucaugugccacgcuacauucaccaugcgccugcugucccccgugcgggucccuaacuauaauaugaucauuauggacgaggcccauuuuacagaucccagcucuaucgcugccagaggcuacauuagcacccgggugggaaugggcgaagccgcugcgaucuucaugacggccacaccucccggguccguggaggcuuuuccucagucuaacgccgucauccaggacgaagaacgcgauauuccggaaagaagcuggaacuccggauaugaguggaucaccgacuuccccggcaagaccguuugguuugugccuucuauuaaaagcgggaacgauaucgccaauugucuccggaagaacggaaagcgcgugauucagcuuuccagaaaaacauucgacaccgaguaccaaaagaccaagaauaacgacugggauuacgucgugaccacggacaucagcgaaaugggcgcuaacuuccgggccgauagaguuauugacccccgccggugccugaagccugugauccugaaagaugggcccgagagagucauccucgcgggcccgaugccugugacaguugcuucugccgcccagcgccggggaagaauuggccgcaaucacaacaaggaaggggaccaguauaucuacaugggacagccccugaauaacgaugaggaccaugcucacuggaccgaggccaagaugcuucuggauaauauuaacacacccgaaggcaucauuccugcgcucuuugaccccgagcgggaaaaauccgccgcuaucgauggggaguauagacugcgcggagaagccagaaagaccuucguggagcugaugcggcgcggcgaccucccugucuggcuuagcuacaaaguggcuuccgagggguuucaauauucugauagacgguggugcuucgacggcgaacgcaauaaccagguccuggaggaaaauauggacguggagaucuggacgaaggaaggagagcgcaagaagcugcggccgagauggcucgaugcccgcaccuacagcgacccccuggcccuucgggaguuuaaagaguucgccgcgggcagacgcuccguuucuggggaucugauucucgagaucggaaagcugccucagcaccugacacagcgggcccaaaacgcucucgacaaucuugugaugcugcauaacagcgaacagggcgggagagccuaucggcacgcuauggaggaacugcccgauaccauugagacacucaugcugcuugcccugaucgccgugcucaccggaggcgucacacuguuuuuccuguccggccgcgggcucggaaagaccagcauuggccuucuguguguuauggcuucuuccgugcugcucuggauggcgagcguggagccucauuggaucgccgcuucuaucauucuggaauuuuuccuuaugguccugcucauccccgagccggacagacagcggacgccucaggauaaucaacuggccuacgugguuauugggcugcucuuuaugauccuuacaguggccgcuaacgaaaugggacugcuggagaccaccaaaaaggaccucggcauugggcacgucgccguggagaaucaccaucacgcggccaugcuggaugucgaccuucaucccgcuuccgccuggacacuguacgcuguggccaccacaaucauuacgccuaugaugcgccacaccaucgaaaacacaaccgcgaacaucagccucacagccauugcuaaucaggccgcuauccugaugggacuggauaaaggcuggcccauuucuaagauggacaucggcguuccucuccuugcccuggggugcuauagccaggugaacccccugacccucacggcugccguccugaugcuuguggcgcauuacgccauuaucggaccgggccugcaagcuaaagccaccagagaggcucagaagcggacagccgccgggaucaugaagaauccuaccguugauggaauuguggcgaucgaccucgaccccgucguguaugaugcuaaauucgaaaagcagcugggccagauuaugcugcucauccuuuguacaucccaaauucugcugaugcgcaccacgugggcccucugcgagucuaucacacuggcuaccgggccccuuacaacccugugggaaggaagcccuggcaaauuuuggaacaccacaaucgccguguccauggccaauauuuucagaggcagcuaccucgcuggggccggacuggcguucucccugaugaagucucucggcgggggacggcgcggcacgggggcccagggagagacccuuggcgagaaauggaagagacagcugaaccagcugagcaaguccgaauuuaauacauauaaacggucuggcaucauggagguugacagaagcgaagcuaaggaggggcucaaacgcggagaaaccacaaagcacgccgucucccggggcaccgcuaaacugagaugguucguggagcgcaaccuugugaagccggaggggaaggucauugaucugggauguggcagagggggaugggccuacuauugcgcgggccucaaaaagguuacggaagugaaaggcuacacaaaagggggacccggccacgaggaaccuauccccauggccaccuacggguggaaucuggugaaacugcauucuggaaaggacgucuuuuucauuccucccgagaaaugugauacccuccuuugcgacaucggcgaaagcuccccuaacccgacaauugaggaggggagaacccugcgcgugcugaagaugguugaacccuggcuccggggaaaucaauuuuguaucaagauccugaacccuuauaugcccagcguggucgagacacuugaacagaugcagagaaaacacggcggcaugcuggugcgcaauccucucucucggaacuccacgcaugagauguacuggguuagcugcgggaccggaaauauugugucugcugucaacaugacauccagaaugcugcugaaucgcuucaccauggcccaccggaagcccacauaugagagagauguggaccucggcgcugggacccgccacguggccgucgaaccggagguugcuaaccuggauaucauuggacagagaaucgaaaacauuaaacaugagcacaagagcacguggcauuacgacgaagauaauccuuauaaaaccugggccuaccacggcucuuaugaggugaagcccuccgggagcgcguccagcauggugaacggagucgugaaacuucugacaaaacccugggacguuaucccuauggugacccaaaucgccaugacagacaccacacccuuuggccagcagcgggucuucaaggagaaaguggauacccgcacgccuaaggcuaaaagaggcacagcccaaauuauggaaguuaccgcuaaguggcucuggggguuucugucucggaauaagaaaccgagaaucuguacccgggaggaguucacacgcaaggugagaagcaacgccgccauuggagcggucuuuguggacgagaaucaguggaacuccgcuaaagaagccguugaggaugagcgguucugggaccuugugcaucgcgaaagagagcugcacaagcagggcaaaugcgccacgugcgucuacaauaugauggggaagcgggaaaagaaacucggagaguuuggcaaggcuaaagggucucgcgccaucugguacauguggcugggcgcuagauuccuggaguucgaggcccucggauuuaugaacgaggaucacugguucagccgggaaaauucccugucuggcguggagggggaaggacuucauaagcugggcuauauucuccgcgacaucagcaaaauccccgggggaaacauguacgcggaugacaccgccggcugggauacaagaauuaccgaggacgaucugcagaaugaggcuaagaucacagacauuauggaaccugagcacgcccuucuggcuaaauccaucuuuaagcucaccuaucaaaacaaggucgugcggguucagcgccccgccaaaaaugggacagugauggaugucauuucuagacgggaccagcgcggcagcggacaggugggcaccuacgggcugaacacguucaccaauauggaagcgcaacugaucagacagauggaguccgaaggaaucuuuagcccuucugagcucgagacacccaaccuggccggccgggugcuugacuggcuggaaaagcaugggguugagagacucaaacgcauggcuauuuccggagaugacuguguggucaagccgaucgaugaccgguucgccaccgcucugacagcccuuaacgauaugggcaaagugagaaaggacauuccucagugggaacccagcaagggguggaaugauuggcagcaaguuccuuuuugcucucaccacuuccaucagcugaucaugaaagacggccgcgagauugugguccccugucggaaccaggaugaacucgugggcagagcucgcgucucccagggagccggguggagccugcgggagaccgcgugccugggaaaguccuaugcccaaauguggcagcucauguacuuucacagacgcgaccugcggcuugcugccaaugccaucuguucugcugugccuguugauugggugcccacgagcagaacaaccugguccauucaugcccaccaucaguggaugacaaccgaggacaugcugagcgucuggaaccgcguguggaucgaagagaauccguggauggaagacaaaacgcacaucucuuccuggggcgauguuccuuaucucgggaagcgggaggaccaauggugcggaagccugauuggccuuaccgcgagagcuacaugggccaccaacauccagguggccauuaaucagguccggagacugcucgggaacgaaaauuaccuggauuacaugacaucuaugaaacgcuucaagaacgagagcgaccccgagggcgcucugugguga

SEQ ID NO: 19357 - RNA, 9879 nt, Artificial Sequence
  derived and/or modified CDS sequence (opt5) from DENV-1__JQ045637__SS-prME
agcgugaccaugcugcucaugcugaugcccacagcccuugcuuuccaccugacgaccagaggcggggaaccucauaugaucgucuccaagcaggaacggggaaaaucucuccuguuuaagaccagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagauguccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggauuggcgugcugcuuaccuggcugggacucaauucuagauccacaagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgauuggcaaggccugggaggagggggugugcggcaucagaagcgcuacgcgccucgaaaacaucauguggaaacagauuuccaacgagcugaaucauauccuucuggaaaacgacaugaaguucacaguuguggucggagauguggccggcauucucgcucaggggaaaaagaugauccggccgcaacccauggaguacaaauauucuuggaaaagcuggggaaaggccaagauuaucggcgccgacgugcagaauaccaccuuuaucauugaugggccuaacacacccgaauguccugacgaucagagagcuuggaauaucugggaggucgaggacuacggauucggcauuuuuaccacgaacaucuggcugaagcugcgcgauuccuauacacagguuugcgaccaccggcuuaugagcgcggccauuaaagauucuaaggcugugcacgccgacaugggcuacuggaucgaauccgagaaaaaugaaaccuggaagcucgccagagcuagcuucaucgaggugaagacauguauuuggcccaaaucucauacccugugguccaacgggguccuggaaagcgagaugaucauuccgaagaucuauggaggcccuauuucucaacacaauuaccgccccggguacuucacacagaccgccggaccuuggcaucucggcaaacuggagcuugauuuugaccugugcgaagggacgaccgugguuguggaugagcacugcggaagccggggccccucccucagaacaaccacagucaccggcaagaucauccacgaaugguguugccggagcuguacgcugccuccccugcgcuucagaggggaggacggaugcugguauggcauggagauucggccggugaaagaaaaggaggaaaaccuuguuaagucuaugguguccgcggggagcggagaggucgacucccucucucugggccugcucuguaucagcauuaugaucgaagaggugaugagaucccgcuggucucggaaaaugcugaugacagggacccuugcugucuuuuuccugcucauuaugggacagcugacauggaaugaucugaucagacuuugcauuauggugggcgccaacgccagcgaccgcaugggcauggggaccaccuaccuggcucucauggccgcguuuaagaugagaccuauguucgcugucggacugcucuuucggcgccugacauccagagaggugcuucugcucacgaucggccugucucugguggccagcgucgaacuucccaauucccuggaggaacucggggauggacuggccaugggcaucaugauucucaaacugcuuaccgacuuccaaagccaucagcugugggcuacacuccugucucugaccuuuaucaagacaaccuucucccuucacuaugccuggaaaacgauggcuaugguucugagcauugugucucucuuuccccugugucucuccacaaccagccagaagaccacauggcugccugugcuucuggggucucugggaugcaagccgcucaccauguuccugaucgccgagaacaaaauuuggggccggcgcuccuggccccuuaaugaaggcaucauggcggucgggaucgugagcauucugcucuccagccugcucaagaacgauguuccucuggccggaccccuuaucgcuggcgggaugcugauugccuguuacgugaucucuggaagcuccgcugaccugucucucgagaaagccgccgaggucagcugggaagaggaagcugagcauuccggcgcgucucacaacauucugguggaaguucaggaugacgggacaaugaagaucaaagaugaggagagagacgauacgcuuaccauccugcucaaggccacacugcucgcugugagcggagucuauccucuguccauucccgccacccuuuuugugugguacuucuggcagaagaagaagcagcggucuggcguccugugggacacaccuagcccucccgaaguggagcgcgccguucuggaugacggcaucuauagaauuaugcagcgggggcuccugggacgcucccaggugggcgucgggguguuccaagaaaauguuuuucauaccauguggcacgugacgagaggagcuguccuuauguaccagggcaaacggcuggagcccagcugggccucugugaagaaagaccucaucuccuacgggggaggcuggagacugcagggcagcuggaacaccggggaggaagugcagguuauugcggucgagcccggaaagaauccuaaaaacgugcaaacagcucccggcaccuucaagacaccggaaggggaggugggagccaucgcccucgauuuuaagccuggcaccucugggucccccauugucaaucgcgaaggaaaaaucgugggccuguauggcaacgggguugugacaacgagcggaaccuacgucuccgcuaucgcccaggcgaaggcuucucaggagggcccucuucccgagauugaagacgagguguuccggaaaagaaaucugacaaucauggaucugcaccccgggagcggaaagacccgccgguaucucccugccauuguuagagaagccaucaaacgcaagcugcggacccuuauucuggcuccgacaagaguggucgccuccgagauggcugaagcccucaagggcaugcccauccgcuaccaaacgaccgcggugaaaagcgagcauacagggaaggagaucguugaccugaugugccacgccaccuuuacaaugcggcugcucucuccugugagaguccccaacuauaauaugauuaucauggaugaagcucauuucaccgacccuuccagcauugccgcucggggcuacaucucuacgcgcgugggaaugggcgaggccgccgcuauuuuuaugacagcgacacccccugggagcguggaagccuucccgcaguccaacgcugucauccaggaugaggaaagagacauccccgagcggucuuggaauagcggauaugaguggauuaccgauuuuccuggcaaaacaguuugguucgugcccuccaucaagucugggaacgacauugccaauugucuucgcaaaaacggaaagagagugauccagcugagccggaagaccuuugauacagaauaccagaaaaccaagaauaacgacugggacuacgucgugacgacagauauuuccgagaugggcgccaacuucagagcugaccgcguuaucgauccucggagaugccugaaacccgugauucucaaggacgggccggaacgcgucauccuggccggcccuaugcccgugaccguugcgagcgcugcccagcggagaggacgcaucggccggaaucacaacaaagagggggaucaguauauuuacaugggacagccccuuaauaacgacgaggaucaugcccacuggacagaagcuaagaugcugcucgacaauaucaacaccccugagggcauuauccccgcccuguucgaaccugagagagaaaagucugcggccauugauggggaguaucgccugagaggagaggcucggaaaacguuuguggaacucaugcgcagaggcgaccuuccggucuggcuguccuacaagguggccagcgagggguuccaauauuccgaucggcgcuggugcuuugacggcgaaagaaauaaccagguccuggaggaaaauauggauguggagaucuggaccaaagagggagaacggaagaaacucagaccccgcuggcuggacgcucggacauacucugacccucuugcccugagagaguucaaggaauuugcugccggccgccggagcguuuccggggaucucauccuggagauuggaaaacugccccagcaccucacccagagagcgcaaaacgcccuugacaaucuggugaugcugcauaacucugaacagggcgggcgggcuuaucgccacgccaucgaggagcucccugauacaauugaaacccugaugcuucuggcucucaucgccgugcugacaggaggcgucacccuguucuuucucagcggcagagggcuuggaaagacguccauuggccugcuguguguuauggccagcucugugcuccuguggauggcuuccguggagccccauuggaucgcggccagcaucauucuugaguucuuucugaugguccuccugaucccggagccugaccggcagcgcacaccccaggauaaucaacuggcuuacgugguuauugggcuccuuuucaugauccugaccguggccgccaacgagaugggacugcucgaaaccacaaagaaagaccugggcauugggcacgucgcuguggagaaucaccaucacgccgcgaugcuugaugucgaccugcauccugccucugcuuggacccucuacgccguggcuacaacgaucauuacccccaugaugagacacacaaucgaaaacaccacagccaacaucucccugaccgcgauugccaaucaggcugccauccugaugggacucgauaagggcuggccuauuagcaaaauggacaucggcguuccccuucuggcucuggggugcuauucucaggugaacccgcucacgcugaccgccgcuguccuuaugcugguggcccauuacgcgauuaucggaccuggccuccaagccaaggcuacacgggaggcccagaaacgcaccgcugccgggaucaugaagaaucccacaguugauggaauuguggccaucgaccuggaucccgucguguaugacgcgaaguuugaaaaacagcugggccagauuaugcuccuuauccuguguaccagccaaauucugcucaugagaacgacaugggcucugugcgaguccaucacccuugccacagggccucugaccacccucugggagggaucuccgggcaaguucuggaacacaacgaucgcugugagcauggccaauauuuuucggggcuccuaccuggccggggcuggacuggccuucagccucaugaaaucccuuggcgggggacgcagaggcaccggggcgcagggagaaacacugggcgagaaguggaaacggcagcugaaccagcucucuaagagcgaguucaauaccuauaagagauccggcaucauggagguugaccgcucugaagccaaagaggggcugaagcggggagagacaaccaaacacgcugucagcagaggcacggccaaacuucgcugguuuguggaacggaaccuggugaaacccgaggggaaggucauugaucucggauguggcagagggggaugguccuacuauugcgcuggccugaagaaaguuacagaagugaagggcuacaccaaagggggaccuggccacgaggaacccaucccuauggccaccuacggguggaaucuggugaagcuccauucuggaaaagacgucuucuuuauucccccugagaagugugauacacuucugugcgacaucggcgagagcuccccgaaccccaccauugaagaggggcgcacacugcgggugcucaaaaugguugaaccuuggcugagaggaaaucaauucuguaucaagauccuuaaccccuauaugccuagcguggucgagacgcuggagcagaugcagcgcaagcacggcggcaugcucgugcggaauccccugucuagaaacuccacccaugaaauguacuggguuagcugcgggacaggaaauauugugucugcggucaacaugaccucccgcaugcugcucaaucgguuuacaauggcccacagaaaaccgaccuaugagcgcgauguggaccugggcgcugggacgagacacguggccgucgaaccugagguugcuaaccuugauaucauuggacagcggaucgaaaacauuaagcaugagcacaaaagcaccuggcauuacgacgaggauaaucccuauaagacaugggccuaccacggcucuuaugaagugaaacccuccgggagcgcuuccagcauggugaacggagucgugaagcugcucaccaagccuugggacguuauccccauggugacacaaaucgccaugaccgauacaaccccuuucggccagcagcgcgucuuuaaagagaagguggacacgagaacaccgaaagcgaagcggggcaccgcccaaauuauggaaguuaccgcuaaauggcuguggggguuccuuucuagaaauaagaagccccggaucuguacacgcgaggaauuuacgagaaaagugcggagcaacgccgcuauuggagccgucuucguggacgagaaucaguggaacuccgccaaggaggcgguugaagaugagcgcuuuugggaccuggugcauagagaacgggagcuccacaaacagggcaagugcgcuaccugcgucuacaauaugauggggaaacgcgaaaagaagcugggagaguucggcaaagccaaggggucuagagccaucugguacauguggcugggcgcucgguuucucgaguucgaagcccugggauucaugaacgaggaucacugguuuagccgcgaaaauucccuuucuggcguggagggggagggacugcauaaacucggcuauauucugagagacaucagcaagaucccugggggaaacauguacgcugaugacacagccggcugggauacccggauuacagaagacgaucuucagaaugaggcgcgcaucaccgacauuauggaacccgagcacgcccugcucgcuagauccaucuucaaacugacauaucaaaacaaggucgugcggguucagcgcccugccaaaaaugggaccgugauggaugucauuucuagacgggaccagagaggcagcggacaggugggcacguacgggcugaacaccuuuacaaauauggaagcucaacucauccgccagauggaguccgagggaaucuucagccccucugaacuggagaccccgaaccuugccgaacgggugcuggauuggcucgagaaguauggcguugaaagacugaagcgcauggcgauuuccggggacgacuguguggucaaaccuaucgaugaccgguuugccacagcucuuaccgcccugaacgauaugggaaaggugagaaaagacauuccccagugggagccuagcaagggcuggaaugauuggcagcaaguucccuucugcucucaucacuuucaccagcucaucaugaaagacgggcgcgagauuguggucccuugucggaaccaggaugaacuggugggcagagcucgcgucucccagggagccggcuggagccugcgggagacggcuugccucgggaaguccuacgcccaaauguggcagcugauguauuuccauagacgcgaccuucggcuggcggccaaugcuaucuguucugccgugcccguugauuggauuccgacaagcagaaccacaugguccauccacgcccaucaccaguggaugaccacggaagacaugcucagcguguggaaccgggucuggaucgaggaaaauccuuggauggaggauaagacccauauuucuuccuggggagacgugcccuaccugggcaaaagagaggaccaauggugcgggagccuuaucggacugacagcucgcgccaccugggcgacaaacauucagguugcuaucaaucaggugcggagacucauuggcaacgaaaauuaccuggauuauaugaccucuaugaagcgcuuuaaaaacgagagcgaccccgaaggggcccugugguga

SEQ ID NO: 19358 - RNA, 9879 nt, Artificial Sequence
  derived and/or modified CDS sequence (opt5) from DENV-1__JQ045638__SS-prME
agcgugaccaugcugcucaugcugaugcccacagcccuugcuuuccaccugacgaccagaggcggggaaccucauaugaucgucuccaagcaggaacgggggaaaucucuccuguuuaagaccagcgccggcguuaacaugugcacccuuauugccauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagauguccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggauuggcgugcugcuuaccuggcugggacucaauucuagauccacaagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgauuggcaaggccugggaggagggggugugcggcaucagaagcgcuacgcgccucgaaaacaucauguggaaacagauuuccaacgagcugaaucauauccuucuggaaaacgacaugaaguucacaguuguggucggagauguggccggcauucucgcucaggggaaaaagaugauccggccgcaacccauggaguacaaauauucuuggaaaagcuggggaaaggccaagauuaucggcgccgacgugcagaauaccaccuuuaucauugaugggccuaacacacccgaauguccugacgaucagagagcuuggaauaucugggaggucgaggacuacggauucggcauuuuuaccacgaacaucuggcugaagcugcgcgauuccuauacacagguuugcgaccaccggcuuaugagcgcggccauuaaagauucuaaggcugugcacgccgacaugggcuacuggaucgaauccgagaaaaaugaaaccuggaagcucgccagagcuagcuucaucgaggugaagacauguauuuggcccaaaucucauacccugugguccaacgggguccuggaaagcgagaugaucauuccgaagaucuauggaggcccuauuucucaacacaauuaccgccccggguacuucacacagaccgccggaccuuggcaucucggcaaacuggagcuugauuuugaccugugcgaagggacgaccgugguuguggaugagcacugcggaagccggggccccucccucagaacaaccacagucaccggcaagaucauccacgaaugguguugccggagcuguacgcugccuccccugcgcuucagaggggaggacggaugcugguauggcauggagauucggccggugaaagaaaaggaggaaaaccuuguuaagucuaugguguccgcggggagcggagaggucgacucccucucucugggccugcucuguaucagcauuaugaucgaagaggugaugagaucccgcuggucucggaaaaugcugaugacagggacccuugcugucuuuuuccugcucauuaugggacagcugacauggaaugaucugaucagacuuugcauuauggugggcgccaacgccagcgaccgcaugggcauggggaccaccuaccuggcucucauggccgcguuuaagaugagaccuauguucgcugucggacugcucuuucggcgccugacauccagagaggugcuucugcucacgaucggccugucucugguggccagcgucgaacuucccaauucccuggaggaacucggggauggacuggccaugggcaucaugauucucaaacugcuuaccgacuuccaaagccaucagcugugggcuacacuccugucucugaccuuuaucaagacaaccuucucccuucacuaugccuggaaaacgauggcuaugguucugagcauugugucucucuuuccccugugucucuccacaaccagccagaagaccacauggcugccugugcuucuggggucucugggaugcaagccgcucaccauguuccugaucgccgagaacaaaauuuggggccggcgcuccuggccccuuaaugaaggcaucauggcggucgggaucgugagcauucugcucuccagccugcucaagaacgauguuccucuggccggaccccuuaucgcuggcgggaugcugauugccuguuacgugaucucuggaagcuccgcugaccugucucucgagaaagccgccgaggucagcugggaagaggaagcugagcauuccggcgcgucucacaacauucugguggaaguucaggaugacgggacaaugaagaucaaagaugaggagagagacgauacgcuuaccauccugcucaaggccacacugcucgcugugagcggagucuauccucuguccauucccgccacccuuuuugugugguacuucuggcagaagaagaagcagcggucuggcguccugugggacacaccuagcccucccgaaguggagcgcgccguucuggaugacggcaucuauagaauuaugcagcgggggcuccugggacgcucccaggugggcgucgggguguuccaagaaaauguuuuucauaccauguggcacgugacgagaggagcuguccuuauguaccagggcaaacggcuggagcccagcugggccucugugaagaaagaccucaucuccuacgggggaggcuggagacugcagggcagcuggaacaccggggaggaagugcagguuauugcggucgagcccggaaagaauccuaaaaacgugcaaacagcucccggcaccuucaagacaccggaaggggaggugggagccaucgcccucgauuuuaagccuggcaccucugggucccccauugucaaucgcgaaggaaaaaucgugggccuguauggcaacgggguugugacaacgagcggaaccuacgucuccgcuaucgcccaggcgaaggcuucucaggagggcccucuucccgagauugaagacgagguguuccggaaaagaaaucugacaaucauggaucugcaccccgggagcggaaagacccgccgguaucucccugccauuguuagagaagccaucaaacgcaagcugcggacccuuauucuggcuccgacaagaguggucgccuccgagauggcugaagcccucaagggcaugcccauccgcuaccaaacgaccgcggugaaaagcgagcauacagggaaggagaucguugaccugaugugccacgccaccuuuacaaugcggcugcucucuccugugagaguccccaacuauaauaugauuaucauggaugaagcucauuucaccgacccuuccagcauugccgcucggggcuacaucucuacgcgcgugggaaugggcgaggccgccgcuauuuuuaugacagcgacacccccugggagcguggaagccuucccgcaguccaacgcugucauccaggaugaggaaagagacauccccgagcggucuuggaauagcggauaugaguggauuaccgauuuuccuggcaaaacaguuugguucgugcccuccaucaagucugggaacgacauugccaauugucuucgcaaaaacggaaagagagugauccagcugagccggaagaccuuugauacagaauaccagaaaaccaagaauaacgacugggacuacgucgugacgacagauauuuccgagaugggcgccaacuucagagcugaccgcguuaucgauccucggagaugccugaaacccgugauucucaaggacgggccggaacgcgucauccuggccggcccuaugcccgugaccguugcgagcgcugcccagcggagaggacgcaucggccggaaucacaacaaagagggggaucaguauauuuacaugggacagccccuuaauaacgacgaggaucaugcccacuggacagaagcuaagaugcugcucgacaauaucaacaccccugagggcauuauccccgcccuguucgaaccugagagagaaaagucugcggccauugauggggaguaucgccugagaggagaggcucggaaaacguuuguggaacucaugcgcagaggcgaccuuccggucuggcuguccuacaagguggccagcgagggguuccaauauuccgaucggcgcuggugcuuugacggcgaaagaaauaaccagguccuggaggaaaauauggauguggagaucuggaccaaagagggagaacggaagaaacucagaccccgcuggcuggacgcucggacauacucugacccucuugcccugagagaguucaaggaauuugcugccggccgccggagcguuuccggggaucucauccuggagauuggaaaacugccccagcaccucacccagagagcgcaaaacgcccuugacaaucuggugaugcugcauaacucugaacagggcgggcgggcuuaucgccacgccaucgaggagcucccugauacaauugaaacccugaugcuucuggcucucaucgccgugcugacaggaggcgucacccuguucuuucucagcggcagagggcuuggaaagacguccauuggccugcuguguguuauggccagcucugugcuccuguggauggcuuccguggagccccauuggaucgcggccagcaucauucuugaguucuuucugaugguccuccugaucccggagccugaccggcagcgcacaccccaggauaaucaacuggcuuacgugguuauugggcuccuuuucaugauccugaccguggccgccaacgagaugggacugcucgaaaccacaaagaaagaccugggcauugggcacgucgcuguggagaaucaccaucacgccgcgaugcuugaugucgaccugcauccugccucugcuuggacccucuacgccguggcuacaacgaucauuacccccaugaugagacacacaaucgaaaacaccacagccaacaucucccugaccgcgauugccaaucaggcugccauccugaugggacucgauaagggcuggccuauuagcaaaauggacaucggcguuccccuucuggcucuggggugcuauucucaggugaacccgcucacgcugaccgccgcuguccuuaugcugguggcccauuacgcgauuaucggaccuggccuccaagccaaggcuacacgggaggcccagaaacgcaccgcugccgggaucaugaagaaucccacaguugauggaauuguggccaucgaccuggaucccgucguguaugacgcgaaguuugaaaaacagcugggccagauuaugcuccuuauccuguguaccagccaaauucugcucaugagaacgacaugggcucugugcgaguccaucacccuugccacagggccucugaccacccucugggagggaucuccgggcaaguucuggaacacaacgaucgcugugagcauggccaauauuuuucggggcuccuaccuggccggggcuggacuggccuucagccucaugaaaucccuuggcgggggacgcagaggcaccggggcgcagggagaaacacugggcgagaaguggaaacggcagcugaaccagcucucuaagagcgaguucaauaccuauaagagauccggcaucauggagguugaccgcucugaagccaaagaggggcugaagcggggagagacaaccaaacacgcugucagcagaggcacggccaaacuucgcugguuuguggaacggaaccuggugaaacccgaggggaaggucauugaucucggauguggcagagggggaugggcuuacuauugcgccggccugaagaaaguuacagaagugaagggcuacaccaaagggggaccuggccacgaggaacccaucccuauggcgaccuacggguggaaucuggugaagcuccauuccggaaaagacgucuucuuuauucccccugagaagugugauacacuucugugcgacaucggcgagucuagcccgaaccccaccauugaagaggggcgcacacugcgggugcucaaaaugguugaaccuuggcugagaggaaaucaauucuguaucaagauccuuaaccccuauaugccuuccguggucgagacgcuggagcagaugcagcgcaagcacggcggcaugcucgugcggaauccccugagcagaaacucuacccaugaaauguacuggguuuccugcgggacaggaaauauugugagcgccgucaacaugaccucucgcaugcugcucaaucgguuuacaauggcucacagaaaaccgaccuaugagcgcgauguggaccugggcgccgggacgagacacguggcugucgaaccugagguugccaaccuugauaucauuggacagcggaucgaaaacauuaagcaugagcacaaauccaccuggcauuacgacgaggauaaucccuauaagacaugggcuuaccacggcagcuaugaagugaaacccucuggguccgccagcuccauggugaacggagucgugaagcugcucaccaagccuugggacguuauccccauggugacacaaaucgcgaugaccgauacaaccccuuucggccagcagcgcgucuuuaaagagaagguggacacgagaacaccgaaagccaagcggggcaccgcucaaauuauggaaguuaccgccaaauggcuguggggguuccuuagcagaaauaagaagccccggaucuguacacgcgaggaauuuacgagaaaagugcggucuaacgcugccauuggagccgucuucguggacgagaaucaguggaacagcgcgaaggaggcuguugaagaugagcgcuuuugggaccuggugcauagagaacgggagcuccacaaacagggcaagugcgcgaccugcgucuacaauaugauggggaaacgcgaaaagaagcugggagaguucggcaaagccaagggguccagagcuaucugguacauguggcugggcgcccgguuucucgaguucgaagcucugggauucaugaacgaggaucacugguuuucucgcgaaaauagccuuuccggcguggagggggagggacugcauaaacucggcuauauucugagagacaucucuaagaucccugggggaaacauguacgccgaugacacagcgggcugggauacccggauuacagaagacgaucuucagaaugaggcccgcaucaccgacauuauggaacccgagcacgcucugcucgccagaagcaucuucaaacugacauaucaaaacaaggucgugcggguucagcgcccugcuaaaaaugggaccgugauggaugucauuuccagacgggaccagagaggcucuggacaggugggcacguacgggcugaacaccuuuacaaauauggaagcccaacucauccgccagauggagagcgagggaaucuucucccccagcgaacuggagaccccgaaccuugcggaacgggugcuggauuggcucgagaaguauggcguugaaagacugaagcgcauggccauuucuggggacgacuguguggucaaaccuaucgaugaccgguuugcuacagcccuuaccgcucugaacgauaugggaaaggugagaaaagacauuccccagugggagccuuccaagggcuggaaugauuggcagcaaguucccuucugcagccaucacuuucaccagcucaucaugaaagacgggcgcgagauuguggucccuugucggaaccaggaugaacuggugggcagagcccgcgucucucagggagcuggcuggucccugcgggagacggccugccucggaaagagcuacgcgcaaauguggcagcugauguauuuccauagacgcgaccuucggcuggccgcuaaugccaucuguuccgccgugcccguugauuggauuccgacaucuagaaccacauggagcauccacgcucaucaccaguggaugaccacggaagacaugcucuccguguggaaccgggucuggaucgaggaaaauccuuggauggaggauaagacccauauuagcucuuggggagacgugcccuaccugggcaaaagagaggaccaauggugcgggucccuuaucggacugacagcccgcgcgaccugggcuacaaacauucagguugccaucaaucaggugcggagacucauuggcaacgaaaauuaccuggauuauaugaccagcaugaagcgcuuuaaaaacgagucugaccccgaaggggcccugugguga

SEQ ID NO: 19359 - RNA, 9879 nt, Artificial Sequence
  derived and/or modified CDS sequence (opt5) from DENV-1__JQ045639__SS-prME
agcgugaccauguuccugaugcucaugcccaccgcccuggcuuuucaccuuacgaccagaggcggggaaccucauaugaucguguccaagcaggaacggggaaaaucucuccuguucaagacaagcgccggcguuaacaugugcacccugaucgcgauggaccuuggggagcugugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggugacaccuagcauggccaugagaugcgugggcauugggucccgggauuucguugagggacuuagcggcgcuacguggguggacguggugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuuuccacacaagaugaaaaggggguuacgcagaacggacggcugaucaccgcgaaucccauugugacagacaaagagaagccugucaacaucgaagcugagccgcccuucggcgagagcuauauugugaucggggccggagaaaaagcccuuaagcucucuugguuuaagaaaggcagcuccauugggaagauguucgaggcuaccgccagaggcgcucgccggauggccauccugggagauacagcgugggacuuuggcucuaucgggggaguguucaccagcguuggcaaacugguccaucagauuuuugggacggccuacggaguccuguucuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguuuaccgugguugugggagaugucgccggcauucucgcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcugaagcugcgcgauuccuauacccaggucugcgaccaccggcuuaugagcgcggccauuaaagauucuaaggcuguucacgccgacaugggcuacuggaucgaauccgagaaaaaugaaacauggaagcucgccagagcuagcuucaucgaggugaagaccuguauuuggcccaaaucucauacacugugguccaacggggugcuggaaagcgagaugaucauuccgaagaucuauggaggcccuauuucucaacacaauuaccgccccggguacuuuacccagacggccggaccuuggcaucucggcaaacuggagcuugauuucgaccugugcgaagggaccacagucgugguugaugagcacugcggaaaccggggccccagccucagaaccacaaccgugacgggcaagaucauccacgaaugguguugccgguccuguacacugccuccccugcgcuuuagaggggaggacggaugcugguauggcauggagauucggccggucaaagaaaaggaggaaaaucuugucaagagcaugguuucugcgggguccggagagguggacagcuucucccucggccugcuguguaucucuauuaugaucgaagaggucaugagaagccgcuggucccggaaaaugcucaugaccgggacacuggcuguguuuuuccuucugauuaugggacagcucaccuggaacgaucugaucagacugugcauuaugguuggcgccaaugccucugaccgcaugggcauggggaccacauaccuugcucugauggccacguuuaagaugagaccuauguucgcggugggacuccuguuucggcgccucaccagcagagagguccugcuucugacaaucggccucucccugguggcuucuguggaacugcccaacagccuugaggaacugggggauggacucgccaugggcaucaugauucugaaacuccugaccgacuuccaaucccaucagcuuugggccacacugcucagccugaccuuuaucaagacgacauucucucugcacuaugcuuggaaaaccauggccaugguccuuuccauuguuagccuguuuccccucugucugucuaccacaucccagaagaccacauggcucccugugcugcuugggagccugggaugcaagccgcugacgauguuccucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggaccaugaagaucaaagaugaggagagagacgauacacugaccauccuucugaaggcgacacuccuggccguuucuggaguguauccucucagcauucccgcuacccuguucgucuggcauuuuuggcagaagaagaagcagcgguccggcgugcuuugggacacgccuucucccccggaagucgagcgcgccgugcuggaugacggcaucuacagaauuaugcagcgggggcugcucggacgcagccagguuggcgugggggucuuccaagaaaacguguuucacaccauguggcacguuacaagaggagccgugcugauguaucagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccucuacggcaauggggugguuaccacauccggaaccuaugugagcgccaucgcucaggcccgggcgucccaggagggcccucugcccgagauugaagacgaggucuucagaaagcgcaaccuuaccaucauggaucugcaucccgggucuggaaaaacacggagauaccugccugcuauugugcgcgaagccaucaagcggaaacucagaacgcugauucuugccccgacccgcguuguggcuagcgagauggccgaagcucugaagggcaugcccauccgguaucaaacaaccgccgucaaguccgagcacacagggaaagagaucguggaccucaugugccaugcgaccuuuacgaugagacugcugagcccuguucgggugcccaauuacaacaugauuaucauggaugaagcccacuucacagacccuucuuccauugcugcccgcggcuauaucagcaccagagucggaaugggcgaggcugccgccauuuuuaugaccgcuacacccccugggucuguggaagcguucccgcagagcaaugccgugauccaggaugaggaacgggacauccccgagcgcuccuggaacucuggauacgaguggauuaccgauuuuccuggcaagacagucugguucguucccagcaucaaauccgggaaugacauugcuaacugucucagaaagaauggaaaacgggugauccagcuuucuagaaagaccuucgauacggaauaucaaaagaccaagaacaacgacugggacuacguggucaccacagauauuagcgagaugggcgccaauuuucgcgccgaccgggugaucgauccuagacgcugccugaagcccguuauucugaaagacgggccggaacgggugauccucgcuggcccuaugcccgucaccguggccuccgcggcucagagacgcggacggaucggcagaaaccauaauaaggagggggaucaguacauuuauaugggacagccccugaacaaugacgaggaucacgcccacuggacggaagccaaaaugcuucuggacaacaucaauaccccugagggcauuauccccgcucucuucgaaccugagcgcgaaaagagcgccgcgauugauggggaguacagacugcggggagaggcccgcaagacauuuguugaacugaugagacggggcgaccucccgguguggcuuucuuauaaagucgcuuccgagggguuccaauacagcgaucgcagauggugcuuugacggcgaacggaacaaucaggugcuggaggaaaacauggaugucgagaucuggaccaaggagggagaacgcaaaaagcugcgcccccgguggcucgacgccagaacauauuccgacccucuggcucuuagagaguucaaagaauuugccgcuggccggagaucugugagcggggaucugauccucgagauuggaaagcugccccagcaucugacccagcgggcccaaaaugcgcucgacaaccuuguuaugcugcacaauuccgaacagggcgggcgcgccuacagacaugcuauggaggagcugccugauacaaucgaaacccucaugcugcuugcccugauugcugugcucacgggaggcgugacacuguucuuucugucuggccgggggcucggaaaaaccagcaucggccuucugugugucauggccuccagcgcccugcucuggauggcuucuguugagccccacuggauugcggccuccaucauccuggaguucuuucuuauggugcugcucauuccggagccugaccgccagagaacaccccaggauaaccaacuggcuuauguggucaucgggcuccucuucaugauucuuacaguggccgccaaugagaugggacugcuggaaaccacaaagaaggaccucggcaucgggcacgcugccguugagaaccaucaccaugcggccaugcuggauguggaccuucacccugcuagcgccuggacgcuguacgcugucgccaccacaauuaucacccccaugaugcggcauacaauugaaaacaccacggcgaauaucucucucaccgccaucgcuaaccaggccgcuauucugaugggacuggauaaaggcuggccuaucuccaagauggacauuggcgugccccuccuugcccuggggugcuacagccaggucaauccgcugacacucaccgcugccgugcugaugcuuguugcgcacuaugccaucauuggaccuggccugcaagcuaaagccacacgcgaggcucagaagagaaccgccgccgggaucaugaaaaaccccacgguggauggaaucgucgcgauugaccucgaucccgugguuuacgacgcuaaguuugaaaagcagcugggccagaucaugcugcucauucuuuguacaucucaaauccugcugaugcggaccacaugggcccucugcgagagcauuacccuggcuaccgggccucuuacaacgcugugggagggauccccgggcaaauucuggaauaccacaaucgccgugucuauggccaacaucuuccgcggcagcuaucucgcuggggccggacuggcguuuucccugaugaaaagccucggcgggggaagacggggcaccggggcccagggagaaacacuuggcgagaaauggaagagacagcugaaucagcuguccaaaucugaguucaacaccuacaagcgcagcggcauuauggaggucgaccgguccgaagcuaaggaggggcucaaaagaggagagacgacaaagcacgccgugucucgcggcaccgcuaaacugcggugguuuguggaaagaaaucuuguuaagcccgaggggaaagucaucgaucugggauguggccgcgggggauggagcuauuacugcgccggccucaagaaggugaccgaagugaaaggcuauacaaaagggggaccuggccaugaggaacccauuccuauggcgaccuacggguggaaccuggucaaacugcacuccggaaaggacguuuucuuuauucccccugagaaaugugauacacuccuuugcgacauuggcgagucuagcccgaaucccacgaucgaagaggggcggacccugagagugcugaagaugguggaaccuuggcuccgcggaaaccaauucuguauuaaaauccugaaucccuacaugccuuccgucguggagacacuugagcagaugcagcggaagcauggcggcaugcugguuagaaacccccucagccgcaauucuacccacgaaauguauuggguguccugcgggacaggaaacaucgucagcgccgugaauaugaccucucggaugcugcugaacagauuuacgauggcucaccgcaagccgaccuacgagagagauguugaccucggcgccgggacacggcauguggcugucgaaccugagguggccaaccuggauauuaucggacagcgcauugaaaauaucaaacacgagcauaaguccaccuggcacuaugacgaggauaaccccuacaaaacaugggcuuaucauggcagcuacgaagugaagcccucuggguccgccagcuccauggucaauggaguugugaaacuucugaccaagccuugggacgugauucccauggucacacaaaucgcgaugaccgauacgacaccuuucggccagcagagaguguuuaaggagaaaguugacacccggaccccgaaggccaaaagaggcacagcucaaaucauggaagugacggccaaguggcucuggggguuccugagccggaacaaaaagccccgcauuuguaccagagaggaauuuacacggaagguccgcucuaaugcugccaucggagccguguucguugacgagaaccaguggaauagcgcgaaagaggcuguggaagaugagagauuuugggaccuuguccaccgggaacgcgagcugcacaagcagggcagaugcgcuaccugcguguauaacaugauggggaaacgggaaaagaaacucggagaguucggcaaggccaaggggucccgcgcuauuugguacauguggcugggcgccagauuccuggaguuugaagcucucggauucaugaaugaggaucauugguuuucucgggaaaacagccuguccggcguugagggggagggacuucacaaacugggcuacauccuccgcgacauuucuaagaucccugggggaaauauguaugccgaugacacagcgggcugggauaccagaaucacagaagacgaucugcagaacgaggcccggauuaccgacaucauggaacccgagcaugcccuucuggccaaaagcauuuucaagcucacguaccaaaauaaagugguccgcgugcagagaccugcuaagaacgggaccgucauggaugugaucucccggagagaccagcgcggcucuggacagguuggcacauaugggcugaauaccuuuacaaacauggaagcccaacugauucggcagauggagagcgagggaaucuucucccccagcgaacucgagaccccgaaccuggcggaaagagugcuugauuggcuggagaaauacggcgucgaacgccucaagcggauggccaucucuggggacgacuguguggugaagccuauugaugacagauuugcuacggcccugacagcucuuaaugauaugggaaaaguucgcaaggacaucccccagugggagccuuccaaaggcuggaacgauuggcagcaagugcccuucugcagccaccacuuucaucagcugauuaugaaggacgggcgggagaucgucgugccuuguagaaaucaggaugaacucguuggccgcgcccgggugucucagggagcuggcuggucccugagagagaccgccugccuggggaaaagcuaugcgcaaauguggcagcucauguacuuccaccgccgggaccugagacuugccgcuaacgccauuuguuccgccguccccguggauuggaucccgacaucucggaccacguggagcauucaugcucaccaucaguggaugaccacagaagacaugcuguccgucuggaauagaguguggaucgaggaaaacccuuggauggaggauaagacccacaucagcucuugggaggacguucccuaucucggaaagcgcgaagaccaauggugcggcucccugauugggcuuacagcccgggcgaccugggcuacaaauauccagguggccauuaaccaggucagacgccugaucggaaaugagaacuaccucgauuacaugaccagcaugaaaagauuuaagaaugaaucugaccccgagggcgcccugugguga

SEQ ID NO: 19360 - RNA, 9879 nt, Artificial Sequence
  derived and/or modified CDS sequence (opt5) from DENV-1__JQ045641__SS-prME
agcgugaccaugcugcucaugcugaugcccacagcccuugcuuuccaccugacgaccagaggcggggaaccucauaugaucguguccaagcaggaacgggggaagucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguugcgcagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcguuggcaaacucguccaucagauuuucgggaccgcuuacggagugcuguuuuccggcgugagcuggacgaugaagaucgggauuggcguccuucugaccuggcucggacucaauucuagauccacaagccugucuaugaccuguaucgccgugggccuuguuacacucuaccugggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcucucugcggccauuggcaaggcuugggaggagggggucugcggcaucagaagcgccacgcgccuggaaaacaucauguggaaacagauuuccaacgagcuuaaucauauccugcucgaaaacgacaugaaguucacagugguugugggagaugucgcuggcauucuggcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggagguggaggacuacggauucggcauuuuuaccacgaacaucuggcugaaacuucgcgauuccuauacacaggucugcgaccaccggcucaugagcgccgcuauuaaagauucuaaggccguucacgccgacaugggcuacuggaucgaauccgagaaaaaugaaaccuggaagcuggcuagagccagcuucaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcgggaccuuggcaucugggcaaacuugagcuggauuuugaccucugcgaagggacgaccgucgugguugaugagcacugcggaaaccggggccccagccugagaacaaccacagugaccggcaagaucauccacgaaugguguugccgguccuguacgcugccuccccuucgcuucagaggggaggacggaugcugguauggcauggagauucggccggucaaagaaaaggaggaaaaucucgucaagagcaugguuucugcuggguccggagagguggacagcuuuucccugggccugcucuguaucucuauuaugaucgaagaggucaugagaagccgcuggucccggaaaaugcugaugacagggacccuugccguguucuuucugcucauuaugggacagcugacauggaacgaucugaucagacuuugcauuaugguuggcgccaaugcuucugaccgcaugggcauggggaccaccuaccuggcccucauggcgacauucaagaugagaccuauguuugcugugggacugcuguuccggcgccugacgagcagagagguccuucugcucaccaucggccugucccugguggccucuguggaacuucccaacagccuggaggaacucggggauggacuggccaugggcaucaugauucucaaacugcuuacagacuuucaaucccaucagcugugggcuacccuccugagccugacauucaucaagaccacgcuuucucugcacuaugccuggaaaacaauggcuaugguccucuccauuguuagccuguuuccccucugucugucuaccaccucccagaagacaaccuggcuuccugugcugcuggggagccucggaugcaagccgcugacaauguuccuuaucgccgagaauaaaauuuggggccggcgcucuuggccccugaacgaaggcaucauggcgguggggaucgucuccauucuccugagcucccuccugaagaacgaugugccucuugccggaccccugaucgcuggcgggaugcugauugccuguuacguuaucagcggaucuagcgcugaccucucccuggagaaagccgccgaggugucuugggaagaggaagcugagcauagcggcgcgucccacaauauucuugucgaagugcaggaugacgggacgaugaagaucaaagaugaggagagagacgauacccugacaauccuccugaaggccacccuccuggcuguuucuggaguguauccucuuagcauucccgccacacuguuugucugguacuucuggcagaagaagaagcagcgguccggcgugcugugggacaccccuucucccccggaagucgagcgcgccgugcucgaugacggcaucuauagaauuaugcagcgggggcugcuuggacgcagccagguuggcgugggggucuuccaagaaaacguguuucauacgauguggcacguuaccagaggagcugugcugauguaccagggcaaacggcucgagccuuccugggccagcgucaagaaagaccugaucucuuacgggggaggcuggagacuccagggcuccuggaauacaggggaggaaguccaggugauugcgguugagcccggaaagaacccuaaaaauguccaaaccgcucccggcacauucaagaccccggaaggggaggugggagccaucgcccuggauuuuaagccuggcacaagcgggucucccauugugaaccgcgaaggaaaaaucgucggccuuuauggcaauggggugguuacgaccuccggaacauacgugagcgcuaucgcccaggcgaaggcuucccaggagggcccucugcccgagauugaagacgaggucuuccggaaaagaaaccugaccaucauggaucuccaccccgggucuggaaagacccgccgguaucugccugccauugugagagaagccaucaaacgcaaacuucggacacugauucucgcuccgacgagaguuguggccagcgagauggcugaagcccugaagggcaugcccauccgcuaccaaaccacagcggucaaauccgagcauaccgggaaggagaucguggaccugaugugccacacaaccuuuacgaugcggcuccuuagcccuguuagagugcccaauuauaacaugauuaucauggaugaagcccauuucacagacccuucuuccauugcugcccggggcuacaucagcacccgcgucggaaugggcgaggcugccgccauuuuuaugaccgcuacacccccugggucuguggaagcguucccgcagagcaaugccgugauccaggaugaggaaagagacauccccgagcgguccuggaacucuggauaugaguggauuaccgauuuuccuggcaaaacagucugguucguucccagcaucaaguccgggaaugacauugcuaacugucugcgcaaaaauggaaagagagugauccagcugucucggaagaccuuugauacggaauaccagaagaccaagaacaacgacugggacuacguggucaccacagauauuagcgagaugggcgccaauuucagagccgaccgcgugaucgauccucggagaugccucaaacccguuauucugaaggacgggccggaacgcgugauccuugcuggcccuaugcccgucaccguggccuccgcggcucagcggagaggacgcaucggccggaaccacaauaaagagggggaucaguauauuuacaugggacagccccugaacaaugacgaggaucaugcccacuggacggaagccaagaugcuccuggacaacaucaauaccccugagggcauuauccccgcucuguucgaaccugagagagaaaagagcgccgcgauugauggggaguaucgccucagaggagaggcccggaaaacauuuguugaacuuaugcgcagaggcgaccugccgguguggcugucuuacaaggucgcuuccgagggguuccaauauagcgaucggcgcuggugcuuugacggcgaaagaaacaaucaggugcucgaggaaaacauggaugucgagaucuggaccaaagagggagaacggaagaaacugagaccccgcuggcuugacgcccggacauacuccgacccucuggcucucagagaguucaaggaauuugccgcuggccgccggucugugagcggggaucugauccuggagauuggaaaacucccccagcaccuuacccagagagcccaaaaugcgcuggacaaccugguuaugcuccauaauuccgaacagggcgggcgggccuaucgccacgcuauggaggagcugccugauacaaucgaaacccuuaugcugcucgcccugauugcugugcugacgggaggcgugacacucuucuuucuuucuggcagagggcugggaaagaccagcaucggccugcucugugucauggccuccagcguucugcuuuggauggccucuguggagccccauuggauugcugcguccaucauccuggaguucuuucucauggugcugcugauuccggagccugaccggcagcgcacaccccaggauaaccaacucgccuacgucgugaucgggcuucuguucaugauucugacaguugcugccaaugagaugggacuccuggaaaccacaaagaaagaccuuggcaucgggcacguggccgucgagaaccaccaucacgcugccaugcuggauguggaccuccauccugcgagcgccuggacgcuguacgcugucgccaccacaauuaucacccccaugaugagacacacaauugaaaacaccacggcuaauaucucucugaccgccaucgcgaaccaggccgcuauucucaugggacuugauaagggcuggccuaucuccaaaauggacauuggcgugccccugcuggcccucgggugcuauagccagguuaauccgcugacacuuaccgcugccgugcugaugcucgucgcucauuacgccaucauuggaccuggccugcaagcgaaggccacacgggaggcucagaaacgcaccgccgcugggaucaugaagaaccccacgguggauggaaucguugccauugaccuggaucccguggucuaugacgccaaguuugaaaaacagcucggccagaucaugcuucugauucuguguacaucucaaauccuccugaugagaaccacaugggcgcuuugcgagagcauuacccuggcuaccgggccucucacaacgcugugggagggauccccgggcaaguucuggaauaccacaaucgccgugucuauggcuaacaucuuucggggcagcuaccuggccggggccggacucgcuuucucccuuaugaaaagccugggcgggggacgcagaggcaccggggcccagggagaaacacugggcgagaaguggaaacggcagcucaaucagcuguccaagucugaguucaacaccuauaagagaagcggcauuauggagguggaccgcuccgaagcgaaagaggggcuuaagcggggagagacgacaaaacacgccguuucuagaggcaccgcuaagcugcgcugguuugucgaacggaaucucgugaaacccgaggggaaggugaucgaucugggauguggcagagggggauggagcuacuauugcgccggccugaagaaagucaccgaaguuaagggcuacacaaaagggggaccuggccacgaggaacccauuccuauggcuaccuacggguggaaccucgugaaacuucauuccggaaaagacguguucuuuauucccccugagaagugugauacacugcugugcgacaucggcgagucuagcccgaaucccacgaucgaagaggggcgcacccuccggguccugaaaaugguggaaccuuggcuuagaggaaaccaauucuguauuaagauccugaaucccuauaugccuuccguuguggagacacucgagcagaugcagcgcaagcacggcggcaugcugguccggaacccccugagcagaaauucuacccaugaaauguacuggguguccugcgggacaggaaacaucguuagcgccgugaauaugaccucucgcaugcuccugaaccgguuuacgauggcgcacagaaaaccgaccuaugagcgcgaugucgaccuuggcgccgggacaagacacguggcuguggaaccugaggucgccaaccuggauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcuccugaccaagccuugggacgugauucccaugguuacacaaaucgcuaugaccgauacgacaccuuucggccagcagcgcguguuuaaagagaaggucgacaccagaaccccgaaagccaagcggggcacagcgcaaaucauggaagugacggccaaauggcuuuggggguuccugagcagaaacaagaagccccggauuuguacccgcgaggaauuuacaagaaaaguucggucuaaugcugccaucggagcuguguucgucgacgagaaccaguggaauagcgccaaggaggccguggaagaugagcgcuuuugggaccucguucauagagaacgggagcugcacaaacagggcaagugcgcgaccugcguguacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcgucgagggggagggacuccauaaacugggcuauauccuuagagacauuucuaagaucccugggggaaauauguacgccgaugacacagcuggcugggauacccggaucacagaagacgaucugcagaacgaggcccgcauuaccgacaucauggaacccgagcacgcgcuccuggccaaaagcauuuucaagcugacguaucaaaauaaaguggucagagugcagcggccugcuaagaacgggaccguuauggaugugaucucccgcagagaccagcggggcucuggacaggucggcacauacgggcucaauaccuuuacaaacauggaagcccaacugauuagacagauggagagcgagggaaucuucucccccagcgaacuugagaccccgaaccuggcugaacgcgugcucgauuggcuggagaaguauggcguggaacggcuuaaaagaauggccaucucuggggacgacuguguugugaagccuauugaugaccgcuuugcgacggcccugacagcucucaaugauaugggaaaaguccggaaggacaucccccagugggagccuuccaaaggcuggaacgauuggcagcaagugcccuucugcagccaucacuuucaccagcugauuaugaaggacgggagagagaucguugugccuugucgcaaucaggaugaacuggucggccgggccagagugucucagggagcuggcuggucccuccgcgagaccgccugccugggaaagagcuacgcucaaauguggcagcuuauguauuuccaucggagagaccugcgccucgccgcgaacgccauuuguuccgcuguccccguggauuggaucccgacaucucggaccacguggagcauucacgcccaucaccaguggaugaccacagaagacaugcuguccguuuggaauagaguguggaucgaggaaaacccuuggauggaggauaaaacccauaucagcucuuggggagacguccccuaccuuggcaagcgggaggaccaauggugcgggucccugauuggacucacagccagagcuaccugggccacaaauauccagguggcgauuaaccagguucgccggcugaucggcaaugaaaacuaccuggauuauaugaccagcaugaaaagauuuaagaaugagucugaccccgaaggggcucucugguga

SEQ ID NO: 19361 - RNA, 9879 nt, Artificial Sequence
  derived and/or modified CDS sequence (opt5) from DENV-1__JQ045642__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucagugugaaaaccugaaauacuccgugaucgucaccgugcacacaggcgaccagcaucaaguugggaaugagagcaccgaacacggaacaaccgccacgauuacaccccaagcuccuaccaccgagauccagcucacagacuauggcgcccugacccuggauugcucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaauguagacugaagauggauaaacuuacacugaaggggaugagcuacgugaugugcaccggcucuuucaaacucgagaaggaagucgcugagacccagcacggaacagugcugguucagauuaaguaugagggcaccgacgccccguguaaaaucccuuucuccacacaagaugaaaagggggugacgcagaacggacggcugaucaccgcgaaucccauugucacagacaaagagaagccugugaacaucgaagcugagccgcccuuuggcgagagcuacauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuauggagugcucuuuuccggcgucagcuggaccaugaagaucgggauuggcgugcugcuuacauggcugggacucaauucuagauccaccagccugucuaugacaugcaucgcuguuggccuggugacccuuuaccucggggucauggugcaggccgauuccggauguguuauuaacuggaaaggccgcgaacugaagugcgggagcggaaucuucgugacaaaugagguccacaccuggacggaacaauacaaguuucaggcugacuccccuaaacggcugucugccgcgauuggcaaggccugggaggaggggguguguggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguauaaauacucuuggaaaagcuggggaaaggccaagauuaucggcgccgacgugcagaauaccacauuuaucauugaugggccuaacacccccgaaugcccugacgaucagagagcuuggaauaucugggaggucgaggacuauggauucggcauuuuuacgacaaacaucuggcugaagcugcgcgauuccuacacccagguuugugaccaccggcuuaugagcgcggccauuaaagauucuaaggcugugcacgccgacaugggcuauuggaucgaauccgagaaaaaugaaacauggaagcucgccagagcuagcuucaucgaggugaagaccugcauuuggcccaaaucucauacacugugguccaacgggguccuggaaagcgagaugaucauuccgaagaucuacggaggcccuauuucucaacacaauuaucgccccggguacuucacccagacggccggaccuuggcaucucggcaaacuggagcuugauuuugaccugugcgaagggaccacagugguuguggaugagcacuguggaaaccggggccccagccucagaaccacaaccgucacgggcaagaucauccacgaauggugcugucgguccugcacacugccuccccugcgcuucagaggggaggacggauguugguacggcauggagauucggccggugaaagaaaaggaggaaaaucuuguuaagagcauggugucugcgggguccggagaggucgacagcuuuucccucggccugcugugcaucucuauuaugaucgaagaggugaugagaagccgcuggucccggaaaaugcucaugaccgggacacuggcuguuuucuuucuucugauuaugggacagcucaccuggaacgaucugaucagacuguguauuauggugggcgccaaugccucugaccgcaugggcauggggaccacauaucuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuacgcuuggaaaaccauggccaugguucuuuccauugugagccuguucccccucugccugucuaccacaucccagaagaccacauggcucccugugcugcuugggagccugggauguaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuugcuaugugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuacccucucagcauucccgcuacccuguucgugugguauuucuggcagaagaagaagcagcgguccggcguccuuugggacacgccuucucccccggaagugggccgcgccguucuggaugacgggaucuacagaauuaugcagcggggacugcucggccgcagccaggugggggucggaguguuucaagagaacguuuuccauaccauguggcacgugacaagaggcgccguccugauguaucaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuacgggaauggaguugugaccacauccggcaccuaugucagcgccaucgcucaggccaaggcgucccaggaagggccucugcccgagauugaggacgaaguguuucggaaaagaaaccuuaccaucauggaucugcaccccggaucuggcaagacacgccgguaccugccugcuauuguuagagaggccaucaaacgcaagcuccggacgcugauucuugccccgaccagaguggucgcuagcgaaauggccgaggcucugaaggggaugcccauccgcuaucaaacaaccgccgugaaauccgaacauacaggcaaggagaucguugaccucaugugucacgcgaccuucacgaugcggcugcugagcccugugagaguccccaauuacaacaugauuaucauggaugaggcccauuuuacagacccuucuuccauugcugcccggggauauaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuacgaguggauuaccgauuucccugggaaaacaguuugguuugugcccagcaucaaguccggaaaugacauugcuaacugccuccgcaaaaauggcaagagagugauccagcuuucucggaagaccuucgauacggaguaucagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguacauuuauaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaccgccugagaggcgaggcccggaaaacauucguggagcugaugcgcagaggggaccucccggucuggcuuucuuauaagguggcuuccgaaggcuuucaauacagcgaucggcgcugguguuucgacggagagagaaacaaucagguccuggaagagaacauggauguggaaaucuggaccaaagagggcgagcggaagaaacugagaccccgcuggcucgacgcccggacauauuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaccgccacgcuauggaggaacugccugauacaaucgagacccucaugcugcuugcccugauugcugugcucacgggcggcgucacacuguuuuuccugucugggagaggacucggcaagaccagcaucgggcuucugugcguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuaugugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggauguuacagccaggugaauccgcugacacucaccgcugccguccugaugcuuguggcucauuaugccaucauuggcccugggcugcaagcgaaggccacacgggaagcucagaaacgcaccgccgcuggaaucaugaagaaccccacgguugauggcaucguggccauugaccucgaucccgucguguacgacgccaaguucgagaaacagcuggggcagaucaugcugcucauucuuugcacaucucaaauccugcugaugagaaccacaugggcgcucugugaaagcauuacccuggcuaccggaccucuuacaacgcugugggagggcuccccgggcaaguuuuggaauaccacaaucgccgugucuauggcuaacaucuuccgggggagcuaucucgccggagccggccuggcuuucucccugaugaaaagccucgggggaggccgcagagggaccggagcccagggcgagacacuuggcgaaaaguggaaacggcagcugaaucagcuguccaagucugaguuuaacaccuacaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugcgggagaggaggcuggagcuauuacugugccggccucaagaaaguuaccgaggugaagggguauacaaaaggaggcccugggcacgaggagcccauuccuauggcuaccuacggauggaaccuggugaagcugcauuccggcaaagacgucuuuuucauucccccugaaaagugcgauacacuccuuugugacauuggggagucuagcccgaaucccacgaucgaggaaggacgcacccugcgggugcugaaaaugguugagccuuggcucagaggcaaccaauuuugcauuaagauccugaaucccuacaugccuuccguggucgaaacacuugagcagaugcagcgcaagcacggcgggaugcuggugcggaacccccucagcagaaauucuacccaugagauguauuggguuuccuguggaacaggcaacaucgugagcgccgucaauaugaccucucgcaugcugcugaaccgguucacgauggcgcacagaaaaccgaccuacgaacgcgauguggaccucggggccggaacaagacacguggcugucgagccugaaguugccaaccuggauauuaucggccagcggauugagaauaucaagcaugaacacaaauccaccuggcauuaugacgaggauaaccccuacaagacaugggcuuaucacgggagcuacgaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuugcacccgcgaagaguucacaagaaaagugcggucuaaugcugccaucggcgcugucuuuguggacgaaaaccaguggaauagcgccaaggaggccguugaggaugaacgcuucugggaccuugugcauagagagcgggaacugcacaaacaggggaagugcgcgaccugugucuauaacaugaugggaaaacgcgagaagaagcucggcgaauuugggaaagcuaagggcuccagagccauuugguacauguggcugggagcccgguuccuggaguucgaggcucucggcuuuaugaaugaagaucacugguucucucgcgagaacagccuguccgggguggaaggagagggccuucauaaacugggguacauccucagagacauuucuaagaucccuggaggcaauauguaugccgaugacacagcugggugggauacccggaucacagaggacgaucugcagaacgaagcccgcauuaccgacaucauggagcccgaacacgcgcuucuggccaaaagcauuuuuaagcucacguaccaaaauaaagucgugagaguucagcggccugcuaagaacggcaccgugauggaugucaucucccgcagagaccagcggggaucuggccagguggggacauauggacugaauaccuucacaaacauggaggcccaacugauuagacagauggaaagcgagggcaucuuuucccccagcgagcucgaaaccccgaaccuggcugagcgcgugcuugauuggcuggaaaaguacgggguugagcggcucaaaagaauggccaucucuggagacgacugcguggucaagccuauugaugaccgcuucgcgacggcccugacagcucuuaaugauaugggcaaagugcggaaggacaucccccagugggaaccuuccaaaggguggaacgauuggcagcaaguucccuuuuguagccaucacuuccaccagcugauuaugaaggacggcagagagaucguggucccuugccgcaaucaggaugagcucgugggacgggccagagucucucagggcgcuggguggucccugcgcgaaaccgccugucugggaaagagcuaugcucaaauguggcagcucauguacuuucaucggagagaccugcgccuugccgcgaacgccauuugcuccgcugugcccguugauuggaucccgacaucucggaccacguggagcauucacgcccaucaccaguggaugaccacagaggacaugcuguccguguggaauagagucuggaucgaagagaacccuuggauggaagauaaaacccauaucagcucuuggggcgacgugcccuaucucgggaagcgggaggaccaaugguguggaucccugauuggccuuacagccagagcuaccugggccacaaauauccagguugcgauuaaccaggugcgccggcugaucgggaaugagaacuaccucgauuacaugaccagcaugaaaagauucaagaaugaaucugaccccgagggcgcucugugguga

SEQ ID NO: 19362 - RNA, 9879 nt, Artificial Sequence
  derived and/or modified CDS sequence (opt5) from DENV-1__JQ045644__SS-prME
agcgugaccaugcugcucaugcugaugcccaccgcccuugcuuuccaccugacgaccagaggcggggaaccucauaugaucgucuccaagcaggaacgggggaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccgcguucaagaugagaccuauguuugcugucggacuccuguuccggcgccucacgagcagagaggugcugcuucugaccaucggccucucccugguggccucugucgaacugcccaacagccuugaggaacugggggauggacucgccaugggcaucaugauucugaaacuccugacagacuuucaaucccaucagcuuugggcuacccugcucagccugacauucaucaagaccacguuuucucugcacuaugccuggaaaacaauggcuaugguucuuuccauugugagccuguucccccucugucugucuaccaccucccagaagacaaccuggcucccugugcugcuugggagccugggaugcaagccgcugacaauguuucucaucgccgagaauaaaauuuggggccggcgcucuuggccccugaacgaaggcaucauggcggucgggaucguguccauucuucugagcucccuccugaagaacgauguuccucucgccggaccccugaucgcuggcgggaugcuuauugccuguuacgugaucagcggaucuagcgcugaccugucccuggagaaagccgccgaggucucuugggaagaggaagcugagcauagcggcgcgucccacaauauucucguggaaguucaggaugacgggacgaugaagaucaaagaugaggagagagacgauacccugacaauccuucugaaggccacccuccuggcugugucuggagucuauccucucagcauucccgccacacuguucgugugguacuucuggcagaagaagaagcagcgguccggcguccuuugggacaccccuucucccccggaaguggagcgcgccguucuggaugacggcaucuauagaauuaugcagcgggggcugcucggacgcagccaggugggcgucgggguguuucaagaaaacguuuuccauacgauguggcacgugaccagaggagcuguccugauguaccagggcaaacggcuugagccuuccugggccagcgugaagaaagaccugaucucuuacgggggaggcuggagacuccagggcuccuggaauacaggggaggaagugcagguuauugcggucgagcccggaaagaacccuaaaaaugugcaaaccgcucccggcacauuuaagaccccggaaggggaggugggagccaucgcccuggauuucaagccuggcacaagcgggucucccauugucaaccgcgaaggaaaaaucgugggccucuauggcaaugggguugugacgaccuccggaacauacgucagcgcuaucgcccaggcgaaggcuucccaggagggcccucugcccgagauugaagacgagguguuucggaaaagaaaccuuaccaucauggaucugcaccccgggucuggaaagacccgccgguaucugccugccauuguuagagaagccaucaaacgcaagcuccggacacugauucuugcuccgacgagaguggucgccagcgagauggcugaagcccugaagggcaugcccauccgcuaccaaaccacagcggugaaauccgagcauaccgggaaggagaucguugaccucaugugccacgccacauucaccaugcggcugcugagcccugugagaguccccaauuauaacaugauuaucauggaugaagcucauuuuacggacccuucuuccauugccgcucggggcuacaucagcacacgcgugggaaugggcgaggccgccgcuauuuucaugaccgcgacacccccugggucuguggaagccuuuccgcagagcaaugcugucauccaggaugaggaaagagacauccccgagcgguccuggaacucuggauaugaguggauuacagauuucccuggcaaaaccguuugguuugugcccagcaucaaguccgggaaugacauugccaacugucuccgcaaaaauggaaagagagugauccagcuuucucggaagacauucgauaccgaauaccagaaaacgaagaacaacgacugggacuacgucgugacaaccgauauuagcgagaugggcgccaauuucagagcugaccgcguuaucgauccucggagaugccugaaacccgugauucugaaggacgggccggaacgcgucauccucgccggcccuaugcccgugacaguugcguccgcugcccagcggagaggacgcaucggccggaaccacaauaaagagggggaucaguauauuuacaugggacagccccugaacaaugacgaggaucaugcccacuggaccgaagcuaagaugcuucuggacaacaucaauacgccugagggcauuauccccgcccucuuugaaccugagagagaaaagagcgcggccauugauggggaguaucgccugagaggagaggcucggaaaaccuucguggaacugaugcgcagaggcgaccucccggucuggcuuucuuacaagguggccuccgagggguuucaauauagcgaucggcgcuggugcuucgacggcgaaagaaacaaucagguccuggaggaaaacauggauguggagaucuggacaaaagagggagaacggaagaaacugagaccccgcuggcucgacgcucggaccuacuccgacccucuggcccuuagagaguuuaaggaguucgcugccggccgccggucuguuagcggggaucugauccucgagauuggaaaacugccccagcaccugacacagagagcgcaaaaugcccucgacaaccuugugaugcugcauaauuccgaacagggcgggcgggcuuaucgccacgccauggaggagcugccugauaccaucgaaacacucaugcugcuugcucugauugccgugcucaccggaggcgucacgcuguuuuuccugucuggcagagggcucggaaagacaagcaucggccuucuguguguuauggccuccagcgugcugcucuggauggcuucuguggagccccauuggauugcggccuccaucauccuggaauuuuuccuuaugguccugcucauuccggagccugaccggcagcgcacaccccaggauaaccaacuggcuuacgugguuaucgggcugcucuuuaugauucuuaccguggccgccaaugagaugggacugcuggaaacaaccaagaaagaccucggcaucgggcacgucgcuguggagaaccaccaucacgccgcgaugcuggaugucgaccuucauccugccagcgcuuggacacuguacgccguggcuacgaccauuaucacacccaugaugagacacaccauugaaaacacaaccgccaauaucucucucacggcgaucgccaaccaggcugccauucugaugggacuggauaagggcuggccuaucuccaaaauggacauuggcguuccccuccuugcucuggggugcuauagccaggugaauccgcugacccucacagccgcuguccugaugcuuguggcccauuacgcgaucauuggaccuggccugcaagccaaggcuacccgggaggcccagaaacgcacagcugccgggaucaugaagaaccccaccguugauggaaucguggccauugaccucgaucccgucguguaugacgcgaaguucgaaaaacagcugggccagaucaugcugcucauucuuuguacgucucaaauccugcugaugagaacaaccugggcucucugcgagagcauuacacuggccaccgggccucuuaccacacugugggagggauccccgggcaaguuuuggaauacgaccaucgcugugucuauggccaacaucuuccggggcagcuaccucgccggggcuggacuggccuucucccugaugaaaagccucggcgggggacgcagaggcacaggggcgcagggagaaacccuuggcgagaaguggaaacggcagcugaaucagcuguccaagucugaauuuaacacauauaagagaagcggcauuauggagguugaccgcuccgaagccaaagaggggcucaagcggggagagaccacgaaacacgcugucucuagaggcacagccaagcugcgcugguucguggaacggaaucuugugaaacccgaggggaaggucaucgaucugggauguggcagagggggauggagcuacuauugcgcuggccucaagaaaguuaccgaagugaagggcuacaccaaagggggaccuggccacgaggaacccauuccuauggccacauacggguggaaccuggugaagcugcauuccggaaaagacgucuuuuucauucccccugagaagugugauacccuccuuugcgacauuggcgagucuagcccgaaucccacaaucgaagaggggcgcacgcugcgggugcugaaaaugguugaaccuuggcucagaggaaaccaauuuuguauuaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacaucgugagcgcggucaauaugacaucucgcaugcugcugaaccgguucaccauggcccacagaaaaccgacguaugagcgcgauguggaccucggcgcugggaccagacacguggccgucgaaccugagguugcuaaccuggauauuaucggacagcggauugaaaauaucaagcaugagcacaaauccacauggcauuacgacgaggauaaccccuauaagaccugggccuaccacggcagcuaugaagugaaacccucuggguccgcuagcuccauggugaauggagucgugaaacuucugacaaagccuugggacguuauucccauggugacccaaaucgccaugacagauaccacgccuuuuggccagcagcgcgucuucaaagagaagguggacacaagaaccccgaaagcgaagcggggcaccgcccaaaucauggaaguuacagcuaaauggcucuggggguuucugagcagaaacaagaagccccggauuuguacgcgcgaggaguucaccagaaaagugcggucuaaugccgcuaucggagccgucuuuguggacgagaaccaguggaauagcgccaaggaggcgguugaagaugagcgcuucugggaccuugugcauagagaacgggagcugcacaaacagggcaagugcgcuacaugcgucuacaacaugauggggaaacgcgaaaagaagcucggagaguuuggcaaagccaagggguccagagccauuugguacauguggcugggcgcucgguuccuggaguucgaagcccucggauuuaugaaugaggaucacugguucucucgcgaaaacagccuguccggcguggagggggagggacuucauaaacugggcuauauccucagagacauuucuaagaucccugggggaaauauguacgcugaugacaccgccggcugggauacacggaucaccgaagacgaucugcagaacgaggcgcgcauuacagacaucauggaacccgagcacgcccuucuggcuagaagcauuuuuaaacucaccuaucaaaauaaggucgugcggguucagcgcccugccaaaaacgggacggugauggaugucaucuccagacgggaccagagaggcucuggacaggugggcaccuacgggcugaauacauucaccaacauggaagcucaacugauucgccagauggagagcgagggaaucuuuucccccagcgaacucgagacaccgaaccuggccgaacgggugcuugauuggcuggagaaguauggcguugaaagacucaagcgcauggcgaucucuggggacgacuguguggucaaaccuauugaugaccgguucgccaccgcucugacggcccuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcucgcgucucucagggagccggcuggucccugcgggagacagcuugccugggaaagagcuacgcccaaauguggcagcucauguauuuucauagacgcgaccugcggcuugcggccaacgcuauuuguuccgccgugcccguugauuggaucccgaccucuagaacaaccuggagcauucacgcccaucaccaguggaugacgaccgaagacaugcuguccguguggaaucgggucuggaucgaggaaaacccuuggauggaggauaagacacauaucagcucuuggggagacgugcccuaccucggcaaaagagaggaccaauggugcgggucccugauuggacuuaccgcucgcgccacaugggcgaccaauauccagguugcuauuaaccaggugcggagacugaucggcaaugaaaacuaccucgauuauaugacaagcaugaagcgcuucaaaaaugagucugaccccgaaggggcccugugguga

SEQ ID NO: 19363 - RNA, 9879 nt, Artificial Sequence
  derived and/or modified CDS sequence (opt5) from DENV-1__JQ045648__SS-prME
agcgugaccaugcugcucaugcugaugcccacagcccuugcuuuccaccugacgaccagaggcggggaaccucauaugaucguguccaagcaggaacgggggaagucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguugcgcagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcguuggcaaacucguccaucagauuuucgggaccgcuuacggagugcuguuuuccggcgugagcuggacgaugaagaucgggauuggcguccuucugaccuggcucggacucaauucuagauccacaagccugucuaugaccuguaucgccgugggccuuguuacacucuaccugggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcucucugcggccauuggcaaggcuugggaggagggggucugcggcaucagaagcgccacgcgccuggaaaacaucauguggaaacagauuuccaacgagcuuaaucauauccugcucgaaaacgacaugaaguucacagugguugugggagaugucgcuggcauucuggcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggagguggaggacuacggauucggcauuuuuaccacgaacaucuggcugaaacuucgcgauuccuauacacaggucugcgaccaccggcucaugagcgccgcuauuaaagauucuaaggccguucacgccgacaugggcuacuggaucgaauccgagaaaaaugaaaccuggaagcuggcuagagccagcuucaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcgggaccuuggcaucugggcaaacuugagcuggauuuugaccucugcgaagggacgaccgucgugguugaugagcacugcggaaaccggggccccagccugagaacaaccacagugaccggcaagaucauccacgaaugguguugccgguccuguacgcugccuccccuucgcuucagaggggaggacggaugcugguauggcauggagauucggccggucaaagaaaaggaggaaaaucucgucaagagcaugguuucugcuggguccggagagguggacagcuuuucccugggccugcucuguaucucuauuaugaucgaagaggucaugagaagccgcuggucccggaaaaugcugaugacagggacccuugccguguucuuucugcucauuaugggacagcugacauggaacgaucugaucagacuuugcauuaugguuggcgccaaugcuucugaccgcaugggcauggggaccaccuaccuggcccucauggcgacauucaagaugagaccuauguuugcugugggacugcuguuccggcgccugacgagcagagagguccuucugcucaccaucggccugucccugguggccucuguggaacuucccaacagccuggaggaacucggggauggacuggccaugggcaucaugauucucaaacugcuuacagacuuucaaucccaucagcugugggcuacccuccugagccugacauucaucaagaccacgcuuucucugcacuaugccuggaaaacaauggcuaugguccucuccauuguuagccuguuuccccucugucugucuaccaccucccagaagacaaccuggcuuccugugcugcuggggagccucggaugcaagccgcugacaauguuccuuaucgccgagaauaaaauuuggggccggcgcucuuggccccugaacgaaggcaucauggcgguggggaucgucuccauucuccugagcucccuccugaagaacgaugugccucuugccggaccccugaucgcuggcgggaugcugauugccuguuacguuaucagcggaucuagcgcugaccucucccuggagaaagccgccgaggugucuugggaagaggaagcugagcauagcggcgcgucccacaauauucuugucgaagugcaggaugacgggacgaugaagaucaaagaugaggagagagacgauacccugacaauccuccugaaggccacccuccuggcuguuucuggaguguauccucuuagcauucccgccacacuguuugucugguacuucuggcagaagaagaagcagcgguccggcgugcugugggacaccccuucucccccggaagucgagcgcgccgugcucgaugacggcaucuauagaauuaugcagcgggggcugcuuggacgcagccagguuggcgugggggucuuccaagaaaacguguuucauacgauguggcacguuaccagaggagcugugcugauguaccagggcaaacggcucgagccuuccugggccagcgucaagaaagaccugaucucuuacgggggaggcuggagacuccagggcuccuggaauacaggggaggaaguccaggugauugcgguugagcccggaaagaacccuaaaaauguccaaaccgcucccggcacauucaagaccccggaaggggaggugggagccaucgcccuggauuuuaagccuggcacaagcgggucucccauugugaaccgcgaaggaaaaaucgucggccuuuauggcaauggggugguuacgaccuccggaacauacgugagcgcuaucgcccaggcgaaggcuucccaggagggcccucugcccgagauugaagacgaggucuuccggaaaagaaaccugaccaucauggaucuccaccccgggucuggaaagacccgccgguaucugccugccauugugagagaagccaucaaacgcaaacuucggacacugauucucgcuccgacgagaguuguggccagcgagauggcugaagcccugaagggcaugcccauccgcuaccaaaccacagcggucaaauccgagcauaccgggaaggagaucguggaccugaugugccacacaaccuuuacgaugcggcuccuuagcccuguuagagugcccaauuauaacaugauuaucauggaugaagcccauuucacagacccuucuuccauugcugcccggggcuacaucagcacccgcgucggaaugggcgaggcugccgccauuuuuaugaccgcuacacccccugggucuguggaagcguucccgcagagcaaugccgugauccaggaugaggaaagagacauccccgagcgguccuggaacucuggauaugaguggauuaccgauuuuccuggcaaaacagucugguucguucccagcaucaaguccgggaaugacauugcuaacugucugcgcaaaaauggaaagagagugauccagcugucucggaagaccuuugauacggaauaccagaagaccaagaacaacgacugggacuacguggucaccacagauauuagcgagaugggcgccaauuucagagccgaccgcgugaucgauccucggagaugccucaaacccguuauucugaaggacgggccggaacgcgugauccuugcuggcccuaugcccgucaccguggccuccgcggcucagcggagaggacgcaucggccggaaccacaauaaagagggggaucaguauauuuacaugggacagccccugaacaaugacgaggaucaugcccacuggacggaagccaagaugcuccuggacaacaucaauaccccugagggcauuauccccgcucuguucgaaccugagagagaaaagagcgccgcgauugauggggaguaucgccucagaggagaggcccggaaaacauuuguugaacuuaugcgcagaggcgaccugccgguguggcugucuuacaaggucgcuuccgagggguuccaauauagcgaucggcgcuggugcuuugacggcgaaagaaacaaucaggugcucgaggaaaacauggaugucgagaucuggaccaaagagggagaacggaagaaacugagaccccgcuggcuugacgcccggacauacuccgacccucuggcucucagagaguucaaggaauuugccgcuggccgccggucugugagcggggaucugauccuggagauuggaaaacucccccagcaccuuacccagagagcccaaaaugcgcuggacaaccugguuaugcuccauaauuccgaacagggcgggcgggccuaucgccacgcuauggaggagcugccugauacaaucgaaacccuuaugcugcucgcccugauugcugugcugacgggaggcgugacacucuucuuucuuucuggcagagggcugggaaagaccagcaucggccugcucugugucauggccuccagcguucugcuuuggauggccucuguggagccccauuggauugcugcguccaucauccuggaguucuuucucauggugcugcugauuccggagccugaccggcagcgcacaccccaggauaaccaacucgccuacgucgugaucgggcuucuguucaugauucugacaguugcugccaaugagaugggacuccuggaaaccacaaagaaagaccuuggcaucgggcacguggccgucgagaaccaccaucacgcugccaugcuggauguggaccuccauccugcgagcgccuggacgcuguacgcugucgccaccacaauuaucacccccaugaugagacacacaauugaaaacaccacggcuaauaucucucugaccgccaucgcgaaccaggccgcuauucucaugggacuugauaagggcuggccuaucuccaaaauggacauuggcgugccccugcuggcccucgggugcuauagccagguuaauccgcugacacuuaccgcugccgugcugaugcucgucgcucauuacgccaucauuggaccuggccugcaagcgaaggccacacgggaggcucagaaacgcaccgccgcugggaucaugaagaaccccacgguggauggaaucguugccauugaccuggaucccguggucuaugacgccaaguuugaaaaacagcucggccagaucaugcuucugauucuguguacaucucaaauccuccugaugagaaccacaugggcgcuuugcgagagcauuacccuggcuaccgggccucucacaacgcugugggagggauccccgggcaaguucuggaauaccacaaucgccgugucuauggcuaacaucuuucggggcagcuaccuggccggggccggacucgcuuucucccuuaugaaaagccugggcgggggacgcagaggcaccggggcccagggagaaacacugggcgagaaguggaaacggcagcucaaucagcuguccaagucugaguucaacaccuauaagagaagcggcauuauggagguggaccgcuccgaagcgaaagaggggcuuaagcggggagagacgacaaaacacgccguuucuagaggcaccgcuaagcugcgcugguuugucgaacggaaucucgugaaacccgaggggaaggugaucgaucugggauguggcagagggggauggagcuacuauugcgccggccugaagaaagucaccgaaguuaagggcuacacaaaagggggaccuggccacgaggaacccauuccuauggcuaccuacggguggaaccucgugaaacuucauuccggaaaagacguguucuuuauucccccugagaagugugauacacugcugugcgacaucggcgagucuagcccgaaucccacgaucgaagaggggcgcacccuccggguccugaaaaugguggaaccuuggcuuagaggaaaccaauucuguauuaagauccugaaucccuauaugccuuccguuguggagacacucgagcagaugcagcgcaagcacggcggcaugcugguccggaacccccugagcagaaauucuacccaugaaauguacuggguguccugcgggacaggaaacaucguuagcgccgugaauaugaccucucgcaugcuccugaaccgguuuacgauggcgcacagaaaaccgaccuaugagcgcgaugucgaccuuggcgccgggacaagacacguggcuguggaaccugaggucgccaaccuggauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcuccugaccaagccuugggacgugauucccaugguuacacaaaucgcuaugaccgauacgacaccuuucggccagcagcgcguguuuaaagagaaggucgacaccagaaccccgaaagccaagcggggcacagcgcaaaucauggaagugacggccaaauggcuuuggggguuccugagcagaaacaagaagccccggauuuguacccgcgaggaauuuacaagaaaaguucggucuaaugcugccaucggagcuguguucgucgacgagaaccaguggaauagcgccaaggaggccguggaagaugagcgcuuuugggaccucguucauagagaacgggagcugcacaaacagggcaagugcgcgaccugcguguacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcgucgagggggagggacuccauaaacugggcuauauccuuagagacauuucuaagaucccugggggaaauauguacgccgaugacacagcuggcugggauacccggaucacagaagacgaucugcagaacgaggcccgcauuaccgacaucauggaacccgagcacgcgcuccuggccaaaagcauuuucaagcugacguaucaaaauaaaguggucagagugcagcggccugcuaagaacgggaccguuauggaugugaucucccgcagagaccagcggggcucuggacaggucggcacauacgggcucaauaccuuuacaaacauggaagcccaacugauuagacagauggagagcgagggaaucuucucccccagcgaacuugagaccccgaaccuggcugaacgcgugcucgauuggcuggagaaguauggcguggaacggcuuaaaagaauggccaucucuggggacgacuguguugugaagccuauugaugaccgcuuugcgacggcccugacagcucucaaugauaugggaaaaguccggaaggacaucccccagugggagccuuccaaaggcuggaacgauuggcagcaagugcccuucugcagccaucacuuucaccagcugauuaugaaggacgggagagagaucguugugccuugucgcaaucaggaugaacuggucggccgggccagagugucucagggagcuggcuggucccuccgcgagaccgccugccugggaaagagcuacgcucaaauguggcagcuuauguauuuccaucggagagaccugcgccucgccgcgaacgccauuuguuccgcuguccccguggauuggaucccgacaaccugcacgaccuggucuauucacgcccaucaccaguggaugacaaccgaagacaugcugagcguuuggaaucggguguggaucgaggaaaacccuuggauggaggauaaaacacauaucuccagcuggggagacguccccuaccuuggcaagagagaggaccaauggugugggucucugauuggacucaccgcccgggcuacaugggccaccaauauccagguggcgauuaaccagguuagacgccugaucggcaaugaaaacuaccuggauuauaugacguccaugaaacgguuuaagaaugagagcgaccccgaaggggcucucugguga

SEQ ID NO: 19364 - RNA, 9879 nt, Artificial Sequence
  derived and/or modified CDS sequence (opt5) from DENV-1__JQ045649__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauaccaugaccuacaaaugcccgcgcaucacagagaccgaacccgacgauguggacuguuggugcaaugcuacggauaccugggugacauauggaaccuguucccaaacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggaggucgaggacuauggauucggcauuuuuacgacaaacaucuggcugaagcugcgcgauuccuacacccagguuugcgaccaccggcuuaugagcgcggccauuaaagauucuaaggcugugcaugccgacaugggcuauuggaucgaauccgagaaaaaugaaacauggaagcucgccagagcuagcuucaucgaggugaagaccuguauuuggcccaaaucucacacacugugguccaacgggguccuggaaagcgagaugaucauuccgaagaucuacggaggcccuauuucucaacauaauuaucgccccggguacuucacccagacggccggaccuuggcaccucggcaaacuggagcuugauuuugaccugugcgaagggaccacagugguuguggaugagcacugcggaaaccggggccccagccucagaaccacaaccgucacgggcaagaucauccaugaaugguguugccgguccuguacacugccuccccugcgcuucagaggggaggacggaugcugguacggcauggagauucggccggugagagaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauugugggacagcucaccuggaacgaucugauccgccugugcauuauggucggcgccaaugccucugacagaaugggcauggggaccacauaucuugcucugauggccacguucaaaaugcggccuauguuugcggugggacuccuguuccgcagacucaccagccgggaggugcugcuucugacaaucggccucucccuggucgcuucuguugaacugcccaacagccuugaggaacugggggauggacucgccaugggcaucaugauucugaagcuccugaccgacuuucaaucccaccagcuuugggccagccugcucucucugacauucaucaaaaccacguuuucccugcauuacgcuuggaagacaauggccauggugcuuagcguggucucucuguucccccucugucuguccaccaccagccagaaaacaaccuggcucccugugcugcuugggucucugggaugcaagccgcugacaauguuucucauugcugagaauaagaucuggggccgcagauccuggccccugaacgaaggcauuauggccguugggaucgugagcauccuucuguccagccuccugaaaaacgaugucccucucgcgggaccccugauugccggcgggaugcuuaucgcuuguuaugugauuucuggaagcuccgccgaccugucucuggagaaggcugccgagguuagcugggaagaggaagccgagcacuccggcgcuucucauaauauccucguggaaguccaggaugacgggacgaugaaaauuaaggaugaggagcgggacgauacccugacaauccuucugaaagcgacccuccuggccgugagcggagucuacccucucuccauccccgcuacacuguucgugugguauuucuggcaaaagaaaaagcagcgcucuggcguucuuugggacaccccuagcccucccgaaguggagagagccguccuggaugacggcauuuaccggaucaugcagcgcgggcugcucggaagaucccaggugggcguugggguguuucaagaaaacgucuuccacacgauguggcacgugacccggggagccgugcugauguaucagggcaagagacuugagcccagcugggcuucuguuaaaaaggaccugauuuccuacgggggaggcuggcgccuccagggcagcuggaauacaggggaggaaguccaggugaucgccguggagcccggcaagaauccuaagaauguccaaaccgcgcccggcacauuuaaaaccccggaaggggaggugggagcuauugcccuggauuucaagccuggcacaucugggucccccaucguuaaccgggaaggaaagauugugggccucuacggcaauggggucgugacgaccagcggaacauauguuuccgccaucgcucaggccaaagcgucucaggagggcccucugcccgagaucgaagacgagguguuuagaaagcgcaaccuuaccauuauggaucugcaucccgggagcggaaaaacccggagauaccugccugcuaucguccgcgaagccauuaagcggaaacucagaacacugauccuugccccgacgcgcgugguugcuuccgagauggccgaagcucugaagggcaugcccauucgguaucaaaccacagccgucaagagcgagcacaccgggaaagagaucgucgaccucaugugccaugcgacauucaccaugagacugcugucuccugugcgggugcccaauuacaacaugaucauuauggaugaagcccacuuuacggacccuuccagcaucgcugcccgcggcuauauuucuacaagagucggaaugggcgaggcugccgccaucuucaugaccgcuacacccccugggagcguugaagcguuuccgcaguccaaugccgugauucaggaugaggaacgggacauccccgagcgcucuuggaacagcggauacgaguggaucacagauuucccuggcaagaccgugugguuuguccccuccauuaaaucugggaaugacaucgcuaacugucucagaaagaauggaaaacgggugauucagcuuagcagaaagacauucgauaccgaauaucaaaagacgaaaaacaacgacugggacuacguugugacaaccgauaucuccgagaugggcgccaauuuccgcgccgaccgggucauugauccuagacgcugccugaagcccgugauccugaaagacgggccggaacggguuauucucgcuggcccuaugcccgugacagucgccagcgcggcucagagacgcggacggaucggcagaaaccauaauaaggagggggaucaguacaucuauaugggacagccccugaacaaugacgaggaucacgcccacuggaccgaagccaaaaugcuucuggacaacauuaauacgccugagggcaucauucccgcucucuuugaaccugagcgcgaaaagucugccgcgaucgauggggaguacagacugcggggagaggcccgcaagaccuucguggaacugaugagacggggcgaccucccggucuggcuuuccuauaaaguggcuagcgagggguuucaauacuccgaucgcagauggugcuucgacggcgaacggaacaaucagguucuggaggaaaacauggauguggagauuuggacaaaggagggagaacgcaaaaagcugcgcccccgguggcucgacgccagaaccuauucugacccucuggcucuuagagaguuuaaagaguucgccgcuggccggagaagcguguccggggaucugauccucgagaucggaaagcugccccagcaucugacacagcgggcccaaaaugcgcucgacaaccuugucaugcugcacaauucugaacagggcgggcgcgccuacagacaugcuauggaggagcugccugauaccauugaaacacucaugcugcuugcccugaucgcuguucucaccggaggcgugacgcuguuuuuccugagcggccgggggcucggaaaaacauccauuggccuucugugugugauggccagcucuguccugcucuggauggccuccguggagccccacuggaucgcugcgagcauuauccuggaauuuuuccuuaugguucugcucaucccggagccugaccgccagagaacaccccaggauaaccaacuggccuauguggucauugggcugcucuuuaugauccuuaccguggcugccaaugagaugggacugcuggaaacaaccaagaaggaccucggcauugggcacgucgccguggagaaccaucaccaugcugccaugcuggauguugaccuucacccugcgucugccuggacacuguacgcuguggccacgaccaucauuacacccaugaugcggcauaccaucgaaaacacaaccgcuaauauuucccucacggccaucgcgaaccaggccgcuauccugaugggacuggauaaaggcuggccuauuagcaagauggacaucggcgucccccuccuugcccuggggugcuacucucaggugaauccgcugacccucacagcugccguucugaugcuuguggcucacuaugccauuaucggaccuggccugcaagcgaaagccacccgcgaggcucagaagagaacagccgcugggauuaugaaaaaccccaccgucgauggaaucguggccaucgaccucgaucccgugguuuacgacgccaaguucgaaaagcagcugggccagauuaugcugcucauccuuuguacgagccaaauucugcugaugcggacaaccugggcgcucugcgaguccaucacacuggcuaccgggccucuuaccacacugugggagggaucuccgggcaaauuuuggaauacgaccauugccgucagcauggcuaacaucuuccgcggcuccuaucucgccggggccggacuggcuuucagccugaugaagucccucggcgggggaagacggggcacaggggcccagggagaaacccuuggcgagaaauggaagagacagcugaaucagcugucuaaaagcgaauuuaacacauacaagcgcuccggcaucauggagguggaccggucugaagcgaaggaggggcucaaaagaggagagaccacgaagcacgccgugagccgcggcacagcuaaacugcggugguucgucgaaagaaaucuuguuaagcccgaggggaaagugauugaucugggauguggccgcgggggaugguccuauuacugcgccggccucaagaaggugaccgaagucaaaggcuauaccaaagggggaccuggccaugaggaacccaucccuauggcuacauacggguggaaccuggugaaacugcacucuggaaaggacgucuuuuucauucccccugagaaaugugauacccuccuuugcgacaucggcgagagcuccccgaaucccacaauugaagaggggcggacgcugagagugcugaagauggucgaaccuuggcuccgcggaaaccaauuuuguaucaaaauucugaaucccuacaugccuagcgugguugagacccuugagcagaugcagcggaagcauggcggcaugcuggugagaaacccccucucucgcaauuccacacacgaaauguauugggucagcugcgggaccggaaacaucgugucugccgugaauaugacaucccggaugcugcugaacagauucaccauggcgcaccgcaagccgacguacgagagagaugucgaccucggcgccgggacccggcauguugcuguggaaccugagguggccaaccuggauaucauuggacagcgcaucgaaaauauuaaacacgagcauaagagcacauggcacuaugacgaggauaaccccuacaaaaccugggcuuaucauggcucuuacgaagucaagcccuccgggagcgccuccagcauggugaauggaguugugaaacuucugacaaagccuugggacgucauccccauggugacccaaauugcuaugacagauaccacgccuuuuggccagcagagaguuuucaaggagaaaguggacacacggaccccgaaggccaaaagaggcaccgcgcaaaucauggaagucacagccaaguggcucuggggguuucugucucggaacaaaaagccccgcaucuguacgagagaggaguucacccggaaggugcgcagcaaugcugccauuggagcuguuuuuguggacgagaaccaguggaacuccgccaaagaggccgucgaagaugagagauucugggaccuugugcaccgggaacgcgagcugcacaagcagggcaaaugcgcgacaugcgucuauaacaugauggggaagagagagaaaaagcucggagaguuuggcaaggcuaaagggucucgggccaucugguacauguggcugggcgcccgcuuccuggaguucgaagcucucggauuuaugaaugaggaucauugguucagcagagaaaacucccugucuggcguggagggggagggacuucacaagcugggcuacauucuccgggacaucagcaaaauuccugggggaaauauguaugccgaugacaccgcuggcugggauacacgcaucaccgaagacgaucugaagaacgaggccagaaucacagacauuauggaacccgagcaugcgcuucuggccaaauccaucuuuaagcucaccuaccagaauaaaguugugcggguccaacgcccugcuaagaacgggacggugauggaugugauuucuagacgggaccagagaggcagcggacagguuggcaccuaugggcugaauacauucaccaacauggaagcccagcugauccgccaaauggaguccgagggaauuuuuagccccucugaacucgagacaccgaaccuggcugaacgggugcuucacuggcuggagaaguacggcgucgaaagacucaaacgcauggccaucuccggggaugacugugugguuaagccuaucgacgaucgguucgcgaccgcccugacggcucuuaaugacaugggaaaagugagaaaggauauuccccagugggagccuagcaaaggcuggaacgacuggcagcagguccccuuuugcucucaccauuuccaccaacugaucaugaaggaugggcgcgagauuguggucccuugucggaaucaggacgaacucgugggcagagcccgcguuucccagggagcuggcuggagccugcgggagacagccugccuggggaaguccuaugcucagauguggcaacucauguacuuucauagacgcgaucugcggcuugccgcgaacgccaucuguucugcugugcccgucgacuggauuccgaccagcagaacaaccugguccauccacgcccaucaccaguggaugacgaccgaagauaugcugagcguguggaaucggguuuggauugaggaaaacccuuggauggaggacaaaacacacaucucuuccuggggagaugugcccuaucucggcaagagagaggaccaguggugcgggagccugaucggacuuaccgcccgcgcuacaugggccaccaauauucaagucgcgaucaaccaggugcggagacugauuggcaaugaaaacuaccucgacuacaugacaucuaugaaacgcuucaagaaugagagcgaucccgaaggggcucugugguga

SEQ ID NO: 19365 - RNA, 9879 nt, Artificial Sequence
  derived and/or modified CDS sequence (opt5) from DENV-1__JQ045650__SS-prME
agcgugaccaugcugcucaugcugaugcccaccgcccuugcuuuccaccugacgaccagaggaggggaaccucauaugauuguguccaagcaggaacggggaaaaucucuccuguuuaagaccagcgccggcguuaacaugugcacccuuauugcgauggaccugggggaacucugugaagauaccaugaccuacaaaugcccgagaaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaaacuucgcgauuccuacacccaggucugcgaccaccggcucaugagcgcggccauuaaagauucuaaggcuguucaugccgacaugggcuauuggaucgaauccgagaaaaaugaaacauggaagcuggccagagcuagcuucaucgaggugaagaccuguauuuggcccaaaucucacacacugugguccaacggggugcucgaaagcgagaugaucauuccgaagaucuacggaggcccuauuucucaacauaauuaucgccccggguacuucacccagacggccggaccuuggcaccugggcaaacuugagcuggauuuugaccucugcgaagggaccacagucgugguugaugagcacugcggaaaccggggccccagccugagaaccacaaccgugacgggcaagaucauccaugaaugguguugccgguccuguacacugccuccccuucgcuucagaggggaggacggaugcugguacggcauggagauucggccggucagagaaaaagaggaaaaucucgucaagagcaugguuucugcgggguccggagagguggacagcuuuucccugggccugcucuguaucucuauuaugaucgaagaggucaugcgcagccggugguccagaaagaugcugaugaccgggacacuugcuguguucuuucugcucauuguuggacagcugaccuggaacgaucugauccgccuuugcauuauggugggcgccaaugccucugacagaaugggcauggggaccacauaucuggcucucauggccacguucaaaaugcggccuauguuugcggucggacugcuguuccgcagacugaccagccgggaggugcuucugcucacaaucggccugucccugguggcuucugucgaacuucccaacagccuggaggaacucggggauggacuggccaugggcaucaugauucucaagcugcuuaccgacuuucaaucccaccagcugugggccagccuccugucucugacauucaucaaaaccacguuuucccuucauuacgcuuggaagacaauggccaugguucugagcguggugucucucuucccccugugucucuccaccaccagccagaaaacaaccuggcugccuguccuucuggggucucugggaugcaagccgcucacaauguuucugauugcugagaauaagaucuggggccgcagauccuggccccuuaacgaaggcauuauggccguggggaucguuagcauccugcucuccagccugcucaaaaacgaugugccucuggcgggaccccuuauugccggcgggaugcugaucgcuuguuaugucauuucuggaagcuccgccgaccugucucucgagaaggcugccgaggugagcugggaagaggaagccgagcacuccggcgcuucucauaauauccugguugaagugcaggaugacgggacgaugaaaauuaaggaugaggagcgggacgauacccuuacaauccugcucaaagcgacccugcucgccgucagcggaguguacccucuguccauccccgcuacacuuuucgucugguauuucuggcaaaagaaaaagcagcgcucuggcgugcugugggacaccccuagcccucccgaaguugagagagccgugcuggaugacggcauuuaccggaucaugcagcgcgggcuccugggaagaucccaggucggcguggggguuuuucaagaaaacguguuccacacgauguggcacgucacccggggagccgugcuuauguaucagggcaagagacuggagcccagcugggcuucugugaaaaaggaccucauuuccuacgggggaggcuggcgccugcagggcagcuggaauacaggggaggaaguucaggucaucgccguggagcccggcaagaacccuaagaaugugcaaaccgcgcccggcacauuuaaaaccccggaaggggaggucggagcuauugcccucgauuucaagccuggcacaucugggucccccaucgugaaccgggaaggaaagauuguuggccuguacggcaaugggguggucacgaccagcggaacauauguguccgccaucgcucaggccaaagcgucucaggagggcccucuucccgagaucgaagacgagguuuuuagaaagcgcaaccugaccauuauggaucugcaucccgggagcggaaaaacccggagauaccucccugcuaucgugcgcgaagccauuaagcggaaacugagaacacuuauccuggccccgacgcgcgucguggcuuccgagauggccgaagcucucaagggcaugcccauucgguaucaaaccacagccguuaagagcgagcacaccgggaaagagaucguggaccugaugugccaugcgacauucaccaugagacugcucucuccuguccgggugcccaauuacaacaugaucauuauggaugaagcccacuuuacggacccuuccagcaucgcugcccgcggcuauauuucuacaagagugggaaugggcgaggcugccgccaucuucaugaccgcuacacccccugggagcgucgaagcguuuccgcaguccaaugccguuauucaggaugaggaacgggacauccccgagcgcucuuggaacagcggauacgaguggaucacagauuucccuggcaagaccgugugguuugugcccuccauuaaaucugggaaugacaucgcuaacugucuuagaaagaauggaaaacgggucauucagcugagcagaaagacauucgauaccgaauaucaaaagacgaaaaacaacgacugggacuacgugguuacaaccgauaucuccgagaugggcgccaauuuccgcgccgaccgggugauugauccuagacgcugccugaagcccgucauccucaaagacgggccggaacgggugauucuggcuggcccuaugcccguuacaguggccagcgcggcucagagacgcggacggaucggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguuugaaccugagcgcgaaaagucugccgcgaucgauggggaguacagacugcggggagaggcccgcaagaccuucgucgaacucaugagacggggcgaccuuccgguguggcuguccuauaaagucgcuagcgagggguuucaauacuccgaucgcagauggugcuucgacggcgaacggaacaaucaggugcuggaggaaaacauggauguugagauuuggacaaaggagggagaacgcaagaagcuccgcccccgguggcuggacgccagaaccuauucugacccucuugcucugcgcgaguuuaaagaguucgccgcuggccggagaagcguguccggggaucucauccuggagaucggaaagcugccccagcaucucacacagcgggcccaaaaugcgcuugacaaccuggugaugcugcacaauucugaacagggcgggcgcgccuacagacaugcuauggaggagcucccugauaccauugaaacacugaugcuucuggcccucaucgcuguccugaccggaggcguuacgcuguuuuuccucagcggccgggggcuuggaaaaacauccauuggccugcugugugugauggccagcucugugcuccuguggauggccuccgucgagccccacuggaucgcugcgagcauuauccuugaauuuuuccugauggugcuccugaucccggagccugaccgccagagaacaccccaggauaaccaacuggccuauguugugauugggcuccuuuuuaugauccugaccgucgcugccaaugagaugggacugcucgaaacaaccaagaaggaccugggcauugggcacguggccgucgagaaccaucaccaugcugccaugcuugauguggaccugcacccugcgucugccuggacacucuacgcuguugccacgaccaucauuacacccaugaugcggcauaccaucgaaaacacaaccgcuaauauuucccugacggccaucgcgaaccaggccgcuauccugaugggacucgauaaaggcuggccuauuagcaagauggacaucggcgugccccuucuggcccuggggugcuacucucaggucaauccgcucacccugacagcugccgugcuuaugcugguugcucacuaugccauuaucggaccuggccuccaagcgaaagccacccgcgaggcucagaagagaacagccgcugggauuaugaaaaaccccaccguggauggaaucgucgccaucgaccuggaucccgugguguacgacgccaaguucgaaaagcagcugggccagauuaugcuccuuauccuguguacgagccaaauucugcucaugcggacaaccugggcgcugugcgaguccaucacacuugcuaccgggccucugaccacacucugggagggaucuccgggcaaauuuuggaauacgaccauugccguuagcauggcuaacaucuuccgcggcuccuaucuggccggggccggacuggcuuucagccucaugaagucccuuggcgggggaagacggggcacaggggcccagggagaaacccugggcgagaaauggaagagacagcugaaucagcucucuaaaagcgaauuuaacacauacaagcgcuccggcaucauggaggucgaccggucugaagcgaaggaggggcugaaaagaggagagaccacgaagcacgccgugagccgcggcacagcuaaacuucggugguucguggaaagaaaucuggucaagcccgaggggaaaguuauugaucucggauguggccgcgggggaugggccuauuacugcgcuggccugaagaaggugaccgaagugaaaggcuauaccaaaggcgggccugggcaugaggaacccaucccuauggccacauacggguggaaccuggucaaacuccacuccggaaaggacguguuuuucauucccccugagaaaugugauacccuucugugcgacaucggcgagucuagcccgaaucccacaauugaagaggggcggacgcugagaguucucaagaugguggaaccuuggcugcgcggaaaccaauuuuguaucaaaauucuuaaucccuacaugccuuccgucguggagacccuggagcagaugcagcggaagcauggcggcaugcucguuagaaacccccugagccgcaauucuacacacgaaauguauuggguguccugcgggaccggaaacaucgucagcgcggugaauaugacaucucggaugcugcucaacagauucaccauggcccaccgcaagccgacguacgagagagauguggaccugggcgcugggacccggcaugucgccguugaaccugagguggcuaaccuugauaucauuggacagcgcaucgaaaauauuaaacacgagcauaaguccacauggcacuaugacgaggauaaccccuacaaaaccugggccuaucauggcagcuacgaagugaagcccucuggguccgcuagcuccauggucaauggagugguuaaacugcucacaaagccuugggacgugauccccauggucacccaaauugccaugacagauaccacgccuuuuggccagcagagaguguucaaggagaaaguugacacacggaccccgaaggcgaaaagaggcaccgcccaaaucauggaagugacagcuaaguggcuguggggguuucuuagccggaacaaaaagccccgcaucuguacgagagaggaguucacccggaagguccgcucuaaugccgcuauuggagccguguuuguugacgagaaccaguggaauagcgccaaagaggcgguggaagaugagagauucugggaccugguccaccgggaacgcgagcuccacaagcagggcaaaugcgcuacaugcguguauaacaugauggggaagagagagaaaaagcugggagaguuuggcaaggccaaagggucccgggccaucugguacauguggcugggcgcucgcuuccucgaguucgaagcccugggauuuaugaaugaggaucauugguucucuagagaaaacagccuuuccggcgucgagggggagggacugcacaagcucggcuacauucugcgggacaucucuaaaauuccugggggaaauauguaugcugaugacaccgccggcugggauacacgcaucaccgaagacgaucuuaagaacgaggcgagaaucacagacauuauggaacccgagcaugcccugcucgcuaaaagcaucuuuaagcugaccuaccagaauaaagugguucgggugcaacgcccugccaagaacgggacggucauggaugugauuuccagacgggaccagagaggcucuggacaggugggcaccuaugggcugaauacauucaccaacauggaagcucagcucauccgccaaauggagagcgagggaaucuuuucccccagcgaacuggagacaccgaaccuugccgaacggguucugcacuggcucgagaaguacggcguggaaagacugaaacgcauggcgaucucuggggaugacugugucgugaagccuaucgacgaucgguucgccaccgcucuuacggcccugaaugacaugggaaaaguuagaaaggauauuccccagugggagccuuccaaaggcuggaacgacuggcaacaggugcccuuuugcagccaccauuuccaccaacucaucaugaaggaugggcgcgagauugucgugccuugucggaaucaggacgaacuggucggcagagcucgcgugucucagggagccggcuggucccugcgggagacagcuugccucggaaagagcuaugcccagauguggcaacugauguacuuucauagacgcgaucuucggcuggcggccaacgcuaucuguuccgccguucccguggacuggauuccgaccucuagaacaaccuggagcauccacgcccaucaccaguggaugacgaccgaagauaugcucuccgucuggaaucggguguggauugaggaaaacccuuggauggaggacaaaacacacaucagcucuuggggagauguucccuaucugggcaagagagaggaccaguggugcgggucccuuaucggacugaccgcucgcgccacaugggcgaccaauauucaaguggcuaucaaccagguccggagacucauuggcaaugaaaacuaccuggacuacaugacaagcaugaaacgcuucaagaaugagucugaucccgaaggggcccugugguga

SEQ ID NO: 19366 - RNA, 9879 nt, Artificial Sequence
  derived and/or modified CDS sequence (opt5) from DENV-1__JQ045651__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaauaaaauuuggggccggcgcucuuggccccuuaacgaaggcaucauggccguggggaucgucuccauucugcucagcucccugcucaagaacgaugugccucuggcgggaccccuuaucgccggcgggaugcugauugcuuguuacguuaucagcggaucuagcgccgaccugucccucgagaaagcugccgaggugucuugggaagaggaagccgagcauagcggcgcuucccacaauauucuggucgaagugcaggaugacgggaccaugaagaucaaagaugaggagagagacgauacacuuaccauccugcucaaggcgacacugcucgccguuucuggaguguauccucugagcauucccgcuacccuuuucgucugguacuucuggcagaagaagaagcagcgguccggcgugcugugggacacgccuucucccccggaagucgagcgcgccgugcuggaugacggcaucuauagaauuaugcagcgggggcuccugggacgcagccagguuggcgugggggucuuucaagaaaacguguuccauaccauguggcacguuacaagaggagccgugcuuauguaccagggcaaacggcuggagccuuccugggcuagcgucaagaaagaccucaucucuuacgggggaggcuggagacugcagggcuccuggaauaccggggaggaaguccaggugauugccguugagcccggaaagaacccuaaaaauguccaaacagcgcccggcaccuuuaagacaccggaaggggaggugggagcuaucgcccucgauuucaagccuggcacgagcgggucucccauugugaaccgcgaaggaaaaaucgucggccuguauggcaauggggugguuaccacauccggaaccuacgugagcgccaucgcucaggccaaggcgucccaggagggcccucuucccgagauugaagacgaggucuuucggaaaagaaaccugaccaucauggaucugcaccccgggucuggaaagacacgccgguaucucccugcuauugugagagaagccaucaaacgcaagcugcggacgcuuauucuggccccgaccagaguuguggcuagcgagauggccgaagcucucaagggcaugcccauccgcuaccaaacaaccgccgucaaauccgagcauacagggaaggagaucguggaccugaugugccacgcgaccuucacgaugcggcugcucagcccuguuagagugcccaauuauaacaugauuaucauggaugaagcccauuuuacagacccuucuuccauugcugcccggggcuacaucagcacccgcgucggaaugggcgaggcugccgccauuuucaugaccgcuacacccccugggucuguggaagcguuuccgcagagcaaugccgugauccaggaugaggaaagagacauccccgagcgguccuggaacucuggauaugaguggauuaccgauuucccuggcaaaacagucugguuuguucccagcaucaaguccgggaaugacauugcuaacugucuucgcaaaaauggaaagagagugauccagcugucucggaagaccuucgauacggaauaccagaagaccaagaacaacgacugggacuacguggucaccacagauauuagcgagaugggcgccaauuucagagccgaccgcgugaucgauccucggagaugccugaaacccguuauucucaaggacgggccggaacgcgugauccuggcuggcccuaugcccgucaccguggccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaagagcgccgcgauugauggggaguaucgccugagaggagaggcccggaaaacauucguugaacucaugcgcagaggcgaccuuccgguguggcugucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacucagaccccgcuggcuggacgcccggacauacuccgacccucuugcucugagagaguuuaaggaguucgccgcuggccgccggucugugagcggggaucucauccuggagauuggaaaacugccccagcaccucacccagagagcccaaaaugcgcuugacaaccugguuaugcugcauaauuccgaacagggcgggcgggccuaucgccacgcuauggaggagcucccugauacaaucgaaacccugaugcuucuggcccucauugcugugcugacgggaggcgugacacuguuuuuccucucuggcagagggcuuggaaagaccagcaucggccugcugugugucauggccuccagcguucuccuguggauggccucuguggagccccauuggauugcugcguccaucauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcgagcgccuggacgcucuacgcugucgccaccacaauuaucacccccaugaugagacacacaauugaaaacaccacggcuaauaucucucugaccgccaucgcgaaccaggccgcuauucugaugggacucgauaagggcuggccuaucuccaaaauggacauuggcgugccccuucuggcccuggggugcuauagccagguuaauccgcucacacugaccgcugccgugcuuaugcuggucgcucauuacgccaucauuggaccuggccuccaagcgaaggccacacgggaggcucagaaacgcaccgccgcugggaucaugaagaaccccacgguggauggaaucguugccauugaccuggaucccguggucuaugacgccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaauaccacaaucgccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaauacgccguuucuagaggcaccgcuaaacuucgcugguucgucgaacggaaucuggugaaacccgaggggaaggugaucgaucucggauguggcagagggggauggagcuauuacugcgccggccugaagaaagucaccgaaguuaagggcuacacaaaagggggaccuggccacgaggaacccauuccuauggcuaccuauggguggaaccuggugaagcuccacuccggaaaagacguguuuuucgugcccccugagaagugugauacacuucugugcgacaucggcgagucuagcccgaaucccacgauugaagaggggcgcacccugcggguccucaaaaugguugaaccuuggcugagaggaaaccaauuuuguaucaagauucuuaaucccuacaugccuuccguggucgagacacuggagcagaugcagcgcaagcauggcggcaugcucgugcggaacccccugagcagaaauucuacccacgaaauguauuggguuuccugcgggacaggaaacaucgugagcgccgucaauaugaccucucgcaugcugcucaaccgguucacgauggcgcauagaaaaccgaccuacgagcgcgauguggaccugggcgccgggacaagacacguggcugucgaaccugagguugccaaccuugauaucauuggacagcggaucgaaaauauuaagcacgagcauaaauccaccuggcacuaugacgaggauaaccccuacaagacaugggcuuaucauggcagcuacgaagugaaacccucuggguccgccagcuccauggugaauggagucgugaagcugcucaccaagccuugggacguuauccccauggugacacaaauugcuaugaccgauacgacaccuuuuggccagcagcgcgucuucaaagagaagguggacaccagaaccccgaaagccaagcggggcacagcgcaaaucauggaaguuacggccaaauggcuguggggguuucuuagcagaaacaagaagccccggaucuguacccgcgaggaguucacaagaaaagugcggucuaaugcugccauuggagcugucuuuguggacgagaaccaguggaauagcgccaaggaggccguugaagaugagcgcuucugggaccuggugcacagagaacgggagcuccauaaacagggcaagugcgcgaccugcgucuacaacaugauggggaaacgcgaaaagaagcugggagaguuuggcaaagcuaagggguccagagccaucugguauauguggcugggcgcccgguuccucgaguucgaagcucugggauuuaugaaugaggaucacugguucucucgcgaaaacagccuuuccggcguggagggggagggacugcacaaacucggcuacauucugagagacaucucuaagauuccugggggaaauauguaugccgaugacacagcuggcugggauacccggaucacagaagacgaucuucagaacgaggcccgcaucaccgacauuauggaacccgagcaugcgcugcucgccaaaagcaucuuuaagcugacguaccaaaauaaagucgugagaguucagcggccugcuaagaacgggaccgugauggaugucauuucccgcagagaccagcggggcucuggacaggugggcacauaugggcugaauaccuucacaaacauggaagcccaacucaucagacagauggagagcgagggaaucuuuucccccagcgaacuggagaccccgaaccuugcugaacgcgugcuggauuggcucgagaaguacggcguugaacggcugaaaagaauggccaucucuggggacgacuguguggucaagccuaucgaugaccgcuucgcgacggcccuuacagcucugaaugauaugggaaaagugcggaaggacauuccccagugggagccuuccaaaggcuggaacgauuggcagcaaguucccuuuugcagccaccauuuccaccagcucaucaugaaggacgggagagagauuguggucccuugucgcaaucaggaugaacuggugggccgggccagagucucucagggagcuggcuggucccugcgcgagaccgccugccucggaaagagcuaugcucaaauguggcagcugauguacuuucaccggagagaccuucgccuggccgcgaacgccaucuguuccgcugugcccguugauuggauuccgacaucucggaccacguggagcauccaugcccaccaucaguggaugaccacagaagacaugcucuccguguggaauagagucuggauugaggaaaacccuuggauggaggauaaaacccacaucagcucuugggaggacgugcccuaccugggaaagcgggaagaccaauggugcggcucccuuaucgggcugacagccagagcuaccugggccacaaauauucagguugcgaucaaccaggugcgccggcucauuggaaaugagaacuaucuggauuacaugaccagcaugaaaagauucaagaaugaaucugaccccgagggcgcucugugguga

SEQ ID NO: 19367 - RNA, 9879 nt, Artificial Sequence
  derived and/or modified CDS sequence (opt5) from DENV-1__JQ045652__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaauaaaauuuggggccggcgcucuuggccccuuaacgaaggcaucauggccguggggaucgucuccauucugcucagcucccugcucaagaacgaugugccucuggcgggaccccuuaucgccggcgggaugcugauugcuuguuacguuaucagcggaucuagcgccgaccugucccucgagaaagcugccgaggugucuugggaagaggaagccgagcauagcggcgcuucccacaauauucuggucgaagugcaggaugacgggaccaugaagaucaaagaugaggagagagacgauacacuuaccauccugcucaaggcgacacugcucgccguuucuggaguguauccucugagcauucccgcuacccuuuucgucugguacuucuggcagaagaagaagcagcgguccggcgugcugugggacacgccuucucccccggaagucgagcgcgccgugcuggaugacggcaucuauagaauuaugcagcgggggcuccugggacgcagccagguuggcgugggggucuuucaagaaaacguguuccauaccauguggcacguuacaagaggagccgugcuuauguaccagggcaaacggcuggagccuuccugggcuagcgucaagaaagaccucaucucuuacgggggaggcuggagacugcagggcuccuggaauaccggggaggaaguccaggugauugccguugagcccggaaagaacccuaaaaauguccaaacagcgcccggcaccuuuaagacaccggaaggggaggugggagcuaucgcccucgauuucaagccuggcacgagcgggucucccauugugaaccgcgaaggaaaaaucgucggccuguauggcaauggggugguuaccacauccggaaccuacgugagcgccaucgcucaggccaaggcgucccaggagggcccucuucccgagauugaagacgaggucuuucggaaaagaaaccugaccaucauggaucugcaccccgggucuggaaagacacgccgguaucucccugcuauugugagagaagccaucaaacgcaagcugcggacgcuuauucuggccccgaccagaguuguggcuagcgagauggccgaagcucucaagggcaugcccauccgcuaccaaacaaccgccgucaaauccgagcauacagggaaggagaucguggaccugaugugccacgcgaccuucacgaugcggcugcucagcccuguuagagugcccaauuauaacaugauuaucauggaugaagcccauuuuacagacccuucuuccauugcugcccggggcuacaucagcacccgcgucggaaugggcgaggcugccgccauuuucaugaccgcuacacccccugggucuguggaagcguuuccgcagagcaaugccgugauccaggaugaggaaagagacauccccgagcgguccuggaacucuggauaugaguggauuaccgauuucccuggcaaaacagucugguuuguucccagcaucaaguccgggaaugacauugcuaacugucuucgcaaaaauggaaagagagugauccagcugucucggaagaccuucgauacggaauaccagaagaccaagaacaacgacugggacuacguggucaccacagauauuagcgagaugggcgccaauuucagagccgaccgcgugaucgauccucggagaugccugaaacccguuauucucaaggacgggccggaacgcgugauccuggcuggcccuaugcccgucaccguggccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaagagcgccgcgauugauggggaguaucgccugagaggagaggcccggaaaacauucguugaacucaugcgcagaggcgaccuuccgguguggcugucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacucagaccccgcuggcuggacgcccggacauacuccgacccucuugcucugagagaguuuaaggaguucgccgcuggccgccggucugugagcggggaucucauccuggagauuggaaaacugccccagcaccucacccagagagcccaaaaugcgcuugacaaccugguuaugcugcauaauuccgaacagggcgggcgggccuaucgccacgcuauggaggagcucccugauacaaucgaaacccugaugcuucuggcccucauugcugugcugacgggaggcgugacacuguuuuuccucucuggcagagggcuuggaaagaccagcaucggccugcugugugucauggccuccagcguucuccuguggauggccucuguggagccccauuggauugcugcguccaucauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcgagcgccuggacgcucuacgcugucgccaccacaauuaucacccccaugaugagacacacaauugaaaacaccacggcuaauaucucucugaccgccaucgcgaaccaggccgcuauucugaugggacucgauaagggcuggccuaucuccaaaauggacauuggcgugccccuucuggcccuggggugcuauagccagguuaauccgcucacacugaccgcugccgugcuuaugcuggucgcucauuacgccaucauuggaccuggccuccaagcgaaggccacacgggaggcucagaaacgcaccgccgcugggaucaugaagaaccccacgguggauggaaucguugccauugaccuggaucccguggucuaugacgccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaauaccacaaucgccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaauacgccguuucuagaggcaccgcuaaacuucgcugguucgucgaacggaaucuggugaaacccgaggggaaggugaucgaucucggauguggcagagggggauggagcuauuacugcgccggccugaagaaagucaccgaaguuaagggcuacacaaaagggggaccuggccacgaggaacccauuccuauggcuaccuauggguggaaccuggugaagcuccacuccggaaaagacguguuuuucgugcccccugagaagugugauacacuucugugcgacaucggcgagucuagcccgaaucccacgauugaagaggggcgcacccugcggguccucaaaaugguugaaccuuggcugagaggaaaccaauuuuguaucaagauucuuaaucccuacaugccuuccguggucgagacacuggagcagaugcagcgcaagcauggcggcaugcucgugcggaacccccugagcagaaauucuacccacgaaauguauuggguuuccugcgggacaggaaacaucgugagcgccgucaauaugaccucucgcaugcugcucaaccgguucacgauggcgcauagaaaaccgaccuacgagcgcgauguggaccugggcgccgggacaagacacguggcugucgaaccugagguugccaaccuugauaucauuggacagcggaucgaaaauauuaagcacgagcauaaauccaccuggcacuaugacgaggauaaccccuacaagacaugggcuuaucauggcagcuacgaagugaaacccucuggguccgccagcuccauggugaauggagucgugaagcugcucaccaagccuugggacguuauccccauggugacacaaauugcuaugaccgauacgacaccuuuuggccagcagcgcgucuucaaagagaagguggacaccagaaccccgaaagccaagcggggcacagcgcaaaucauggaaguuacggccaaauggcuguggggguuucuuagcagaaacaagaagccccggaucuguacccgcgaggaguucacaagaaaagugcggucuaaugcugccauuggagcugucuuuguggacgagaaccaguggaauagcgccaaggaggccguugaagaugagcgcuucugggaccuggugcacagagaacgggagcuccauaaacagggcaagugcgcgaccugcgucuacaacaugauggggaaacgcgaaaagaagcugggagaguuuggcaaagcuaagggguccagagccaucugguauauguggcugggcgcccgguuccucgaguucgaagcucugggauuuaugaaugaggaucacugguucucucgcgaaaacagccuuuccggcguggagggggagggacugcacaaacucggcuacauucugagagacaucucuaagauuccugggggaaauauguaugccgaugacacagcuggcugggauacccggaucacagaagacgaucuucagaacgaggcccgcaucaccgacauuauggaacccgagcaugcgcugcucgccaaaagcaucuuuaagcugacguaccaaaauaaagucgugagaguucagcggccugcuaagaacgggaccgugauggaugucauuucccgcagagaccagcggggcucuggacaggugggcacauaugggcugaauaccuucacaaacauggaagcccaacucaucagacagauggagagcgagggaaucuuuucccccagcgaacuggagaccccgaaccuugcugaacgcgugcuggauuggcucgagaaguacggcguugaacggcugaaaagaauggccaucucuggggacgacuguguggucaagccuaucgaugaccgcuucgcgacggcccuuacagcucugaaugauaugggaaaagugcggaaggacauuccccagugggagccuuccaaaggcuggaacgauuggcagcaaguucccuuuugcagccaccauuuccaccagcucaucaugaaggacgggagagagauuguggucccuugucgcaaucaggaugaacuggugggccgggccagagucucucagggagcuggcuggucccugcgcgagaccgccugccucggaaagagcuaugcucaaauguggcagcugauguacuuucaccggagagaccuucgccuggccgcgaacgccaucuguuccgcugugcccguugauuggauuccgacaucucggaccacguggagcauccaugcccaccaucaguggaugaccacagaagacaugcucuccguguggaauagagucuggauugaggaaaacccuuggauggaggauaaaacccacaucagcucuuggggagacgugcccuaccugggcaagcgggaggaccaauggugcgggucccuuaucggacugacagccagagcuaccugggccacaaauauucagguugcgaucaaccaggugcgccggcucauuggcaaugaaaacuaucuggauuacaugaccagcaugaaaagauucaagaaugagucugaccccgaaggggcucugugguga

SEQ ID NO: 19368 - RNA, 9879 nt, Artificial Sequence
  derived and/or modified CDS sequence (opt5) from DENV-1__JQ045653__SS-prME
agcgugaccaugcugcugaugcugaugcccacagcccuugcuuuccaccugacgacccggggcggggagccucauaugaucguguccaagcaggaacgggggaaaucucuccuguuuaagacaagcgccggcguuaauaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcacccucgucgauagaggcuggggcaauggguguggacuguuuggcaaagggucucuuauuacaugcgcuaaguucaagugcgugacgaaacuggagggaaagaucguucaguacgaaaaccucaaauauuccgugaucgucaccgugcacacaggcgaccagcaucaaguugggaaugagagcaccgaacacggaacaaccgccacgauuacaccccaagcuccuaccaccgagauccagcugacagacuacggcgcccugacccucgauuguucuccccggacgggccuggacuuuaacgaaauggugcuucugacaaugaaggagaaauccuggcucguccauaagcagugguuccuggaucuuccucugcccuggaccagcggggccuccacaucucaagagaccuggaaucgccaggaccuccuggugaccuuuaaaacagcucacgcgaagaagcaggaagucgugguucugggaagccaagagggcgccaugcacacggcucucaccggggccacagaaauucagaccuccggaacaaccacgaucuucgccggccaucugaaaugcagacuuaagauggauaaacugacacucaaggggaugagcuaugugauguguaccggcucuuuuaaacuggagaaggaacuggcugagacccagcacggaacaguccuugugcagauuaaguacgagggcaccgacgccccgugcaaaaucccuuucuccacacaagaugaaaaggggguuacgcagaacggacggcucaucaccgcgaaucccauugugacagacaaagagaagccugucaacaucgaagcugagccgcccuucggcgagagcuauauugugaucggggccggagaaaaagcccugaagcugucuugguuuaagaaaggcagcuccauugggaagauguucgaggcuaccgccagaggcgcucgccggauggccauccucggagauacagcgugggacuuuggcucuaucgggggaguguucaccagcguuggcaaacugguccaucagauuuuugggacggccuacggagugcuuuucuccggcgugagcuggaccaugaagaucgggauuggcguccugcucacauggcugggacucaauucuagauccaccagccuuucuaugacauguaucgcugugggccucguuacccuguaccugggggugaugguccaggccgauuccggaugcgugauuaacuggaaaggccgcgaacucaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccuugaaaacaucauguggaaacagauuuccaacgagcugaaucauauccuccuggaaaacgacaugaaguuuaccgugguugugggagaugucgccggcauucuggcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcuuaagcuccgcgauuccuauacccaggucugcgaccaccggcugaugagcgcggccauuaaagauucuaaggcuguucacgccgacaugggcuacuggaucgaauccgagaaaaaugaaacauggaagcuggccagagcuagcuuuaucgaggugaagaccuguauuuggccccgcucucauacacucugguccaacggggugcuggaaagcgagaugaucauuccgaaaaucuauggaggcccuauuucucaacacaauuaccggcccggguacuucacccagacggccggaccuuggcaucuuggcaagcuggagcucgauuucgaccugugcgaagggaccacagucgugguugaugagcacugcggaaacagaggccccagccugcggaccacaaccgugacgggcaaaaucauccacgaaugguguugccgcuccuguacacuuccuccccucagauuuagaggggaagacggaugcugguauggcauggagauuagaccggucaaggaaaaagaggaaaaucuggucaagagcaugguuucugcgggguccggagagguggacagcuucucccugggccuccuguguaucucuauuaugaucgaagaggucaugcgcagccggugguccaagaaaaugcuuaugaccgggacacuggcuguguuuuuccuccugauuaugggacagcugaccuggaacgaucuuaucagacugugcauuaugguuggcgccaaugccucugaccgcaugggcauggggaccacauaccucgcucugauggccacguuuaagaugagaccuauguucgcggugggacuccuguuucggcgccuuaccagcagagagguccugcuccugacaaucggccugucccuuguggcuucuguggaacugcccaacagccucgaggaacugggggauggacucgccaugggcaucaugauucugaaacuucugaccgacuuccaaucccaucagcucugggccacacugcugagccuuaccuuuaucaagacgacauucucucugcacugugcuuggaaaaccauggccaugauucucuccaucgucagccuguuuccccucugccugucuaccacaucccagaagaccacauggcuuccuguucugcuggggagccucggauguaagccgcugacgauguuccuuauugcugagaauaaaaucuggggccggcgcucuuggccccugaacgaaggcaucauggccguggggauuguguccauccuccugagcucccuccugaagaacgaugucccucuugcgggaccccugauugccggcgggaugcugaucgcuugcuaugugauuagcggaucuagcgccgaccucucccuggagaaagcugccgagguuucuugggaagaggaagccgagcauagcggcgcuucccacaauauccuuguggaaguccaggaugacgggaccaugaagaucaaagaugaggagagagacgauacacugaccauucuccugaaggcgacacuccuggccgugucuggaguuuacccucuuagcauccccgcuacccuguuugugugguauuucuggcagaagaagaagcagcgguccggcguccugugggacacgccuucucccccggaaguggagcgcgccguccucgaugacggcauuuacagaaucaugcagcgggggcugcuuggacgcagccaggugggcguugggguguuccaagaagacgucuuucauaccauguggcacgugacaagaggagccguucugauguaucagggcaaacggcucgagccuuccugggcuagcgugaagaaagaucugauuucuuacgggggaggcuggagacuccagggcuccuggaacaccggggaggaaguccaggugaucgccguggagcccggaaagaauccuaaaaacguucaaacagcgcccggcaccuucaagacaccggaaggggaggucggagcuauugcccuggacuuuaagccuggcacgagcgggucucccaucgugaaucgcgaaggaaaaaucgugggccuuuacggcaacggggucgugaccacauccggaaccuauguuagcgccauugcucaggccaaggcgucccaggagggcccucugcccgagaucgaagaugagguguuccggaaaagaaaucugaccauuauggaccuccaccccgggucuggaaagacacgccgguaccugccugcuaucgucagagaagccauuaaacgcaaacuucggacgcugauccucgccccgaccagagugguugcuagcgagauggccgaagcucugaagggcaugcccauccgcuaucaaacaaccgccgugaaauccgagcauacagggaaggagauugucgaucugaugugucacgcgaccuuuacgaugcggcuccuuagcccugugagaguucccaacuacaauaugaucauuauggacgaagcccauuucacagauccuucuuccaucgcugcccggggcuauauuagcacccgcgugggaaugggcgaggcugccgccaucuuuaugaccgcuacacccccugggucugucgaagcguucccgcagagcaacgccgugauccaggacgaggaaagagauauucccgagcgguccuggaacucuggauacgaguggaucaccgacuuuccuggcaaaacagugugguucguccccagcauuaaguccgggaacgauaucgcuaauugccugcgcaaaaacggaaagagaguuauucagcugucucggaagaccuuugacacggaauaucagaagaccaagaauaacgacugggauuacguggugaccacagacaucagcgagaugggcgccaacuucagagccgaucgcgucauugacccucggagaugccucaaacccgugauccugaaggaugggccggaacgcguuauccuugcuggcccuaugcccgugaccgucgccuccgcggcucagcggagaggacgcauuggccggaaucacaacaaagagggggaccaguacaucuauaugggacagccccugaauaacgaugaggaccaugcccacuggacggaagccaagaugcuccuggauaauauuaacaccccugagggcaucauucccgcucuguucgaaccugagagagaaaagagcgccgcgaucgacggggaguaccgccucagaggagaggcccggaaaacauuuguggaacuuaugcgcagaggcgaucugccgguuuggcugucuuauaagguggcuuccgagggguuccaauacagcgaccggcgcugguguuuugauggcgaaagaaauaaccagguccucgaggaaaauauggacguggagaucuggaccaaagagggagaacggaagaaacugagaccccgcuggcuugacgcccggacauauuccgauccucuggcucucagagaguucaaggaauuugccgcuggccgccggucugucagcggggaccugauucuggagaucggaaaacucccccagcaccuuacccagagagcccaaaacgcgcuggauaaucuggugaugcuccauaacuccgaacagggcgggcgggccuaccgccacgcuauggaggagcugccugacacaauugaaacccuuaugcugcucgcccugaucgcuguucugacgggaggcgugacacucuucuuucuuucuggcagagggcugggaaagaccagcauuggccugcucugcgugauggccuccagcguccugcuuuggauggccucuguugagccccauuggaucgcugcguccaucauucuggaguucuuucucauggugcugcugaucccggagccugaucggcagcgcacaccccaggacaaucaacucgccuauguggucauugggcuucuguucaugauccugacaguggcugccaacgagaugggacuccuggaaaccacaaagaaagaucuuggcauugggcacguugccguggagaaucaccaucacgcugccaugcuggacgucgaucuccauccugcgagcgccuggacgcuguacgcuguggccaccacaaucauuacccccaugaugagacacacaaucgaaaacaccacggcuaacaucucucugaccgccauugcgaaucaggccgcuauccucaugggacuugacaagggcuggccuauuuccaaaauggauaucggcgucccccugcuggcccucggguguuacagccaggugaacccgcugacacuuaccgcugccguucugaugcucguggcucauuaugccauuaucggaccuggccugcaagcgaaggccacacgggaggcucagaaacgcaccgccgcugggaucaugaagaaucccacggucgacggaauuguggccaucgaucuggaccccguuguguacgacgccaaguuugaaaaacagcucggccagauuaugcuucugauccugugcacaucucaaauucuccugaugagaaccacaugggcgcuuugugagagcaucacccuggcuaccgggccucucacaacgcugugggagggauccccgggcaaguucuggaacaccacaaucgccgucucuauggcuaauauuuuucggggcagcuaucuggccggggccggacucgcuuucucccuuaugaaaagccugggcgggggacgcagaggcaccggggcccagggagaaacacugggcgagaaguggaaacggcagcucaaccagcuguccaagucugaguucaauaccuacaagagaagcggcaucauggagguggaucgcuccgaagcgaaagaggggcuuaagcggggagagacgacaaaacacgccgugucuagaggcaccgcuaagcugcgcugguuuguugaacggaaccucgucaaacccgaggggaaggugauugaccugggaugcggcagagggggauggagcuauuacugugccggccugaagaaagugaccgaagucaagggcuauacaaaagggggaccuggccacgaggaacccaucccuauggcuaccuacggguggaaucucguuaaacuucauuccggaaaagauguguucuuuauucccccugagaagugcgacacacugcugugugauaucggcgagucuagcccgaaccccacgauugaagaggggcgcacccuccgggugcugaaaauggucgaaccuuggcuuagaggaaaucaauucugcaucaagauccugaaccccuacaugccuuccgugguugagacacucgagcagaugcagcgcaagcacggcggcaugcuggugcggaauccccugagcagaaacucuacccaugaaauguauugggucuccugugggacaggaaauauugugagcgccguuaacaugaccucucgcaugcuccugaaucgguuuacgauggcgcacagaaaaccgaccuacgagcgcgacguggaucuuggcgccgggacaagacacgucgcuguggaaccugagguggccaaccuggacaucauuggacagcggaucgaaaacauuaagcaugagcacaaauccaccuggcauuaugaugaggacaaucccuacaagacaugggcuuaucacggcagcuacgaagucaaacccucuggguccgccagcuccaugguuaacggaguggugaagcuccugaccaagccuugggaugucauccccauggugacacaaaucgcuaugaccgacacgacaccuuucggccagcagcgcguuuuuaaagagaagguggacaccagaaccccgaaagccaagcggggcacagcgcaaauuauggaagucacggccaaauggcuuuggggguuccugagcagaaauaagaagccccggaucugcacccgcgaggaauuuacaagaaaagugcggucuaacgcugccauuggagcuguuuucguggaugagaaucaguggaacagcgccaaggaggccgucgaagacgagcgcuuuugggaucucgugcauagagaacgggagcugcacaaacagggcaagugcgcgaccuguguuuauaauaugauggggaaacgcgaaaagaagcugggagaguucggcaaagcuaagggguccagagccaucugguacauguggcucggcgcccgguuucuggaguucgaagcucuuggauucaugaacgaggaccacugguuuucucgcgaaaauagccuguccggcguggagggggagggacuccauaaacugggcuacauucuuagagauaucucuaagaucccugggggaaacauguaugccgacgauacagcuggcugggacacccggauuacagaagaugaccugcagaaugaggcccgcaucaccgauauuauggaacccgagcacgcgcuccuggccaaaagcaucuucaagcugacguaccaaaacaaagucgugagaguccagcggccugcuaagaaugggaccgugauggacguuauuucccgcagagaucagcggggcucuggacaggugggcacauaugggcucaacaccuuuacaaauauggaagcccaacugaucagacagauggagagcgagggaaucuucucccccagcgaacuugagaccccgaaccuggcugaacgcguccucgacuggcuggagaaguacggcguggaacggcuuaaaagaauggccauuucuggggacgauugcgugguuaagccuaucgacgaucgcuuugcgacggcccugacagcucucaacgacaugggaaaagugcggaaggauauuccccagugggagccuuccaaaggcuggaaugacuggcagcaaguccccuucuguagccaucacuuucaccagcugaucaugaaggaugggagagagauugugguuccuugccgcaaccaggacgaacuggugggccgggccagagucucucagggagcuggcuggucccuccgcgagaccgccugucugggaaagagcuaugcucaaauguggcagcuuauguacuuccaucggagagaucugcgccucgccgcgaaugccaucugcuccgcugugcccgucgacuggauuccgacaucucggaccacguggagcauccacgcccaucaccaguggaugaccacagaagauaugcuguccguguggaacagaguuuggaucgaggaaaauccuuggauggaggacaaaacccauauuagcucuuggggagacgugcccuaucuuggcaagcgggaggaucaauggugugggucccugaucggacucacagccagagcuaccugggccacaaacauucaggucgcgaucaaucaggugcgccggcugauuggcaacgaaaauuaccuggacuacaugaccagcaugaaaagauuuaagaacgagucugaucccgaaggggcucucugguga

SEQ ID NO: 19369 - RNA, 9879 nt, Artificial Sequence
  derived and/or modified CDS sequence (opt5) from DENV-1__JQ045657__SS-prME
agcgugaccaugcugcucaugcugaugcccacagcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccaccacgcgccuggaaaacaucauguggaagcagauuucuaacgagcucaaucauauccugcuugaaaacgacaugaaauuuacaguuguggucggagauguggccggcauucuggcucaggggaagaaaaugauccggccgcagcccauggaguacaaguauagcuggaaguccuggggaaaagccaagauuaucggcgccgacgugcaaaauaccaccuucaucauugaugggccuaacacacccgaauguccugacgaucagagagcuuggaauaucugggaggucgaggacuacggauuuggcauuuucaccacgaacaucuggcucaaacugcgcgauagcuauacacagguuugcgaccaccggcugaugucugcggccauuaaggauuccaaagcugugcacgccgacaugggcuacuggaucgaaagcgagaagaaugaaaccuggaaacuugccagagcuucuuucaucgaggugaaaacauguauuuggcccaagucccauacccucuggagcaacgggguccuggaaucugagaugaucauuccgaaaaucuauggaggcccuauuagccagcacaauuaccgccccggguacuuuacacaaaccgccggaccuuggcaucugggcaagcucgagcuggauuucgaccuuugcgaagggacgaccgugguuguggaugagcacugcggaaaccggggccccucccugagaacaaccacagucaccggcaaaaucauccacgaaugguguugccggagcuguacgcucccuccccugcgcuuuaagggggaggacggaugcugguauggcauggagauuagaccggugaaggaaaaagaggaaaaucugguuaagucuaugguguccgcggggagcggagaggucgacuccuucucucuuggccuccuguguaucagcauuaugaucgaagaggugaugcgguccagauggucucgcaaaaugcugaugacagggacccucgcugucuuuuuccugcuuauuaugggacagcugacauggaacgaucucauccggcugugcauuauggugggcgccaaugccagcgacagaaugggcauggggaccaccuaccuggcucuuauggccacauuuaagaugcgcccuauguucgcggucggacugcucuuuagacggcugacgucccgcgaggugcuccugcuuaccaucggccugucucucguggcuagcgucgaacugcccaacucccuggaggaacuuggggauggacuggccaugggcaucaugauucucaaacugcucacagacuuccagagccaucaacugugggccacccuucugucucucacauuuaucaagaccacguucucccugcacuaugcuuggaagacaauggccaugguucugagcauugugucucuuuuuccccugugucucuccaccaccagccagaaaacaaccuggcugccugugcuccuggggucucuuggaugcaagccgcugacaauguuccugaucgcugagaauaaaauuuggggcagaaaguccuggccccucaacgaaggcaucauggccgucgggaucgugagcauucugcuuuccagccugcucaaaaacgauguuccucuggcgggaccccucaucgccggcgggaugcugauugcuuguuacgugaucucuggaagcuccgccgaccuuucucuggagaaggcugccgaggucagcugggaagaggaagccgagcauuccggcgcuucucacaauauucugguggaaguucaggaugacgggacgaugaaaaucaaggaugaggagcgggacgauacccucacaauccugcuuaaggcgacccugcucgccgugagcggagucuauccucuguccauucccgcuacacucuucgugugguacuuuuggcagaaaaagaaacaacgcucuggcguccugugggacaccccuuccccucccgaaguggagagagccguucuugaugacggcaucuaucggauuaugcagcgcgggcugcugggaagaucccaggugggcgucgggguguuccaggaaaacguuuuucauacgauguggcacgugacccggggagccguccucauguaccaaggcaagcgccuggagcccagcugggcuucugugaaaaaggaccuuaucuccuacgggggaggcuggagacugcagggcagcuggaauacaggggaggaagugcagguuauugccgucgagcccggaaagaacccuaaaaaugugcagaccgcgcccggcacauucaagaccucugaaggggaggugggagcuaucgcccucgauuuuaaaccgggcacauccgggagcccuauugucaaccgggaaggaaagaucgugggccuguauggcaaugggguugugacgaccuccggaacauacgucucugccaucgcucaagccaaagcgagccaggagggcccccucccugagauugaagacgagguguucagaaagcgcaaccugaccaucauggaucuucaccccggguccggaaagacccggagauaucugcccgcuauuguucgcgaagccaucaaacggaagcugagaacacucauucuggccccuacgcgcguggucgcuagcgagauggccgaagcucuuaaaggcaugccgauccgguaccagaccacagccgugaagucugagcauaccgggaaagagaucguugaccugaugugccacgcgacauuuaccaugagacuccugucccccgugcgcgucccuaauuauaacaugauuaucauggaugaagcccauuucacggaccccagcucuauugcugcccggggcuacaucagcacaagagugggaaugggcgaggcugccgccauuuuuaugaccgcuaccccucccggguccguggaagcguucccucaaucuaaugccgucauccaggaugaggaacgggacaucccggagcgcagcuggaacuccggauaugaguggauuacagauuuucccggcaagaccguuugguucgugccuucuaucaagagcgggaaugacauugcuaacugucugcgcaagaauggaaagcgggugauccagcucucccgcaaaacauucgauaccgaauaccagaagacgaaaaacaacgacugggacuacgucgugacaaccgauauuagcgagaugggcgccaauuuuagagccgaccggguuaucgaucccagacgcugccuuaagccugugauucugaaggacgggcccgaacgggucauccuggcuggcccgaugccugugacaguugccucugcggcucaaagacgcggacggaucggcagaaaccacaauaaagagggggaucaguauauuuacaugggacagccccucaacaaugacgaggaucaugcccacuggaccgaagccaagaugcugcuugacaacaucaauacgcccgagggcauuaucccugcucuguucgaacccgagcgcgaaaaauccgccgcgauugauggggaguaucggcucagaggagaggcccgcaagaccuuuguggaacugaugagacggggcgaccugccugucuggcucagcuacaaaguggcuuccgagggguuccaguauucugaucgcagauggugcuuugacggcgaacggaacaaucaaguccuugaggaaaacauggauguggagaucuggacaaaggagggagaacgcaaaaagcugagaccgcgguggcuggacgccagaaccuacagcgacccccucgcucugcgcgaguucaaggaauuugccgcuggccggagauccguuucuggggaucuuauccuggagauuggaaaacucccucagcaccugacacagcgcgcccagaaugcgcuggacaaccucgugaugcuucauaauagcgaacaaggcgggcgggccuauagacacgcuauggaggagcugcccgauaccaucgaaacacugaugcuccuggcccuuauugcugugcugaccggaggcgucacgcuguucuuucuguccggccgggggcugggaaagacaagcaucggccuccuuuguguuauggccucuuccgugcugcuguggauggccagcguggagccucauuggauugcugcgucuaucauccucgaguucuuucugaugguccuucugauucccgagccggaccgccagagaaccccucaggauaaccagcucgccuacgugguuaucgggcugcuguucaugauucucaccguggcugccaaugagaugggacuucuggaaacaaccaaaaaggaccugggcaucgggcacgucgccgcugagaaccaccaucacgccgcgaugcucgauguggaccugcaucccgccuccgcuuggacacuuuacgccgucgcuacgaccauuaucacaccuaugaugcggcacaccauugaaaacacaaccgccaauaucagccugacggcgaucgccaaccaagcugccauucucaugggacuggauaaaggcuggcccaucucuaagauggacauuggcgugccucugcucgcucuugggugcuauagccagguuaauccccugacccugacagccgcugugcucaugcuggucgcccauuacgcgaucauuggaccgggccuucaggccaaggcuacccgcgaggcccagaagagaacagcugccgggaucaugaagaacccuaccguggauggaaucguugccauugaccuggaucccguggucuaugacgcgaaauuugaaaagcagcucggccagaucaugcugcugauucucuguacgucccagauccuucugaugcggacaaccugggcucugugcgagucuauuacacucgccaccgggccccugaccacacuuugggagggaagcccuggcaaauucuggaauacgaccaucgcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcauuauggagguggaccggagcgaagccaaggaggggcugaaaagaggagagaccacgaagcacgcuguuucccgcggcacagccaagcuccggugguuugucgaaagaaaucuggugaaaccggaggggaaggugaucgaucuuggauguggccgcgggggauggucuuacuauugcgcuggccugaaaaaggucaccgaaguuaaaggcuacaccaaagggggacccggccacgaggaaccuauucccauggccacauacggguggaaccucgugaaacugcauagcggaaaggacguguucuuugucccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacaccgccggcugggauacacgcaucaccgaagacgaucuccagaacgaggcgagaaucacagacauuauggaaccugagcacgcccugcuugcuaagucuaucuucaagcugaccuaucagaauaaagucgugcggguucaacgccccgccaagaacgggacggugauggaugucauuagcagacgggaccagcgcggcuccggacaggugggcaccuacgggcucaauacauuuaccaacauggaagcucagcugaucagacaaauggagagcgaggaaauuuucucuccuuccgagcuggaaacacccaaccucgccggacgggugcuggauuggcuugagaaacauggcguugaaagacugaagcgcauggcgaucagcggggacgacuguguggucaaaccgaucgaugaccgguuugccaccgcucucacggcccugaaugauaugggaaaggugagaaaggacauuccucagugggagcccucuaaaggcuggaacgauuggcagcagguuccuuucugcucccaccacuuucaucaacuuaucaugaaggacgggcgcgagauugugguccccugucggaaucaggaugaacuggugggcagagcucgcgucagccagggagccggcuggucccuccgggagacagcuugccuggggaaaucuuaugcccagauguggcaacugauguacuuccacagacgcgaccuccggcuggcggccaacgcuaucuguagcgccgugccuguugauugggugcccaccuccagaacaaccuggagcauucaugcccaccaucaguggaugacgaccgaagacaugcuuucugucuggaaucgcguguggaucgaggaaaacccguggauggaggauaagacacacauuuccagcuggggagacguuccuuaucugggcaaacgggaggaccaguggugcgggucucucaucggacugaccgcuagagccacaugggcgaccaauauccaaguggcuauuaaccagguccggagacuuaucggcaaugaaaacuaccuggauuacaugacaagcaugaagcgcuuuaagaaugaguccgaccccgaaggggcccucugguga

SEQ ID NO: 19370 - RNA, 9879 nt, Artificial Sequence
  derived and/or modified CDS sequence (opt5) from DENV-1__JQ045659__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggaacucugugaagauaccaugaccuacaaaugcccccgcaucacagaaaccgaacccgacgauguggacuguuggugcaaugcuacggauaccugggugacauauggaaccuguucccagacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggcgacgcagaacggacggcugaucaccgcuaaucccauugugacagacaaagagaagccugucaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguguuuaccagcguuggcaaacugguccaucagauuuucgggacggcuuacggagugcucuuuuccggcgugagcuggaccaugaagaucgggauuggcguccugcuuacauggcugggacucaauucuagauccaccagccugucuaugacauguaucgccgugggccugguuacccuuuaccucggggugaugguccaggcugauuccggaugcgugauuaacuggaaaggccgcgaacugaagugugggagcggaaucuucguuacaaaugaggugcacaccuggacggaacaauauaaguuucaggccgacuccccuaaacggcugucugcggccauuggcaaggcuugggaggagggggucugcggcaucagaagcgccacacgccucgaaaacaucauguggaaacagauuuccaacgagcugaaucauauccuucuggaaaacgacaugaaguucaccgugguugugggagaugucaccggcauucucgcucaggggaaaaagaugauccggccgcaacccauggaguacaaauauucuuggaaaagcuggggaaaggccaagauuaucggcgccgacgugcagaauacaaccuuuaucauugaugggccuaacacgcccgaauguccugacgaucagagagcuuggaauaucugggagguggaggacuacggauucggcauuuuuacaaccaacaucuggcugaagcugcgcgauucccacacacaggucugcgaccaccggcuuaugagcgcggccauuaaagauucuaaggcuguucaugccgacaugggcuauuggaucgaauccgagaaaaaugaaaccuggaagcucgccagagcuagcuucaucgaggugaagacauguauuuggcccaaaucucacacccugugguccaacggggugcuggaaagcgagaugaucauuccgaagaucuacggaggcccuauuucucaacauaauuaucgccccggguacuucacgcagaccgccggaccuuggcaccucggcaaacuggagcuugauuuugaccugugcgaagggacaaccgucgcgguggaugagcacugcggaaaccggggccccagccucagaacaaccacgguuacaggcaagaucauccaugaaugguguugccgguccuguacccugccuccccugcgcuucagaggggaggacggaugcugguacggcauggagauucggccggugaaagaaaaggaggaaaaucuugucaagagcauggugucugcuggguccggagagguugacagcuuuucccucggccugcuguguaucucuauuaugaucgaagaggugaugagaagccgcuggucccggaaaaugcucaugacagggacccuggccgucuucuuucuucugauuaugggacagcucaccuggaacgaucugaucagacugugcauuauggugggcgccaaugcuucugaccgcaugggcauggggacaacguaucuugcccugauggcgaccuucaagaugagaccuauguuugcuguuggacuccuguuccggcgccucacaagcagagaggugcugcuucugaccaucggccucucccuggucgccucuauggaacugcccaacagccuugaggaacugggggauggacucgccaugggcaucaugauucugaaacuccugacagacuuucaaucccaccagcuuugggcuacccugcucagccugacguucaucaagacaaccuuuucucugcauuacgccuggaaaaccauggcuauggugcuuuccauugugagccuguucccccucugucugucuacaaccucccagaagacaacguggcucccuguccugcuugggagccugggaugcaagccgcugaccauguuucucaucgccgagaauaaaauuuggggccggcgcucuuggccccugaacgaaggcaucauggcgguugggaucguguccauucuucugagcucccuccugaagaacgaugugccucucgccggaccccugaucgcuggcgggaugcuuauugccuguuaugucaucagcggaucuagcgcugaccugucccuggagaaagccgccgaggugucuugggaaaaggaggcugaacacagcggcgcgucccauaauauucucguugaggugcaggaugacgggacaaugaaaaucaaggaugaagagagagacgauacccugacaauccuucugaaagccacccuccuggcugucucuggaguguacccucucagcauucccgccacgcuguucguuugguauuucuggcaaaagaagaaacagcgguccggcgugcuuugggacaccccuucucccccggaggucggccgcgccgugcuggaugacgggaucuacagaauuaugcagcggggacugcucggccgcagccaggucggggugggaguuuuucaagaaaacguguuccacacaauguggcacgucaccagaggcgcugugcugauguaucaggggaagcggcuugagccuuccugggccagcguuaaaaaggaccugaucucuuacggaggcggcuggagacuccagggguccuggaauacaggagaagaggugcaggucauugcgguggagcccggcaaaaacccuaagaaugugcaaaccgcucccgggacauuuaagacgccggaaggagagguuggcgccaucgcccuggauuucaaaccugggaccagcggaucucccauugucaaccgcgaaggcaagaucgugggccucuacgggaauggaguggucacaaccuccggcaccuaugugagcgcuaucgcccaggcgaaggcuucccaggaggggccucugcccgaaauugaggacgagguuuuucggaagagaaaccuuacaaucauggaucugcaucccggaucuggcaaaacgcgccgguaccugccugccauugugagagaagccaucaagcgcaagcuccggacccugauucuugcuccgacaagagucguggccagcgagauggcugaagcccugaaagggaugcccauccgcuaucaaaccacagcgguuaaguccgagcacaccggcaaagaaaucguggaccucaugugccaugccacguucacaaugcggcugcugagcccugucagagugcccaauuacaacaugauuaucauggaugaggcucacuuuaccgacccuucuuccauugccgcucggggauauaucagcacccgcguuggcaugggggaggccgccgcuauuuucaugacagcgacacccccuggaucuguggaagccuuuccgcagagcaaugcugucauccaggaugaggaaagagacauccccgagcgguccuggaacucuggcuacgaauggauuacagauuucccugggaagaccgugugguuugugcccagcaucaaauccggaaaugacauugccaacugucuccgcaagaauggcaagagagucauccagcuuucucggaaaacguucgauacagaguaucaaaagaccaaaaacaacgacugggacuacguugugacaaccgauauuagcgagaugggggccaauuucagagcugaccgcgugaucgauccucggagaugccugaagcccgucauucugaaagacggcccggaacgcgugauccucgccggaccuaugcccguuacgguggcguccgcugcccagcggagaggccgcaucgggcggaaccauaauaaggagggagaucaguacauuuauaugggccagccccugaacaaugacgaagaucacgcccacuggaccgaggcuaagaugcuucuggacaacaucaauacaccugaggggauuauccccgcccucuuugaaccugagagagaaaagagcgcggccauugauggagaguaccgccugagaggcgaggcucggaagaccuucgucgagcugaugcgcagaggggaccucccgguguggcuuucuuauaaaguugccuccgagggcuuucaauacagcgaucggcgcuggugcuucgacggagaaagaaacaaucaggugcuggaggaaaacauggaugucgagaucuggacaaaggaaggcgagcggaaaaagcugagaccccgcuggcucgacgcucggaccuauuccgacccucuggcccuuagagaguuuaaagaguucgcugccgggcgccggucugugagcggagaucugauccucgagauuggcaagcugccccagcaucugacacagagagcgcaaaaugcccucgacaaccuugucaugcugcacaauuccgaacaagggggacgggcuuaccgccaugccauggaggaacugccugauaccaucgagacgcucaugcugcuugcucugauugccgugcucacaggcggcguuacccuguuuuuccugucugggagaggacucggcaagaccagcaucgggcuucugugugugauggccuccagcgugcugcucuggauggcuucugucgagccccacuggauugcggccuccaucauccuggaauuuuuccuuaugguucugcucauuccggagccugaccggcagcgcacaccccaggauaaccaacuggcuuauguggugaucggacugcucuuuaugauucuuaccgucgccgccaaugaaaugggccugcuggagacaacgaaaaaggaccucgggaucggacacguggcuguugagaaccaucaccaugccgcgaugcuggauguggaccuucacccugccagcgcuuggacccuguacgccgucgcuacaaccauuaucacacccaugaugagacauaccauugaaaacacgaccgccaauaucucucucacagcgaucgccaaccaggcugccauucugaugggccuggauaaaggcuggccuaucuccaagauggacauuggggugccccuccuugcucugggaugcuacagccaggucaauccgcugacccucacagccgcugugcugaugcuuguugcccacuaugcgaucauuggcccugggcugcaagccaaagcuacccgggaggcccagaagcgcacggcugccggaaucaugaagaaccccacaguggauggcaucgucgccauugaccucgaucccgugguuuacgacgcgaaauucgaaaagcagcuggggcagaucaugcugcucauucuuuguaccucucaaauccugcugaugagaacaaccugggcucucugcgagagcauuacccuggccacaggaccucuuacgacccugugggaaggcuccccgggcaaauuuuggaauacaaccaucgcugugucuauggccaacaucuuccgggggagcuaucucgccggagcuggccuggccuucucccugaugaaaagccucgggggaggccgcagagggacaggagcgcagggcgagacccuuggcgagaaauggaagcggcagcugaaucagcuguccaagucugaauuuaacacguacaaaagaagcgggauuauggaggucgaccgcuccgaagccaaggagggacucaaacggggcgaaacaaccaagcacgcugugucuagagggaccgccaaacugcgcugguucguggagcggaaucuuguuaagcccgagggaaaggucaucgaucugggcugugggagaggaggcuggagcuauuacugcgcuggccucaaaaaggugacagaagugaaaggguauaccaagggaggcccugggcaugaggaacccauuccuauggccacauacggauggaaccuggucaaacugcacuccggcaaggacgucuuuuucauucccccugagaaaugugauacgcuccuuugcgacauuggggaaucuagcccgaaucccaccaucgaggagggacgcacacugcgggugcugaagaugguggaaccuuggcucagaggcaaccaauuuuguauuaagauccugaaucccuacaugccuuccgucguggagacccuugaacagaugcagcgcaaacauggcgggaugcugguucggaacccccucagcagaaauucuacacacgagauguauuggguguccugcggaaccggcaacaucgucagcgcggugaauaugacgucucgcaugcugcugaaccgguucaccauggcccacagaaagccgacauacgagcgcgauguugaccucggggcuggaaccagacauguggccgucgaaccugagguggcuaaccuggauauuaucggccagcggauugaaaauaucaaacacgagcauaaguccacauggcacuaugacgaagauaaccccuacaaaaccugggccuaucaugggagcuacgaggugaagcccucuggauccgcuagcuccauggucaauggcguugugaaacuucugacaaaaccuugggacgugauucccauggucacccaaaucgccaugacggauacaaccccuuuuggccagcagcgcguguucaaggagaaaguugacaccagaacaccgaaggcgaaacgggggacggcccaaaucauggaagugaccgcuaaguggcucuggggauuucugagcagaaacaagcggccccgcauuuguacaagagaggaguucacccggaaaguccgcucuaaugccgcuaucggcgccguguuuguugacgagaaccaguggaauagcgccaaggaagcgguggaggaugagagauucugggaccuuguccaccgggaacgcgagcugcacaaacaggggaagugcgcuacaugcguguauaacaugaugggaaaaagagaaaagaagcucggcgaguuugggaaagccaagggcucccgggccauuugguacauguggcugggagcucgcuuccuggaguucgaggcccucggcuuuaugaaugaggaucauugguucucuagagaaaacagccuguccgggguugagggagaaggccuucacaaacugggguacauccuccgggacauuucuaagaucccuggaggcaauauguaugcugaugacaccgccgggugggauacacgcaucaccgaggacgaucugcagaacgaggcgagaauuacggacaucauggaacccgagcaugcccuucuggcuaaaagcauuuuuaagcucaccuaccaaaauaaagugguccgggugcagcgcccugccaagaacggcacagucauggaugugaucuccagacgggaccagagaggaucuggccagguugggaccuauggacugaauacauucaccaacauggaagcucaacugauucgccagauggagagcgaaggcaucuuuucccccagcgagcucgagacgccgaaccuggccgaacgggugcuugauuggcuggagaaguacggggucgaaagacucaaacgcauggcgaucucuggagacgacuguguggugaagccuauugaugaccgguucgccacagcucugaccgcccuuaaugauaugggcaaaguuagaaaggacaucccccagugggagccuuccaaaggguggaacgauuggcagcaagugcccuuuugcagccaccacuuccaucagcugauuaugaaggacggccgcgaaaucgucgugccuugucggaaucaggaugagcucguuggcagagcucgcgugucucagggcgccggguggucccugcgggagacagcuugccugggaaagagcuaugcccaaauguggcagcucauguacuuucacagacgcgaccugcggcuugcggccaacgcuauuuguuccgccguccccguggauuggaucccgaccucuagaacgaccuggagcauucaugcccaccaucaguggaugacaaccgaagacaugcuguccgucuggaaucggguguggaucgaggaaaacccuuggauggaggauaaaacacacaucagcucuuggggcgacguucccuaucucgggaagagagaagaccaauggugcggaucccugauuggccuuaccgcucgcgccacaugggcgaccaauauccagguggcuauuaaccagguccggagacugaucgggaaugagaacuaccucgauuacaugacgagcaugaaacgcuucaagaaugagucugaccccgaaggcgcccugugguga

SEQ ID NO: 19371 - RNA, 9879 nt, Artificial Sequence
  derived and/or modified CDS sequence (opt5) from DENV-1__JQ045661__SS-prME
agcgugaccaugcugcucaugcugaugcccacagcccuugcuuuccaccugacgaccagaggcggggaaccucauaugauuguguccaagcaggaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaaacuucgcgauuccuacacccaggucugcgaccaccggcucaugagcgcggccauuaaagauucuaaggcuguucaugccgacaugggcuauuggaucgaauccgagaaaaaugaaacauggaagcuggccagagcuagcuucaucgaggugaagaccuguacauggcccaaaucucacacccugugguccaacggggugcucgaaagcgagaugauuaucccgaagauuuacggaggcccuaucucucaacauaauuaucgccccggguacuucacgcagaccgccggaccuuggcaccugggcaaacuugagcuggauuuugaccucugcgaagggacaaccgucgugguugaugagcacugcggaaaccggggccccagccugagaacaaccacggugacaggcaagauuauccaugaaugguguugccgguccuguacccugccuccccuucgcuucagaggggaggacggaugcugguacggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugacagggacccuugcuguguucuuucugcucaucguuggacagcugaccuggaacgaucugauuagacuuugcaucaugauuggcgccaaugccucugaccgcaugggcauggggacaacguaucuggcucucauggccaccuucaagaugagaccuauguuugcggugggacugcuguuccggcgccugacaagcagagagguccuucugcucaccaucggccugucccugguggcuucuguggaacuucccaacagccuggaggaacucggggauggacuggccaugggcaucaugauucucaaacugcuuacagacuuucaaucccaccagcugugggccacccuccugagccugacguucaucaagacaaccuuuucucuucauuacgcuuggaaaaccauggccaugguccuguccguugugagccucuucccccugugucucucuacaaccucccagaagacaacguggcugccugugcuucuggggagccugggaugcaagccgcucaccauguuucugauugcugagaauaaaaucuggggccggcgcucuuggccccuuaacgaaggcauuauggccgucgggaucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacaaugaagauuaaagaugaggagagagacgauacccuuacaauccugcucaaggcgacccugcucgccgugucuggagucuacccucugagcauccccgcuacgcuuuucgugugguauuucuggcagaagaagaagcagcgguccggcguccugugggacaccccuucucccccggaaguggagcgcgccguucuggaugacggcauuuacagaaucaugcagcgggggcuccugggacgcagccaggugggcgucgggguguuucaagaaaacguuuuccacacaauguggcacgugaccagaggagccguccuuauguaucagggcaaacggcuggagccuuccugggcuagcgugaagaaagaccucauuucuuacgggggaggcuggagacugcagggcuccuggaauacaggggaggaagugcagguuaucgccgucgagcccggaaagaacccuaaaaaugugcaaaccgcgcccggcacauuuaagacgccggaaggggaggugggagcuauugcccucgauuucaagccuggcaccagcgggucucccaucgucaaccgcgaaggaaaaauugugggccuguacggcaaugggguugugacaaccuccggaaccuaugucagcgccaucgcucaggccaaggcgucccaggagggcccucuucccgagaucgaagacgagguguuucggaaaagaaaccugacaauuauggaucugcaucccgggucuggaaagacgcgccgguaccucccugcuaucguuagagaagccauuaaacgcaagcugcggacccuuauccuggccccgacaagaguggucgcuagcgagauggccgaagcucucaagggcaugcccauucgcuaucaaaccacagccgugaaauccgagcacaccgggaaggagaucguugaccugaugugccaugcgacguucacaaugcggcugcucagcccugugagaguccccaauuacaacaugaucauuauggaugaagcccacuuuaccgacccuucuuccaucgcugcccggggcuauauuagcacccgcgugggaaugggcgaggcugccgccaucuucaugacagcuacacccccugggucuguggaagcguuuccgcagagcaaugccgucauucaggaugaggaaagagacauccccgagcgguccuggaacucuggauacgaguggaucacagauuucccuggcaaaaccguuugguuugugcccagcauuaaguccgggaaugacaucgcuaacugucuucgcaaaaauggaaagagagugauucagcugucucggaagacguucgauacagaauaucagaagaccaagaacaacgacugggacuacgucgugacaaccgauaucagcgagaugggcgccaauuucagagccgaccgcguuauugauccucggagaugccugaaacccgugauccucaaggacgggccggaacgcgucauucuggcuggcccuaugcccgugacgguugccuccgcggcucagcggagaggacgcaucggccggaaccauaauaaagagggggaucaguacaucuauaugggacagccccuuaacaaugacgaggaucacgcccacuggaccgaagccaagaugcugcucgacaacauuaauacaccugagggcaucauucccgcucuguuugaaccugagagagaaaagagcgccgcgaucgauggggaguaccgccugagaggagaggcccggaaaaccuucguggaacucaugcgcagaggcgaccuuccggucuggcugucuuauaagguggcuuccgagggguuucaauacagcgaucggcgcuggugcuucgacggcgaaagaaacaaucagguccuggaggaaaacauggauguggagauuuggacaaaagagggagaacggaagaaacucagaccccgcuggcuggacgcccggaccuauuccgacccucuugcucugagagaguuuaaggaguucgccgcuggccgccggucuguuagcggggaucucauccuggagaucggaaaacugccccagcaucucacacagagagcccaaaaugcgcuugacaaccuggugaugcugcacaauuccgaacagggcgggcgggccuaccgccaugcuauggaggagcucccugauaccauugaaacgcugaugcuucuggcccucaucgcugugcugacaggaggcgucacccuguuuuuccucucuggcagagggcuuggaaagaccagcauuggccugcuguguguuauggccuccagcgugcuccuguggauggccucuguggagccccacuggaucgcugcguccauuauccuugaauuuuuccugaugguccuccugaucccggagccugaccggcagcgcacaccccaggauaaccaacuggccuaugugguuauugggcuccuuuuuaugauccugaccguggcugccaaugagaugggacugcucgaaacaacgaagaaagaccugggcauugggcacgucgccguggagaaccaucaccaugcugccaugcuugaugucgaccugcacccugcgagcgccuggacccucuacgcuguggccacaaccaucauuacacccaugaugagacauaccaucgaaaacacgaccgcuaauauuucucugacagccaucgcgaaccaggccgcuauccugaugggacucgauaagggcuggccuauuuccaaaauggacaucggcguuccccuucuggcccuggggugcuacagccaggugaauccgcucacccugacagcugccguccuuaugcugguggcucacuaugccauuaucggaccuggccuccaagcgaaggccacccgggaggcucagaaacgcacggccgcugggauuaugaagaaccccacaguugauggaaucguggccaucgaccuggaucccgucguguacgacgccaaguucgaaaaacagcugggccagauuaugcuccuuauccuguguaccucucaaauucugcucaugagaacaaccugggcgcugugcgagagcaucacccuugcuacagggccucugacgacccucugggagggauccccgggcaaguuuuggaauacaaccauugccgugucuauggcuaacaucuuccggggcagcuaucuggccggggccggacuggcuuucucccucaugaaaagccuuggcgggggacgcagaggcacaggggcccagggagaaacccugggcgagaaguggaaacggcagcugaaucagcucuccaagucugaauuuaacacguacaagagaagcggcaucauggagguugaccgcuccgaagcgaaagaggggcugaagcggggagagacaaccaaauaugccgucucuagaggcaccgcuaaacuucgcugguucguggaacggaaucuggugaaacccgaggggaaggucauugaucucggauguggcagagggggauggagcuacuauugcgccggccugaagaaaguuacagaagugaagggcuacaccaaagggggaccuggccacgaggaacccaucccuauggcuacauacggguggaaccuggugaagcuccauuccggaaaagacgucuuuuucauucccccugagaagugugauacgcuucugugcgacaucggcgagucuagcccgaaucccaccauugaagaggggcgcacacugcgggugcucaaaaugguugaaccuuggcugagaggaaaccaauuuuguaucaagauucuuaaucccuauaugccuuccguggucgagacccuggagcagaugcagcgcaagcacggcggcaugcucgugcggaacccccugagcagaaauucuacacaugaaauguacuggguuuccugcgggaccggaaacaucgugagcgccgucaauaugacgucucgcaugcugcucaaccgguucaccauggcgcacagaaaaccgacauaugagcgcgauguggaccugggcgccgggaccagacacguggcugucgaaccugagguugccaaccuugauaucauuggacagcggaucgaaaauauuaagcaugagcacaaauccacauggcauuacgacgaggauaaccccuauaagaccugggcuuaccacggcagcuaugaagugaaacccucuggguccgccagcuccauggugaauggagucgugaagcugcucacaaagccuugggacguuauccccauggugacccaaauugcuaugacggauacaaccccuuuuggccagcagcgcgucuucaaagagaagguggacaccagaacaccgaaagccaagcggggcacggcgcaaaucauggaaguuaccgccaaauggcuguggggguuucuuagcagaaacaagaagccccggaucuguacacgcgaggaguucaccagaaaagugcggucuaaugcugccauuggagcugucuuuguggacgagaaccaguggaauagcgccaaggaggccguugaagaugagcgcuucugggaccuggugcauagagaacgggagcuccacaaacagggcaagugcgcgacaugcgucuacaacaugauggggaaacgcgaaaagaagcugggagaguuuggcaaagcuaagggguccagagccaucugguacauguggcugggcgcccgguuccucgaguucgaagcucugggauuuaugaaugaggaucacugguucucucgcgaaaacagccuuuccggcguggagggggagggacugcauaaacucggcuauauucugagagacaucucuaagauuccugggggaaauauguacgccgaugacaccgcuggcugggauacacggaucaccgaagacgaucuucagaacgaggcccgcaucacggacauuauggaacccgagcacgcgcugcucgccaaaagcaucuuuaagcugaccuaucaaaauaaagucgugagaguucagcggccugcuaagaacgggacagugauggaugucauuucccgcagagaccagcggggcucuggacaggugggcaccuacgggcugaauacauucaccaacauggaagcccaacucaucagacagauggagagcgagggaaucuuuucccccagcgaacuggagacgccgaaccuugcugaacgcgugcuggauuggcucgagaaguauggcguugaacggcugaaaagaauggccaucucuggggacgacuguguggucaagccuaucgaugaccgcuucgcgacagcccuuaccgcucugaaugauaugggaaaagugcggaaggacauuccccagugggagccuuccaaaggcuggaacgauuggcagcaaguucccuuuugcagccaucacuuccaccagcucaucaugaaggacgggagagagauuguggucccuugucgcaaucaggaugaacuggugggccgggccagagucucucagggagcuggcuggucccugcgcgagacagccugccucggaaagagcuacgcucaaauguggcagcugauguauuuucaucggagagaccuucgccuggccgcgaacgccaucuguuccgcugugcccguugauuggauuccgaccucucggacgaccuggagcauccacgcccaucaccaguggaugacaaccgaagacaugcucuccguguggaauagagucuggauugaggaaaacccuuggauggaggauaaaacacauaucagcucuuggggagacgugcccuaccugggcaagcgggaggaccaauggugcgggucccuuaucggacugaccgccagagcuacaugggccaccaauauucagguugcgaucaaccaggugcgccggcucauuggcaaugaaaacuaccuggauuauaugacgagcaugaaaagauucaagaaugagucugaccccgaaggggcucugugguga

SEQ ID NO: 19372 - RNA, 9879 nt, Artificial Sequence
  derived and/or modified CDS sequence (opt5) from DENV-1__JQ045663__SS-prME
agcgugaccaugcugcugaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaagcugaccgugguugugggagaugucgccggcauucuggcucaggggaaaaagaugauccggccgcaacccauggaguacaaauauucuuggaaaagcuggggaaaggccaagauuaucggcgccgacgugcagaauaccacauucaucauugaugggccuuccacccccgaauguccugacgaucagagagcuuggaacaucugggagguggaggacuacggauuuggcauuuucacgacaaauaucuggcuuaagcuccgcgauagccacacccaggucugcgaccaccggcugaugucugcggccauuaaagauuccaaggcuguucaugccgacaugggcuauuggaucgaaagcgagaaaaacgaaacauggaagcuggccagagcuucuuuuaucgaggugaagaccuguauuuggcccaaaucccacacacucuggagcaauggggugcuggaaucugagaugaucauuccgaagaucuacggaggcccuauuagccaacauaacuaucgccccggguacuucacccagacggccggaccuuggcaccuuggcaaacuggagcucgauuucgaccugugcgaagggaccacagucgugguugaugagcacugcggaaaucggggccccucccugagaaccacaaccgugacgggcaagaucauccaugaaugguguugccggagcuguacacuuccuccccuccgcuuuagaggggaggacggaugcugguacggcauggagauucggccggucaaagaaaaggaggaaaaccuggugaagucuaugguuuccgcggggagcggagagguggacuccuucucucugggccuccuguguaucagcauuaugaucgaagaggucaugagaucccgcuggucucggaaaaugcuuaugaccgggacacuggcuguguuuuuccuccugauuaugggacagcugaccuggaaugaucuuaucagacugugcauuaugguuggcgccaacgccagcgaccgcaugggcauggggaccacauaucucgcucugauggccacguuuaagaugagaccuauguucgcggugggacuccuguuucggcgccuuaccuccagagagguccugcuccugacaaucggccugucucuuguggcuagcguggaacugcccaauucccucgaggaacugggggauggacucgccaugggcaucaugauucugaaacuucugaccgacuuccaaagccaccagcucugggccacacugcugucucuuaccuuuaucaagacgacauucucccugcauuacgcuuggaaaaccauggccaugguccucagcauuguuucucuguuuccccucugucuguccaccacaagccagaagaccacauggcuuccugugcugcuggggucucucggaugcaagccgcugacgauguuccuuaucgcugagaacaaaauuuggggccggcgcuccuggccccugaaugaaggcaucauggccguggggaucgucagcauucuccuguccagccuccugaagaacgaugugccucuugcgggaccccugaucgccggcgggaugcugauugcuuguuauguuaucucuggaagcuccgccgaccucucucuggagaaagcugccgaggugagcugggaagaggaagccgagcacuccggcgcuucucauaacauucuugucgaagugcaggaugacgggaccaugaagaucaaagaugaggagagagacgauacacugaccauccuccugaaggcgacacuccuggccguuagcggaguguacccucuuuccauucccgcuacccuguuugucugguauuucuggcagaagaagaagcagcggucuggcgugcugugggacacgccuagcccucccgaagucgagcgcgccgugcucgaugacggcaucuacagaauuaugcagcgggggcugcuuggacgcucccagguuggcgugggggucuuccaagaaaauguguuucacaccauguggcacguuacaagaggagccgugcugauguaucagggcaaacggcucgagcccagcugggcuucugucaagaaagaccugaucuccuacgggggaggcuggagacuccagggcagcuggaacaccggggaggaaguccaggugauugccguugagcccggcaaaaauucuaaaaacguccaaacagcgccuggaaccuucaagacacccgaaggggaggugggagcuaucgcccuggauuuuaagccgggcacguccgggagcccuauugugaaucgcgaaggaaaaaucgucggccuuuacggcaacggggugguuaccacauccggaaccuaugugucugccaucgcucaggccaaggcgagccaggagggcccccugccugagauugaagacgaggucuuccggaaaagaaaucugaccaucauggaucuccaucccggguccggaaagacacgccgguaccugcccgcuauugugagagaagccaucaaacgcaaacuucggacgcugauucucgccccuaccagaguuguggcuagcgagauggccgaagcucugaagggcaugccgauccgcuaucaaacaaccgccgucaaaucugagcacacagggaaggagaucguggaccugaugugccaugcgaccuuuacgaugcggcuccuuucccccguuagagugccuaacuacaauaugauuaucauggaugaagcccacuucacagaccccagcucuauugcugcccggggcuauaucagcacccgcgucggaaugggcgaggcugccgccauuuuuaugaccgcuacaccucccggguccguggaagcguucccucagucuaacgccgugauccaggaugaggaaagagacaucccggagcggagcuggaacuccggauacgaguggauuaccgauuuucccggcaaaacagucugguucguuccuucuaucaagagcgggaacgacauugcuaauugucugcgcaaaaacggaaagagagugauccagcugucccggaagaccuuugauacggaauaucagaagacaaagaauaacgacugggacuacguggucaccacagauauuagcgagaugggcgccaacuucagagccgaccgcgugaucgauccccggagaugccucaaaccuguuauucugaaggacgggcccgaacgcgugauccuugcuggcccgaugccugucaccguggccucugcggcucagcggagaggacgcaucggccggaaucauaacaaagagggggaucaguacauuuauaugggacagccccugaauaacgacgaggaucacgcccacuggacggaagccaagaugcuccuggacaauaucaacacccccgagggcauuaucccugcucuguucgaacccgagagagaaaaguccgccgcgauugauggggaguaccgccucagaggagaggcccggaaaacauuuguugaacuuaugcgcagaggcgaccugccuguguggcugagcuauaaggucgcuuccgagggguuccaauacucugaucggcgcuggugcuuugacggcgaaagaaauaaccaggugcucgaggaaaauauggaugucgagaucuggaccaaagagggagaacggaagaaacugagaccgcgcuggcuugacgcccggacauauagcgacccccuggcucucagagaguucaaggaauuugccgcuggccgccgguccgugucuggggaucugauccuggagauuggaaaacucccucagcaucuuacccagagagcccaaaacgcgcuggacaaucugguuaugcuccacaacagcgaacagggcgggcgggccuaccgccaugcuauggaggagcugcccgauacaaucgaaacccuuaugcugcucgcccugauugcugugcugacgggaggcgugacacucuuccuucuguccggcagagggcugggaaagaccagcaucggccuccugugugucauggccucuuccguucuucuguggauggccagcguggagccucacuggauugcugcgucuaucauccucgaauuuuuccugauggugcugcucauucccgagccggaccggcagcgcaccccucaggauaaucaacuugccuaugucgugaucgggcugcuguuuaugauucucacaguugcugccaacgagaugggacugcuugaaaccacaaagaaagaccugggcaucgggcacguggccgucgagaaucaucaccaugcugccaugcucgauguggaccugcaccccgcguccgccuggacgcuguacgcugucgccaccacaauuaucaccccuaugaugagacauacaauugaaaacaccacggcuaacaucagccucaccgccaucgcgaaucaggccgcuauucuuaugggacuggauaagggcuggcccaucucuaaaauggacauuggcgugccucugcucgcccuggggugcuacagccagguuaacccccuuacacugaccgcugccgugcucaugcuggucgcucacuaugccaucauuggaccgggccugcaagcgaaggccacacgggaggcucagaaacgcaccgccgcugggaucaugaagaauccuacgguggauggaaucguugccauugaccucgaucccguggucuacgacgccaaguucgaaaaacagcuuggccagaucaugcugcugauucucuguacaucccaaauccugcuuaugagaaccacaugggcgcugugcgagucuauuacccucgcuaccgggccccugacaacgcugugggagggaagcccuggcaaguuuuggaacaccacaaucgccguguccauggcuaauaucuuccggggcagcuaucucgccggggccggacuugcuuuuucccugaugaaaucucugggcgggggacgcagaggcaccggggcccagggagaaacacucggcgagaaguggaaacggcagcugaaccagcuuagcaaguccgaguucaauaccuacaagagaucuggcauuauggagguggaccgcagcgaagcgaaagaggggcugaagcggggagagacgacaaaacacgccguuuccagaggcaccgcuaagcuccgcugguucgucgaacggaaccuggugaaaccggaggggaaggugaucgaucugggauguggcagagggggauggucuuauuacugcgccggccucaagaaagucaccgaaguuaagggcuauacaaaagggggacccggccaugaggaaccuauucccauggcuaccuacggguggaaucuugugaagcugcacagcggaaaagacguguuuuucaucccucccgagaagugugauacacugcucugcgacauuggcgaguccagcccuaacccgacgaucgaagaggggcgcacccugcggguccuuaaaaugguggaacccuggcugagaggaaaucaauuuuguauuaagauccucaacccuuacaugcccucuguuguggagacacuggagcagaugcagcgcaagcauggcggcaugcugguccggaauccucucuccagaaacagcacccacgaaauguauugggugucuugcgggacaggaaauaucguuuccgccgugaacaugaccagccgcaugcugcuuaaucgguucacgauggcgcacagaaaacccaccuacgagcgcgaugucgaccugggcgccgggacaagacauguggcuguggaaccggaggucgccaaccucgauauuaucggacagcggauugaaaacaucaagcacgagcauaaaucuaccuggcacuaugacgaggauaauccuuacaagacaugggcuuaucauggcuccuacgaaguuaaacccagcggguccgccagcucuauggugaacggaguggucaagcugcuuaccaagcccugggacgugauuccuaugguuacacaaaucgcuaugaccgauacgacacccuuuggccagcagcgcguguucaaagagaaggucgacaccagaaccccuaaagccaagcggggcacagcgcaaaucauggaagugacggccaaauggcuguggggguuucucagcagaaauaagaagccgcggauuuguacccgcgaggaguucacaagaaaaguucgguccaacgcugccaucggagcuguguuugucgacgagaaucaguggaacucugccaaggaggccguggaagaugagcgcuucugggaccugguucacagagaacgggagcugcacaaacagggcaagugcgcgaccugcguguauaauaugauggggaaacgcgaaaagaagcucggagaguuuggcaaagcuaaggggagcagagccauuugguacauguggcugggcgcccgguuccuugaguuugaagcucugggauucaugaacgaggaucauugguucucccgcgaaaauucucucagcggcgucgagggggagggacugcacaaacuuggcuacauccugagagacauuuccaagauccccgggggaaacauguaugccgaugacacagcuggcugggauacccggaucacagaagacgaucuccagaaugaggcccgcauuaccgacaucauggaaccugagcaugcgcugcuggccaaaucuauuuuuaagcucacguaccaaaacaaaguggucagagugcagcggcccgcuaagaaugggaccguuauggaugugaucagccgcagagaccagcggggcuccggacaggucggcacauaugggcugaacaccuucacaaauauggaagcccaacuuauuagacagauggagagcgagggaaucuuuucuccuuccgaacuggagacccccaaccucgcugaacgcgugcuggauuggcuugagaaguacggcguggaacggcugaaaagaauggccaucagcggggacgacuguguugugaagccgauugaugaccgcuucgcgacggcccucacagcucugaacgauaugggaaaaguccggaaggacaucccucagugggagcccucuaaaggcuggaaugauuggcagcaagugccuuuuugcucccaccacuuccaucagcugauuaugaaggacgggagagagaucguugugcccugucgcaaccaggaugaacucgucggccgggccagagugagccagggagcuggcuggucccugcgcgagaccgccugccuugggaagucuuaugcucaaauguggcagcugauguacuuucaccggagagaccuccgccuggccgcgaaugccauuuguagcgcugucccuguggauuggauccccacaucccggaccacguggagcauucaugcccaccaucaguggaugaccacagaagacaugcuuucuguuuggaacagaguguggaucgaggaaaauccguggauggaggauaaaacccacaucuccagcuggggagacgucccuuaucugggcaagcgggaggaccaauggugcgggucucucauuggacugacagccagagcuaccugggccacaaacauccagguggcgauuaaucagguucgccggcugaucggcaacgaaaauuaccucgauuacaugaccagcaugaaaagauucaagaacgaguccgaccccgaaggggcucugugguga

SEQ ID NO: 19373 - RNA, 9879 nt, Artificial Sequence
  derived and/or modified CDS sequence (opt5) from DENV-1__JQ045665__SS-prME
agcgugaccaugcugcugaugcugaugcccacagcccuugcuuuccaccugacggccagaggcggggaaccucauaugaucgucuccaagcaagaacggggaaaaucucuccuguuuaagaccagcgccggcguuaauaugugcacccuuauugcuauggaccugggggaacucugugaagauaccaugacauacaaaugcccccgcaucaccgaaacagaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaagggggcuacacagaacggacggcuuaucacggccaaucccauuguuaccgacaaagagaagccugugaacaucgaagccgagccgcccuuuggcgagagcuauauugucaucggggcuggagaaaaagcccucaagcugucuugguucaagaaaggcagcuccauugggaagauguuugaggcuacagccagaggcgcgcgccggauggccauccugggagauaccgcuugggacuucggcucuaucgggggaguguuuacaagcgugggcaaacucguucaucagauuuucgggaccgccuacggaguccuguuuuccggcgugagcuggacgaugaagaucgggauuggcgugcuucugaccuggcucggacucaauucuagauccacaagccugucuaugaccuguaucgcugucggccuugugacacucuaccuggggguuauggugcaggccgauuccggaugcgucauuaacuggaaaggccgcgaacugaagugugggagcggaaucuucgugaccaaugagguucacacauggaccgaacaauauaaguuucaggcggacuccccuaaacggcucucugccgcuauuggcaaggccugggaggagggggugugcggcaucagaagcgcuacgcgccuggaaaacaucauguggaaacagauuuccaacgagcuuaaucauauccugcucgaaaacgacaugaaguucacagucgugguuggagauguggccggcauucuggcccaggggaaaaagaugauccggccgcaacccauggaguacaaauauucuuggaaaagcuggggaaaggcuaagauuaucggcgcggacguccagaauaccaccuuuaucauugaugggccuaacacacccgaauguccugacgaucagagagccuggaauaucugggagguggaggacuacggauucggcauuuuuaccacgaacaucuggcugaaacuucgcgauuccuauacacaggugugcgaccaccggcucaugagcgcugccauuaaagauucuaaggccguccacgcugacaugggcuacuggaucgaauccgagaaaaaugaaaccuggaagcuggccagagcgagcuucaucgagguuaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuuugaccucugcgaagggacgaccguggucgugaacgagcacugcggaaaucggggccccagccugagaacaaccacaguuaccggcaagaucauccacgaaugguguugccgguccuguacgcugccuccccuucgcuucagaggggaggauggaugcugguauggcauggagauucggccggugaaagaaaaggaggaaaaccucgucaagagcauggugucugccggguccggagagguugacagcuuuucccugggccugcucuguaucucuauuaugaucgaagaggugaugagaagccgccugucccggaaaaugcuuaugacagggacccuggccgucuucuuucuccugauuaugggacagcugacauggaaugaccuuaucagacugugcauuauggugggcgcuaacgccucugaucgcaugggcauggggaccaccuaccucgcgcugauggcuacauucaagaugagaccuauguuugccguuggacuccuguuccggcgccuuacgagcagagaggugcugcuccugaccaucggccugucccuugucgccucuguggaacugcccaauagccucgaggaacugggggacggacucgcuaugggcaucaugauucugaaacuucugacagauuuucaaucccaucagcucugggccacccugcugagccuuacauucaucaagaccacguuuucucugcaccaugcuuggaaaacaauggccaugauucucuccaucgugagccuguucccccucugucugucuaccaccucccagaagacaaccuggcuuccuguccugcuggggagccucggaugcaagccgcugacaauguuucuuauugcggagaacaaaaucuggggccggcgcucuuggccccugaacgaaggcaucauggccguugggauuguguccauccuccugagcucccuccugaagaaugacgugccucuugcuggaccccugauugccggcgggaugcugaucgcuuguuaugucauuagcggaucuagcgccgaucucucccuggagaaagccgcugaggugucuugggaagaggaagcggagcacagcggcgccucccauaacauccuuguugaagugcaggacgaugggacgaugaagaucaaagacgaggagagagaugacacccugacaauucuccugaaggcuacccuccuggccgucucuggaguguacccucuuagcauccccgccacacuguucguuugguauuucuggcagaagaagaagcagcgguccggcgugcugugggauaccccuucucccccggaagucgagcgcgcugugcucgacgauggcauuuacagaaucaugcagcgggggcugcuuggacgcagccaggucggcguggggguuuuucaagaaaauguguuccacacgauguggcacgucaccagaggagccgugcugauguaucagggcaaacggcucgagccuuccugggcgagcguuaagaaagaccugauuucuuacgggggaggcuggagacuccagggcuccuggaacacaggggaggaagugcaggucaucgcuguggagcccggaaagaauccuaaaaacgugcaaaccgcccccggcacauuuaagaccccggaaggggagguuggagccauugcucuggacuucaagccuggcacaagcgggucucccaucgucaaucgcgaaggaaaaaucgugggccuuuacggcaacgggguggucacgaccuccggaacauaugugagcgccauugcgcaggcuaaggccucccaggagggcccucugcccgagaucgaagaugagguuuuucggaaaagaaaucugaccauuauggaccuccaucccgggucuggaaagacccgccgguaccugccugccaucgugagagaagcuauuaaacgcaaacuucggacacugauccucgccccgacgagagucguggcuagcgagauggccgaagcgcugaagggcaugcccauccgcuaucaaaccacagccguuaaauccgagcacaccgggaaggagauuguggaucugaugugccaugcuacauucaccaugcggcuccuuagcccugucagagugcccaacuacaauaugaucauuauggacgaagcccacuuuacggauccuucuuccaucgcugcccggggcuauauuagcacacgcguuggaaugggcgaggccgcugcgaucuucaugaccgccacacccccugggucuguggaggcuuuuccgcagagcaacgccgucauccaggacgaggaaagagauauucccgagcgguccuggaacucuggauacgaguggaucacagacuucccuggcaaaaccgugugguuugugcccagcauuaaguccgggaacgauaucgccaauugucugcgcaaaaacggaaagagagucauucagcugucucggaagacauucgacaccgaauaucagaagacgaagaacaaugauugggacuacguugugacaaccgacaucagcgagaugggcgcuaacuucagagccgaucgcgugauugacccucggagaugccucaaacccgucauccugaaggaugggccggaacgcgugauccuugcgggcccuaugcccguuacaguggcuuccgccgcccagcggagaggacgcauuggccggaaucauaacaaagagggggaccaguacaucuauaugggacagccccugaauaacgaugaggaccacgcucacuggaccgaagccaagaugcuccuggauaauauuaacacgccugagggcaucauucccgcgcuguuugaaccugagagagaaaagagcgccgcuaucgacggggaguaccgccucagaggagaggcccggaaaucuuucgucgaacuuaugcgcagaggcgaucugccgguguggcuguccuauaagguugcuagcgagggguuucaauacuccgaccggcgcuggugcuucgauggcgaaagaaauaaccaggugcucgaggaaaauauggacgucgagaucuggaccaaagagggagaacggaagaaacugagaccccgcuggcuugaugcccggacauauucugacccucuggcucucagagaguuuaaggaguucgccgcgggccgccggagcguguccggggaccugauucuggagaucggaaaacucccccagcaucuuacccagagagcccaaaacgcucuggauaaucuggucaugcuccacaacucugaacagggcgggcgggccuaccgccaugcuauggaggagcugccugacacaauugaaacccuuaugcugcucgcccugaucgccgugcugacaggaggcguuacccucuuuuuccuuagcggcagagggcugggaaagacguccauuggccugcucugugugauggcuagcucugugcugcuuuggauggcguccgucgagccccacuggaucgccgcuagcaucauucuggaauuuuuccucaugguucugcugaucccggagccugaucggcagcgcacaccccaggacaaucaacucgccuauguggugauugggcuucuguuuaugauccugaccgucgccgcuaacgagaugggacuccuggaaaccacaaagaaagaucuuggcauugggcacguggccguugagaaccaucaccaugcggccaugcuggacguggaucuccacccugcuucugccuggacccuguacgcugucgccacaacgaucauuacccccaugaugagacauacaaucgaaaauaccacagcgaacaucucccugaccgccauugcuaaucaggccgcuauccucaugggacuugacaagggcuggccuauuagcaaaauggauaucggcgugccccugcuggcccucgggugcuacucucaggucaacccgcugacgcuuaccgcugccgugcugaugcucguugcgcacuaugccauuaucggaccuggccugcaagcuaaggccacacgggaggcucagaaacgcaccgccgccgggaucaugaagaaucccacaguggacggaauugucgcgaucgaucuggaccccgugguuuacgaugcuaaguucgaaaaacagcucggccagauuaugcuucugauccuguguaccagccaaauucuccugaugagaacgacaugggcccuuugcgaguccaucacccuggcuacagggccucucaccacccugugggagggaucuccgggcaaguuuuggaacacaacgaucgccgugagcauggccaauauuuuccggggcuccuaucuggcuggggccggacucgcguucagccuuaugaaaucccugggcgggggacgcagaggcaccggggcccagggagaaacacugggcgagaaguggaaacggcagcucaaccagcugucuaagagcgaauuuaauaccuacaagagauccggcaucauggaggucgaccgcucugaagcuaaagaggggcuuaagcggggagagacaaccaaacacgccgugagcagaggcacggcuaagcugcgcugguucguggaacggaaccucguuaaacccgaggggaaggucauugaccugggauguggcagagggggaugguccuauuacugcgccggccugaagaaagugacagaagugaagggcuauaccaaagggggaccuggccaugaggaacccaucccuauggcgaccuacggguggaaucucgucaaacuucacucuggaaaagauguguuuuucauucccccugagaagugugacacacugcugugcgauaucggcgagagcuccccgaaccccaccauugaagaggggcgcacacuccggguucugaaaaugguggaaccuuggcuuagaggaaaucaauuuuguaucaagauccugaaccccuacaugccuagcgucguggagacgcucgagcagaugcagcgccggcauggcggcaugcugguuagaaauccccugucucgcaacuccacccacgaaauguauugggugagcugcgggacaggaaauauugucucugccgugaacaugaccucccggaugcuccugaacagauucacaauggcucaccgcaagccgaccuacgagagagacguugaucuuggcgccgggacgcggcauguggcugucgaaccugagguggccaaucuggacaucauuggacagcgcaucgaaaacauuaaacacgagcauaagagcaccuggcacuaugaugaggacaaucccuacaaaacaugggcuuaucauggcucuuacgaagugaagcccuccgggagcgccuccagcauggucaacggaguugugaaacuccugaccaagccuugggaugugauccccauggucacacaaaucgcgaugaccgacacaaccccuuuuggccagcagagaguguucaaggagaaaguugauacgcggacaccgaaggccaaaagaggcaccgcucaaauuauggaagugaccgccaaguggcuuuggggguuucugucucggaauaaaaagccccgcaucuguacaagagaggaguucacgcggaagguccgcagcaacgcugccauuggagccguguuuguugacgagaaucaguggaacuccgcgaaagaggcuguggaagacgagagauucugggaucucguccaccgggaacgcgagcugcacaagcagggcaaaugcgcgaccugcguguauaauaugauggggaagagagagaagaagcugggagaguuuggcaaggccaaagggucucgggcuaucugguacauguggcucggcgcccgcuuccuggaguucgaagcucuuggauuuaugaacgaggaccauugguucagcagagaaaauucccugucuggcguugagggggagggacuccacaagcugggcuacauucuucgggauaucagcaaaaucccugggggaaacauguaugccgacgauacagcgggcugggacacccgcauuacagaagaugaccugcagaaugaggccagaaucaccgauauuauggaacccgagcaugcucuccuggccaaguccaucuuuaaacugacauaccaaaacaaggugguccgggugcagcgcccugcuaaaaaugggaccgucauggacgugauuucuagacgggaucagagaggcagcggacagguuggcacguaugggcucaacaccuucacaaacauggaagcccaacugauccgccagauggaguccgagggaaucuuuagccccucugaacuugagaccccgaaucuggcggaacgggugcucgacuggcuggagaaguacggcgucgaaagacuuaagcgcauggccauuuccggggaugacuguguggugaaaccuaucgacgaucgguucgcuacagcccugaccgcucucaacgacaugggaaagguuagaaaagauauuccccagugggagccuagcaagggcuggaaugacuggcagcaagugcccuuuugcucucaccacuuccaucagcugaucaugaaagaugggcgcgagauugucgugccuugucggaaccaggacgaacugguuggcagagcccgcgugucccagggagcuggcuggagccuccgggagacggccugccuggggaaguccuaugcgcaaauguggcagcuuauguacuuucacagacgcgaucugcggcucgccgcuaaugccaucuguucugccguccccguggacuggauuccgacaaccugcacaaccuggagcauccaugcucaccaucaguggaugacgaccgaagauaugcuguccgucuggaacagaguguggaucgaggaaaauccuuggauggaggacaagacacacauuagcucuuggggagauguucccuaucuuggcaaacgggaggaccaauggugugggucccugaucggacucaccgccagagcgacaugggcuaccaacauucagguggccaucaaucagguccgccggcugauuggcaacgaaaauuaccuggacuacaugacaagcaugaagagauucaaaaacgagucugaucccgaaggggcccucugguga

SEQ ID NO: 19374 - RNA, 9879 nt, Artificial Sequence
  derived and/or modified CDS sequence (opt5) from DENV-1__JQ045666__SS-prME
agcgugaccaugcugcugaugcugaugcccacagcccuugcuuuccaccugacggccagaggcggggaaccucauaugaucgucuccaagcaagaacggggaaaaucucuccuguuuaagaccagcgccggcguuaauaugugcacccuuauugcuauggaccugggggaacucugugaagauaccaugacauacaaaugcccccgcaucaccgaaacagaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaagggggcuacacagaacggacggcuuaucacggccaaucccauuguuaccgacaaagagaagccugugaacaucgaagccgagccgcccuuuggcgagagcuauauugucaucggggcuggagaaaaagcccucaagcugucuugguucaagaaaggcagcuccauugggaagauguuugaggcuacagccagaggcgcgcgccggauggccauccugggagauaccgcuugggacuucggcucuaucgggggaguguuuacaagcgugggcaaacucguucaucagauuuucgggaccgccuacggaguccuguuuuccggcgugagcuggacgaugaagaucgggauuggcgugcuucugaccuggcucggacucaauucuagauccacaagccugucuaugaccuguaucgcugucggccuugugacacucuaccuggggguuauggugcaggccgauuccggaugcgucauuaacuggaaaggccgcgaacugaagugugggagcggaaucuucgugaccaaugagguucacacauggaccgaacaauauaaguuucaggcggacuccccuaaacggcucucugccgcuauuggcaaggccugggaggagggggugugcggcaucagaagcgcuacgcgccuggaaaacaucauguggaaacagauuuccaacgagcuuaaucauauccugcucgaaaacgacaugaaguucacagucgugguuggagauguggccggcauucuggcccaggggaaaaagaugauccggccgcaacccauggaguacaaauauucuuggaaaagcuggggaaaggcuaagauuaucggcgcggacguccagaauaccaccuuuaucauugaugggccuaacacacccgaauguccugacgaucagagagccuggaauaucugggagguggaggacuacggauucggcauuuuuaccacgaacaucuggcugaaacuucgcgauuccuauacacaggugugcgaccaccggcucaugagcgcugccauuaaagauucuaaggccguccacgcugacaugggcuacuggaucgaauccgagaaaaaugaaaccuggaagcuggccagagcgagcuucaucgagguuaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuuugaccucugcgaagggacgaccguggucgugaacgagcacugcggaaaucggggccccagccugagaacaaccacaguuaccggcaagaucauccacgaaugguguugccgguccuguacgcugccuccccuucgcuucagaggggaggauggaugcugguauggcauggagauucggccggugaaagaaaaggaggaaaaccucgucaagagcauggugucugccggguccggagagguugacagcuuuucccugggccugcucuguaucucuauuaugaucgaagaggugaugagaagccgccugucccggaaaaugcuuaugacagggacccuggccgucuucuuucuccugauuaugggacagcugacauggaaugaccuuaucagacugugcauuauggugggcgcuaacgccucugaucgcaugggcauggggaccaccuaccucgcgcugauggcuacauucaagaugagaccuauguuugccguuggacuccuguuccggcgccuuacgagcagagaggugcugcuccugaccaucggccugucccuugucgccucuguggaacugcccaauagccucgaggaacugggggacggacucgcuaugggcaucaugauucugaaacuucugacagauuuucaaucccaucagcucugggccacccugcugagccuuacauucaucaagaccacguuuucucugcaccaugcuuggaaaacaauggccaugauucucuccaucgugagccuguucccccucugucugucuaccaccucccagaagacaaccuggcuuccuguccugcuggggagccucggaugcaagccgcugacaauguuucuuauugcggagaacaaaaucuggggccggcgcucuuggccccugaacgaaggcaucauggccguugggauuguguccauccuccugagcucccuccugaagaaugacgugccucuugcuggaccccugauugccggcgggaugcugaucgcuuguuaugucauuagcggaucuagcgccgaucucucccuggagaaagccgcugaggugucuugggaagaggaagcggagcacagcggcgccucccauaacauccuuguugaagugcaggacgaugggacgaugaagaucaaagacgaggagagagaugacacccugacaauucuccugaaggcuacccuccuggccgucucuggaguguacccucuuagcauccccgccacacuguucguuugguauuucuggcagaagaagaagcagcgguccggcgugcugugggauaccccuucucccccggaagucgagcgcgcugugcucgacgauggcauuuacagaaucaugcagcgggggcugcuuggacgcagccaggucggcguggggguuuuucaagaaaauguguuccacacgauguggcacgucaccagaggagccgugcugauguaucagggcaaacggcucgagccuuccugggcgagcguuaagaaagaccugauuucuuacgggggaggcuggagacuccagggcuccuggaacacaggggaggaagugcaggucaucgcuguggagcccggaaagaauccuaaaaacgugcaaaccgcccccggcacauuuaagaccccggaaggggagguuggagccauugcucuggacuucaagccuggcacaagcgggucucccaucgucaaucgcgaaggaaaaaucgugggccuuuacggcaacgggguggucacgaccuccggaacauaugugagcgccauugcgcaggcuaaggccucccaggagggcccucugcccgagaucgaagaugagguuuuucggaaaagaaaucugaccauuauggaccuccaucccgggucuggaaagacccgccgguaccugccugccaucgugagagaagcuauuaaacgcaaacuucggacacugauccucgccccgacgagagucguggcuagcgagauggccgaagcgcugaagggcaugcccauccgcuaucaaaccacagccguuaaauccgagcacaccgggaaggagauuguggaucugaugugccaugcuacauucaccaugcggcuccuuagcccugucagagugcccaacuacaauaugaucauuauggacgaagcccacuuuacggauccuucuuccaucgcugcccggggcuauauuagcacacgcguuggaaugggcgaggccgcugcgaucuucaugaccgccacacccccugggucuguggaggcuuuuccgcagagcaacgccgucauccaggacgaggaaagagauauucccgagcgguccuggaacucuggauacgaguggaucacagacuucccuggcaaaaccgugugguuugugcccagcauuaaguccgggaacgauaucgccaauugucugcgcaaaaacggaaagagagucauucagcugucucggaagacauucgacaccgaauaucagaagacgaagaacaaugauugggacuacguugugacaaccgacaucagcgagaugggcgcuaacuucagagccgaucgcgugauugacccucggagaugccucaaacccgucauccugaaggaugggccggaacgcgugauccuugcgggcccuaugcccguuacaguggcuuccgccgcccagcggagaggacgcauuggccggaaucauaacaaagagggggaccaguacaucuauaugggacagccccugaauaacgaugaggaccacgcucacuggaccgaagccaagaugcuccuggauaauauuaacacgccugagggcaucauucccgcgcuguuugaaccugagagagaaaagagcgccgcuaucgacggggaguaccgccucagaggagaggcccggaaaucuuucgucgaacuuaugcgcagaggcgaucugccgguguggcuguccuauaagguugcuagcgagggguuucaauacuccgaccggcgcuggugcuucgauggcgaaagaaauaaccaggugcucgaggaaaauauggacgucgagaucuggaccaaagagggagaacggaagaaacugagaccccgcuggcuugaugcccggacauauucugacccucuggcucucagagaguuuaaggaguucgccgcgggccgccggagcguguccggggaccugauucuggagaucggaaaacucccccagcaucuuacccagagagcccaaaacgcucuggauaaucuggucaugcuccacaacucugaacagggcgggcgggccuaccgccaugcuauggaggagcugccugacacaauugaaacccuuaugcugcucgcccugaucgccgugcugacaggaggcguuacccucuuuuuccuuagcggcagagggcugggaaagacguccauuggccugcucugugugauggcuagcucugugcugcuuuggauggcguccgucgagccccacuggaucgccgcuagcaucauucuggaauuuuuccucaugguucugcugaucccggagccugaucggcagcgcacaccccaggacaaucaacucgccuauguggugauugggcuucuguuuaugauccugaccgucgccgcuaacgagaugggacuccuggaaaccacaaagaaagaucuuggcauugggcacguggccguugagaaccaucaccaugcggccaugcuggacguggaucuccacccugcuucugccuggacccuguacgcugucgccacaacgaucauuacccccaugaugagacauacaaucgaaaauaccacagcgaacaucucccugaccgccauugcuaaucaggccgcuauccucaugggacuugacaagggcuggccuauuagcaaaauggauaucggcgugccccugcuggcccucgggugcuacucucaggucaacccgcugacgcuuaccgcugccgugcugaugcucguugcgcacuaugccauuaucggaccuggccugcaagcuaaggccacacgggaggcucagaaacgcaccgccgccgggaucaugaagaaucccacaguggacggaauugucgcgaucgaucuggaccccgugguuuacgaugcuaaguucgaaaaacagcucggccagauuaugcuucugauccuguguaccagccaaauucuccugaugagaacgacaugggcccuuugcgaguccaucacccuggcuacagggccucucaccacccugugggagggaucuccgggcaaguuuuggaacacaacgaucgccgugagcauggccaauauuuuccggggcuccuaucuggcuggggccggacucgcguucagccuuaugaaaucccugggcgggggacgcagaggcaccggggcccagggagaaacacugggcgagaaguggaaacggcagcucaaccagcugucuaagagcgaauuuaauaccuacaagagauccggcaucauggaggucgaccgcucugaagcuaaagaggggcuuaagcggggagagacaaccaaacacgccgugagcagaggcacggcuaagcugcgcugguucguggaacggaaccucguuaaacccgaggggaaggucauugaccugggauguggcagagggggaugguccuauuacugcgccggccugaagaaagugacagaagugaagggcuauaccaaagggggaccuggccaugaggaacccaucccuauggcgaccuacggguggaaucucgucaaacuucacucuggaaaagauguguuuuucauucccccugagaagugugacacacugcugugcgauaucggcgagagcuccccgaaccccaccauugaagaggggcgcacacuccggguucugaaaaugguggaaccuuggcuuagaggaaaucaauuuuguaucaagauccugaaccccuacaugccuagcgucguggagacgcucgagcagaugcagcgccggcauggcggcaugcugguuagaaauccccugucucgcaacuccacccacgaaauguauugggugagcugcgggacaggaaauauugucucugccgugaacaugaccucccggaugcuccugaacagauucacaauggcucaccgcaagccgaccuacgagagagacguugaucuuggcgccgggacgcggcauguggcugucgaaccugagguggccaaucuggacaucauuggacagcgcaucgaaaacauuaaacacgagcauaagagcaccuggcacuaugaugaggacaaucccuacaaaacaugggcuuaucauggcucuuacgaagugaagcccuccgggagcgccuccagcauggucaacggaguugugaaacuccugaccaagccuugggaugugauccccauggucacacaaaucgcgaugaccgacacaaccccuuuuggccagcagagaguguucaaggagaaaguugauacgcggacaccgaaggccaaaagaggcaccgcucaaauuauggaagugaccgccaaguggcuuuggggguuucugucucggaauaaaaagccccgcaucuguacaagagaggaguucacgcggaagguccgcagcaacgcugccauuggagccguguuuguugacgagaaucaguggaacuccgcgaaagaggcuguggaagacgagagauucugggaucucguccaccgggaacgcgagcugcacaagcagggcaaaugcgcgaccugcguguauaauaugauggggaagagagagaagaagcugggagaguuuggcaaggccaaagggucucgggcuaucugguacauguggcucggcgcccgcuuccuggaguucgaagcucuuggauuuaugaacgaggaccauugguucagcagagaaaauucccugucuggcguugagggggagggacuccacaagcugggcuacauucuucgggauaucagcaaaaucccugggggaaacauguaugccgacgauacagcgggcugggacacccgcauuacagaagaugaccugcagaaugaggccagaaucaccgauauuauggaacccgagcaugcucuccuggccaaguccaucuuuaaacugacauaccaaaacaaggugguccgggugcagcgcccugcuaaaaaugggaccgucauggacgugauuucuagacgggaucagagaggcagcggacagguuggcacguaugggcucaacaccuucacaaacauggaagcccaacugauccgccagauggaguccgagggaaucuuuagccccucugaacuugagaccccgaaucuggcggaacgggugcucgacuggcuggagaaguacggcgucgaaagacuuaagcgcauggccauuuccggggaugacuguguggugaaaccuaucgacgaucgguucgcuacagcccugaccgcucucaacgacaugggaaagguuagaaaagauauuccccagugggagccuagcaagggcuggaaugacuggcagcaagugcccuuuugcucucaccacuuccaucagcugaucaugaaagaugggcgcgagauugucgugccuugucggaaccaggacgaacugguuggcagagcccgcgugucccagggagcuggcuggagccuccgggagacggccugccuggggaaguccuaugcgcaaauguggcagcuuauguacuuucacagacgcgaucugcggcucgccgcuaaugccaucuguucugccguccccguggacuggauuccgacaagcagaaccacaugguccauccaugcucaccaucaguggaugaccacggaagauaugcugagcgucuggaaccggguguggaucgaggaaaauccuuggauggaggacaagacccacauuucuuccuggggagauguucccuaucuuggcaaaagagaggaccaauggugcgggagccugaucggacucacagcccgcgcgaccugggcuacaaacauucagguggccaucaaucagguccggagacugauuggcaacgaaaauuaccuggacuacaugaccucuaugaagcgcuucaaaaacgagagcgaucccgaaggggcccucugguga

SEQ ID NO: 19375 - RNA, 9879 nt, Artificial Sequence
  derived and/or modified CDS sequence (opt5) from DENV-1__JQ045667__SS-prME
agcgugaccaugcugcucaugcugaugcccacggcccuugcuuuccaccugacgaccagaggaggggaaccucauaugauuguguccaagcaggaacggggaaaaucucuccuguuuaagacaagcgccggcguuaacaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccaacagcagauguccgacccaaggagaggcgacacugguugaagaacaagaugccaauuucgugugccggcgcaccuuuguggacagaggcuggggcaacggguguggacucuucggcaaagggucucugaucacaugcgcuaaguuuaagugcgucacgaaacuugagggaaagaucgugcaguacgaaaaucugaaauauuccguuauugugaccguccacacaggcgaucagcaucaaguggggaacgagagcaccgaacacggaacaaccgccacgaucacaccccaagcuccuaccaccgagauucagcucacagacuacggcgcccugacccuggacuguucuccccggacgggccucgauuucaaugaaaugguucugcuuacaaugaaggggaaauccuggcuggugcauaagcagugguuucucgaccugccucuucccuggaccagcggagccuccacaucucaagagaccuggaaccgccaggaucugcucgucaccuucaaaacagcucacgcgaagaagcaggagguggucgugcugggcagccaagaaggggccaugcacacggcucugaccggagccacagagauccagaccuccggcacaaccacgauuuuugccgggcaucucaaaugcagacugaagauggacaaacuuacacugaagggcaugagcuauguuauguguaccggaucuuucaaacucgaaaaggagguggcugaaacccagcacggcacaguccuggugcagaucaaguacgaggggaccgaugccccgugcaaaaucccuuucuccacacaagacgagaagggaguuacgcagaauggccggcugauuaccgcgaaccccaucgugacagauaaagaaaagccugucaauauugaggcugaaccgcccuuuggggagagcuauaucgugauuggagccggcgagaaagcccuuaagcucucuugguucaagaaagggagcuccaucggcaagauguuugaagcuaccgccagaggagcucgccggauggccauccugggcgacacagcgugggauuucgggucuauuggaggcguguuuaccagcguugggaaacugguccaucagaucuucggaacggccuacggcgugcucuuuuccggggugagcuggaccaugaagauuggcaucggaguccugcuuacauggcugggccucaacucuagauccaccagccugucuaugacauguauugcuguggggcugguuacccuuuaccucggagugaugguccaggccgacuccggcugcgugaucaauuggaaagggcgcgagcugaaguguggaagcggcauuuucguuacaaacgaagugcacaccuggacggagcaauauaaguuucaggcugauuccccuaaacggcugucugccgcgaucgggaaggccugggaagagggcgucugcggaaucagaagcgcuacacgccucgagaacauuauguggaaacagaucuccaaugaacugaaccauauucuucuggagaaugacaugaaguucaccgugguugugggcgacgucgccgggauccucgcucagggcaagaagaugauucggccgcaacccauggaauacaaauauucuuggaaaagcuggggcaaggccaagaucaucggggccgaugugcagaacaccacauuuauuaucgacggaccuaauacccccgaguguccugaugaccagagagcuuggaacauuugggaaguggaggauuacggcuucggcaucuuuacgacaaauauuuggcugaagcugcgcgacuccuauacccaggucugcgaucaccggcuuaugagcgcggccaucaaagacucuaaggcuguucacgccgauaugggguacuggaucgaguccgagaaaaaugagacauggaagcucgccagagcuagcuucauugaagugaagaccuguaucuggcccaaaucucauacacugugguccaauggagugcuggagagcgaaaugauuaucccgaagauuuauggcgggccuaucucucaacacaacuaccgccccggauacuucacccagacggccggcccuuggcaucucgggaaacuggagcuugacuuugaucugugcgagggaaccacagucgugguugacgaacacugcggcaaucggggccccagccucagaaccacaaccgugacggggaagaucauucacgagugguguugccgguccuguacacugccuccccugcgcuucagaggagaagauggcugcugguaugggauggagauccggccggucaaagagaaggaagagaaccuugucaagagcaugguuucugcgggauccggcgaaguggacagcuuuucccucgggcugcuguguauuucuaucaugauugaggaagucaugagaagccgcuggucccggaaaaugcucaugaccggaacacuggcuguguucuuucuucugaucaugggccagcucaccuggaaugaccugauuagacugugcaucaugguuggcgccaacgccucugaucgcauggggaugggaaccacauaccuugcucugauggccacguucaagaugagaccuauguuugcggugggccuccuguuccggcgccucaccagcagagagguccugcuucugacaaucgggcucucccugguggcuucuguggagcugcccaauagccuugaagaacugggagacggccucgccauggggauuaugauccugaaacuccugaccgauuuucaauccuaucagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuuggaagccugggcugcaagccgcugacgauguuucucauugcugaaaacaaaaucuggggccggcgcucuuggccccugaacgaggggaucauggccgugggaauugucuccauccuucugagcucccuccugaagaaugacgugccucucgcgggcccccugauugccgggggaaugcuuauggcuuguuauguuaucagcggcucuagcgccgaucugucccuggaaaaagcugccgaggugucuugggaggaagaggccgaacacagcggggcuucccauaacauucucgucgaggugcagggagacggcaccaugaagaucaaagaugaagagagagacgauacacugaccauccuucugaaggcgacacuccuggccguuucuggcguguacccucucagcauucccgcuacccuguucgucugguauuucuggcagaaaaagaagcagcgguccggggugcuuugggacacgccuucucccccggaggucggacgcgccgugcuggaugacggcaucuacagaauuaugcagcgggggcugcucggacgcagccagguuggcgugggggucuuucaagaaaauguguuccacaccauguggcauguuacaagaggagccgugcugauguaccagggcaaacggcuugagccuuccugggcuagcgucaagaaagaucugaucucuuauggcgggggauggagacuccagggcuccuggaacaccggggaagagguccaggugauugccguugagcccggaaagaauccuaaaaacguccaaacagcgcccggcaccuuuaagacaccggaaggggaggugggagcuaucgcccuggacuucaagccuggcacgagcggcucucccauugugaaucgcgaagggaaaaucgucggacucuacggcaacggggugguuaccacauccggaaccuaugugagcgccaucgcucaggccaaggcgucccaggagggcccucugcccgaaauugaggacgaggucuuucggaaaagaaaucuuaccaucauggaucugcaccccgggucuggcaagacacgccgguaccugccugcuauugugagagaagccaucaaacgcaagcuccggacgcugauucuugccccgaccagaguuguggcuagcgagauggccgaagcucugaagggaaugcccauccgcuaucaaacaaccgccgucaaauccgagcacacaggcaaggaaaucguggaccucaugugccaugcgaccuucacgaugcggcugcugagcccuguuagagugcccaacuacaauaugauuaucauggaugaggcccacuuuacagacccuucuuccauugcugcccggggguauaucagcacccgcgucggaaugggcgaggcugccgccauuuucaugaccgcuacacccccugggucuguggaagcguuuccgcagagcaacgccgugauccaggaugaggaaagagacauccccgagcgguccuggaacucuggauacgaauggauuaccgauuucccuggcaaaacagucugguuuguucccagcaucaaguccgggaacgacauugcuaauugucuccgcaaaaacggcaagagagugauccagcuuucucggaagaccuucgauacggaguaccagaaaaccaagaacaaugacugggauuauguggucaccacagacauuagcgagaugggagccaacuucagagccgaccgcgugaucgauccucggagaugccugaaacccguuauucugaaggacggcccggaacgcgugauccucgcugggccuaugcccgucaccguggccuccgcggcucagcggagaggacgcaucggccggaaucauaacaaagagggggaucaguacauuuauaugggacagccccugaauaacgacgaagaucacgcccauuggacggaggccaagaugcuucuggacaauaucaacaccccugagggcauuauccccgcucucuuugaaccugagagagaaaagagcgccgcgauugauggggaguaccgccugagaggcgaagcccggaaaacauucguugagcugaugcgcagaggagaccucccgguguggcuuucuuauaaggucgcuuccgagggcuuucaauacagcgaucggcgcuggugcuucgacggggaaagaaauaaccaggugcuggaggaaaauauggaugucgagaucuggaccaaagaaggagagcggaagaaacugagaccccgcuggcucgacgcccggacauauuccgauccucuggcucuuagagaguuuaaggaguucgccgcuggccgccggucugugagcggggaccugauccucgagauuggaaaacugccccagcaccugacccagagagcccaaaacgcgcucgacaaucuuguuaugcugcacaacuccgaacagggcggccgggccuaccgccaugcuauggaggaacugccugauacaaucgagacccucaugcugcuugcccugauugcugugcucacaggcggggugacacuguuuuuccugucugggagagggcucggaaagaccagcaucggccuucugugugucauggccuccagcguucugcucuggauggccucuguggagccccacuggauugcugcguccaucauccuggaauuuuuccuuauggugcugcucauuccggagccugaccggcagcgcacaccccaggauaaucaacuggccuacgucgugaucgggcugcucuuuaugauucuuacaguugcugccaacgaaaugggacugcuggagaccacaaagaaagaccucggcaucggccauguggccgucgagaaccaccaccaugcugccaugcuggauguggaccuucacccugcgagcgccuggacgcuguaugcugucgccaccacaauuaucacccccaugaugagacauacaauugaaaauaccacggcuaacaucucucucaccgccaucgcgaaucaggccgcuauucugauggggcuggauaagggauggccuaucuccaaaauggacauuggcgugccccuccuugcccuggggugcuacagccagguuaacccgcugacacucaccgcugccgugcugaugcuugucgcucacuaugccaucauuggaccuggccugcaagcgaaggccacacgggaggcucagaaacgcaccgccgcugggaucaugaagaaucccacgguggauggaaucguugccauugaccucgaucccguggucuacgacgccaaguucgaaaaacagcugggccagaucaugcugcucauucuuuguacaucucaaauccugcugaugagaaccacaugggcgcucugcgagagcauuacccuggcuaccggcccucuuacaacgcugugggaaggguccccgggaaaguuuuggaacaccacaaucgccgugucuauggcuaauaucuuccggggcagcuaucucgccggggccggacuggcuuucucccugaugaaaagccucggcgggggacgcagaggcaccggcgcccagggggagacacuuggagagaaguggaaacggcagcugaaccagcuguccaagucugaauuuaauauuuacaagagaagcggcaucauggagguggaucgcuccgaagcgaaagaggggcucaagcggggagaaaccacgaaacaugccguuucuagaggcacagcuaagcugcgcugguucgucgagcggaaccuugugaaacccgaggggaaggugauugaccugggauguggcagaggcggguggagcuauuacugcgccggacucaagaaagucaccgaaguuaagggcuacaccaaagggggaccuggccacgaggaacccaucccuauggcuacauauggguggaaucuggugaagcugcacuccggaaaagacguguuuuucauucccccugagaagugugauacccuccuuugcgacaucggcgaaucuagcccgaaccccacaauugaggagggccgcacgcugcggguccugaaaaugguggaaccuuggcucagagggaaucaauuuuguaucaagauccugaaccccuacaugccuuccguuguggagacccuugaacagaugcagcgcaagcauggaggcaugcugguccggaauccccucagcagaaacucuacacacgagauguauuggguguccugcgggaccggaaauauuguuagcgccgugaacaugacaucucgcaugcugcugaaccgguucaccauggcgcauagaaaaccgacguacgagcgcgaugucgaccucggcgccgggaccagacacguggcuguggaaccugaggucgccaaucuggauaucauuggacagcggaucgaaaacauuaagcacgagcauaaauccacauggcacuaugacgaagauaaucccuacaagaccugggcuuaucauggcagcuacgagguuaaacccucuggcuccgccagcuccauggugaacgggguggucaaacuucugacaaagccuugggacgugauccccaugguuacccaaaucgcuaugacagauaccacgccuuuuggacagcagcgcguguucaaagagaaggucgacacaagaaccccgaaagccaagcggggcaccauucaaaucauggaagugacagcgaaauggcucuggggguuucugagcagaaauaagaagccccggauuuguacgcgcgaggaguucaccagaaaaguucggucuaacgccgcuaucggagccguguuugucgaugagaaucaguggaacagcgcuaaggaagccguggaggacgagcgcuucugggaccuuguucacagagaacgggagcugcauaaacagggcaagugcgccacaugcguguacaauaugauggggaaacgcgaaaagaagcucggcgaguuuggaaaagcgaagggcuccagagcuauuugguauauguggcugggggcccgguuccuggaguucgaggcccucggauuuaugaacgaggaucacugguucucucgcgaaaauagccuguccggcgucgagggggaaggacuucacaaacugggcuacauccucagagacaucucuaagauuccugggggcaacauguaugcugaugacaccgccggaugggauacacggaucaccgaggacgaucugcagaaugaggcucgcauuacagacaucauggaacccgagcaugcccuucuggcgaaaagcauuuuuaagcucaccuaccaaaacaaaguggucagagugcagcggccugccaagaauggcacgguuauggaugugaucucccgcagagaccagcgggggucuggacaggucggcaccuaugggcugaacacauucaccaacauggaagcucaacugaucagacagauggagagcgaaggaaucuuuucccccagcgagcucgagacaccgaaucuggccgaacgcgugcuugauuggcuggagaaguacggcguggaacggcucaaaagaauggcuaucucuggggacgauuguguugugaagccuauugacgaccgcuucgccaccgcgcugacggcccuuaacgauaugggcaaaguccggaaggacaucccccagugggagccuuccaaaggauggaaugauuggcagcaagugcccuuuugcagccaccauuuccaccagcugauuaugaaggacggcagagaaaucguugugccuugucgcaaccaggaugagcucgucgggcgggcuagagugucucagggagccggcuggucccugcgcgagacagcuugccugggaaagagcuaugcccaaauguggcagcucauguacuuucaccggagagaccugcgccuugcugccaaugcgauuuguuccgccguccccguggauuggaucccgaccucucggacaaccuggagcauccaugcucaccaucaguggaugacgaccgaagacaugcuguccguuuggaacagaguguggauugaggaaaauccuuggauggaggauaaaacacacaucagcucuuggggagacguccccuaccucggcaagcgggaagaucaauggugcgggucccugauuggccuuaccgccagagccacaugggcuaccaacauccagguggccauuaaucagguucgccggcugaucggaaacgagaauuaucucgacuacaugacaagcaugaaaagauucaagaacgagucugaccccgaaggcgcgcugugguga

SEQ ID NO: 19376 - RNA, 9879 nt, Artificial Sequence
  derived and/or modified CDS sequence (opt5) from DENV-1__KU094071__SS-prME
agcgugaccaugcugcugaugcugcuucccaccgcccuggcuuuccaccucacgacccggggaggggaaccucauaugauugucuccaagcaggaacggggaaagucucugcuuuuuaagaccagcgccggcguuaacaugugcacccugauugcgauggaccucggggaacugugugaagauacaaugaccuacaagugcccccgcaucacaaaggcugagcccgacgauguggacuguuggugcaaugccaccgauacgugggugaccuauggaacauguucccaaaccggcgaacaccggcgggacaagcgcucugucgcccuggcuccucauguggggcucggacuggagacaagagccgagaccuggaugagcuccgaaggcgcuuggaagcagauucagaagguugagacgugggcccuucggcaccccggcuucacagugaucgcgcuguuucucgcccaugcuauugggaccucuaucacacagaagggaaucauuuucauccugcuuaugcuggucaccccuagcauggccaugcgcugcgugggcauugggaacagagauuuuguugaaggacucuccggcgggaccuggguggacgucgugcuggagcacggaagcugugugacaacgauggcuaaggauaagcccacccuggacaucgagcuccugaagacagaagucaccaauccugccguucuucggaaacugugcauugaggcgaagaucucuaacacaaccacggauucccgcuguccgacacaaggcgaagccacccucguggaggaacaggacgcuaauuucgugugcagacggaccuuugucgaucgcggcugggggaacggauguggccuguucgggaagggaagccuuauuacaugcgccaaauuuaagugcgugaccaaacuggagggcaagaucguucaguacgagaaucucaaauauucugugaucgucacagugcacacgggggaccagcaucaaguuggaaacgaaaccacagagcacggcaccauugcuacaaucacaccccaggccccuacguccgaaauucagcugaccgacuacggcgcccugacacucgauuguagccccagaaccgggcuggacuucaaugagauggugcuucugacaaugaagcggaaaucuuggcucguccauaagcagugguuucuggaucuuccucugcccuggaccuccggagcuagcacgccgcaagaaacauggaaccgcgaggaccuccuggugaccuucaagacagcgcacgccaaaaagcaggaggucgugguucugggcucccaggaaggggcuaugcacaccgcccucaccggagccacagagauccaaacgucuggcaccacaaaaauuuuugcugggcaucugaagugcagacuuaaaauggauaagcugacccucaagggcaugagcuaugugauguguacaggauccuucaaacuggaaaaggaggucgccgaaacccagcacggcacggugcugguucaggugaaauacgaggggacagacgcgccuugcaagauccccuucagcacccaggaugagaaaggagucacccaaaauggccggcuuaucacagcuaacccuauugugaccgacaaggaaaagcccgugaauaucgaggccgaacccccuuuuggggagucuuauauuguugucggagccggcgagaaagcucucaagcuguccugguucaaaaaggggagcucuaucggcaaaaugcuggaagccacagcuagaggagcccgccggauggcgauucucggcgauacggccugggacuuugggagcaucggaggcguguucaccuccguggggaagcugguccaucagaucuuuggaacagcuuacggcgugcuuuucucugggguuagcuggaccaugaagauuggcaucggcauucugcucacauggcugggccugaacuccagaagcgccucucuuuccaugaccuguaucgcuguggggauggucacgcucuaccugggagugaugguucaggccgauagcggcugcgugauuaauuggaaagggcgcgagcugaaguguggaucuggcaucuuugucaccaacgaagugcacacauggaccgagcaguauaaauuccgggcggacuccccgaagagacucagcgccgcuauugggaaagccugggaagagggcguuugcggaauccgcuccgcuacacggcuggagaacaucauguggaagcaaauuucuaaugaacuuaaccauauccugcucgagaaugacaugaaauuuaccguggucgugggcgaugugagcgggauucugacacagggaagaaagaugaucggcccccagccuauggaacacaaguacuccuggaaaucuugggggaaggccaaaauuaucggagccgacguccagaacaccacguucaucauugauggccccaauacaccugagugucccgacgaucaacgcgcuuggaacaucugggaaguugaggacuauggcuuugggauuuucaccaccaauaucuggcugaaacuucgggauagcuacacacaggugugcgacccgagacucauguccgcggccauuaaagauagcaaggcugugcacgccgacaugggauauuggaucgagucugaaaagaacgagaccuggcgccuggcccgggcuuccuuuaucgaagucaaaacguguguguggccuaagagccauacacuguggucuaauggcguucucgaguccgaaaugauuauccccaaaauuuacgggggaccuaucagccagcacaacuauagacccggcuacucuacccagacagccgggccuuggcaucugggaaaacuugagcuggauuucgaccucugcgagggcaccacaguggucguggaugaacacugcggcaaucgggggcccagccugcgcaccacgaccguuacaggaaaaauuauccacgagugguguugcagauccuguacccugccgccucuucgguucaagggcgaagacgggugcugguacggaauggagaucagacccgugaaggacaaagaggaaaaccucgucaagagccuggugucugcgggcuccggggagguugauagcuuuucccugggacuccugugugugucuauuaugaucgaagaggucaugcgcagccggugguccagaaaaaugcuuaugacaggcacccuggcuguguuccuccugcugauuaugggccaacuuacguggaaugaccugauccgccucugcauuauggugggggccaacgccucugauagaaugggaaugggcacaaccuaucuggcucucaucgccacauuuaagaugcggcccauguucgcggucgggcugcuuuuucgcagacugaccagccgggaaguucuccugcugaccauuggacuuucccugguggcuucuguggagcucccuaauagccuggaggaacucggcgacgggcuggccaugggaaucaugauccuuaaacugcucacagauuuccagucccaucagcugugggccgcucugcuuagccugacguuuauuaagaccacauucucucuccacuacgccuggaagaccauggcuaugguccuguccacagugagccucuuuccgcugugucuuucuaccacgucccgcaaaacaaccuggcugcccguucugcucggcagccugggcugcaagccucuuaccauguuccugaucgccgagaacaaaauuugggggagaaagucuuggccccucaacgaaggaaucauggcggugggcauugucuccauccugcucagcucccugcuuaaaaaugacgugccucuggccgggccccugaucgcuggaggcaugcucauugccuguuauguuaucagcgggucuagcgcugaucugucccuugagaaggccgccgaagugucuugggaggaggaagcugagcauagcggagcgucccacaacauucuggucgaagugcaagacgauggcacaaugaaaaucaaggacgaggaacgggaugacacccucacaauucugcucaaggccacgcugcuugcugucucuggcguguacccuaucagcauccccgccacccuguuuguuugguauuuccgccagaaaaagaaacagagauccggggugcugugggauacaccgucuccucccgaggucgagcgggccgugcucgacgacggaauuuaccgcauccugcagagaggccuucuggggcggagccaaguuggagugggcgucuuucaggaagggguguuccauaccauguggcacgugacaagaggagcuguucucauguaucagggcaagcgccuggagccuuccugggccagcgucaaaaaggaucucauuucuuacggcgggggauggcgguuccagggcuccuggaauaccggggaagaggugcaagugaucgcggucgagcccggaaagaacccgaaaaaugugcagacggcuccuggcaccuuuaagacacccgaaggggagguuggagugauugcccuggacuucaaaccuggcaccagcggcucucccaucgucaacagagaagggaagauugugggacuuuacggcaaugggguugugacaaccuccggaacauaugucagcgccaucgcucaggccaaagcgucccaggagggcccccugccugaaaucgaggaugagguguuucgcaagcggaaccugacgauuauggaccuccacccggggucuggcaagaccagacgcuaccugcccgcuaucguucgggaagccauuaaaagaaaacuucgcacacugauccucgccccuacccggguggucgcuagcgagauggccgaagcucugaaaggaaugcccauuagauaucaaaccacagccgugaaguccgagcauacgggccgggaaaucguggaucugaugugccacgcgaccuucacaaugcgccuccuuagcccugucagaguucccaauuacaacaugaucauuauggacgaggcccauuuuaccgauccugcuucuaucgccgcucggggguauauuuccacacgcgugggaaugggcgaggccgccgcuaucuucaugaccgcgacgccgcccgggagcguggaagccuuuccucagucuaaugcugucauucaggacgaggaaagagauauccccgagcggagcuggaacuccggauacgacuggaucacagauuucccuggcaaaaccgugugguuuguucccucuauuaagagcgggaaugacaucgccaacugucugagaaagaauggcaaacgcgugauucaacugucccggaagaccuucgacacagaauaucagaaaaccaagaacaacgauugggacuacgucgugacaaccgauaucucugagaugggagccaauuuuagagcugaccgcguuauugauccgcggagaugcagcaaaccugugauccucaaggacggccccgagcgcgucauucuggccgggcccaugccugugacggucgcguccgcugcccagcggagaggacgcaucggcagaaaccagaauaaggaaggggaucaauacaucuauaugggacagccccuuaacaaugacgaggaucacgcccauuggacagaagcuaaaaugcugcucgacaacauuaauaccccugagggcaucauuccggcccuguucgagcccgaacggggaaagagcgcggccaucgauggcgaguaccgccugagaggagaagcucggaaaacauucguggagcucaugcgcagaggcgaccuuccuguuuggcugucuuauaagguggccuccgaaggguuucaguacagcgaucggaaauggugcuucgacggagagagaaacaaucaggugcuggaggaaaacauggacgucgagauuuggaccaaggaaggcgagcgcaaaaagcuccggcccagauggcuggaugcucgcacguauuccgacccucaagcccuucgggaauuuaaggaguucgcugccgggagacggucuguuagcggagaucugauccucgagaucggcaaacugccccagcaccugacccagcgcgcgcagaaugcccucgacaaccuugugaugcugcacaauuccgaacaaggcgggaaggcuuacagacaugccauggaggaacugccggauacaauugagacccucaugcugcuugcucugaucgccgugcucacaggaggcgucacccuguuuuuccugucugggcggggacucggcaaaacaagcauugggcuucugugugugauggccuccagcguucugcucuggguggcuucugucgaaccucacuggaucgcggccuccauuauccuggaguuuuuccuuauggugcugcucauccccgagccugaccgccagagaacaccccaggauaaccagcuggcuuaugucgugauuggacugcucuuuaugauccuuacgguugccgccaaugaaaugggccugcuggagacaaccaagaaagaccucggcauugggcauguggcugucgaaaaccaccaccaugccaccaugcuggauguggaccuucggccugcgagcgccuggacacuguacgcuguugccaccacaaucauuacgcccaugaugcgccacaccaucgagaacacaaccgcuaauauuucucucacagccaucgcgaaccaagccgcuauccugaugggacuggauaagggcuggccgauuuccaagauggacaucggggugccucuccuugcccugggaugcuacagccaggucaauccgcccacccugauugcugccgugcucaugcugguggcucauuaugccaucauuggcccugggcuucaggcgaaagccacgagagaggcucaaaagcggaccgccgcuggaaucaugaaaaacccgacaguugauggcaucgucgccauugaccuggaccccgugguguacgaugccaaguucgaaaaacagcucggccagaucaugcugcugauucucuguaccucucagauccuuagcaugcgcacaaccugggcgcugugcgaguccauuacgcuggcuacagggccucucaccacacugugggaaggaucucccggcaaguuuuggaauaccaccaucgccgucagcauggcuaacaucuucagaggguccuaucuugccggagccggccuggcuuuuccucucaugaaaagccucgggggcgggcggagaggcacaggggcccaaggagagacgcugggcgaaaaauggaagcgccagcucaaucagcuuuccaaaucugaguucaacaccuacaagcggagcgggauuauggagguugacagauccgaagcgaaagagggacugaagcgcggcgaaacaaccaagcacgccgugucucgggggacagcuaaacugagaugguucguggagcgcaaucucgucaagcccgaaggaaaagugaucgaucugggcuguggcagagggggauggagcuauuacugcgccggccuuaagaaaguuaccgaggugaagggguauacgaaaggaggcccugggcaugaggaaccgauucccauggcuacauacggauggaaccuggucaagcuccacuccggcaaggacguguuuuucaccccucccgagaaaugugauacccugcugugcgacaucggcgaaucuagcccuaaucccacaauugaggaagggagaacccuccgcguucuuaagaugguggagccguggcugcggggaaaccaguuuuguaucaaaauucugaauccuuacaugcccuccgucguggagacacucgaacaaaugcagagaaagcacggcgggaugcuggugcgcaacccccuuagcagaaauucuacgcaugagauguauugggucuccugcggaaccggcaacaucguuagcgccgugaauaugacaucuagaaugcugcucaaccgcuucaccauggcgcacagaaaaccuacauacgaacgggauguggaccugggggccggaacccgccaugucgcuguggagcccgagguugccaaccuggauaucauuggccagagaaucgaaaauauuaagaacgagcacaaguccacguggcacuaugacgaagauaauccuuacaaaaccugggcuuaucauggcagcuacgaggugaagccgucuggguccgccagcuccauggucaacggagugguucggcuccugacaaaacccugggacgugaucccuauggucacccagauugcuaugacagacaccacacccuuuggccaacagagaguguucaaggaaaaaguugauacccggacgccuaaggccaagcgcgggacagcgcagaucauggaggugaccgccagauggcuuuggggauuucugagccggaauaaaaagccccgcaucuguaccagagaggaguucacacggaaaguccgcucuaacgcugccauuggcgcuguguuugucgacgagaaucaauggaacagcgccaaggaagccguggaggaugaaagauucugggaccucguucaccgggagcgcgagcugcauaaacaggggaagugcgcgacgugcguguauaauaugaugggcaagagagagaagaaacuuggagaguuuggcaaagcuaaggggucccgggccaucugguacauguggcugggagcccgcuuccucgaauuugaggcucugggcuucaugaacgaagaucacugguucucuagagagaauagccuguccggggucgagggagaaggccuccauaaacugggguacauucuucgggacaucucuaagauuccgggcggaaacauguaugccgaugacaccgcuggcugggauacacgcaucaccgaggacgaucugcagaaugaagccaaaaucacagacauuauggagccugagcacgcgcuccuggccaccagcaucuuuaaacuuacauaccagaacaagguggugagaguucaacggcccgcuaaaaaugggaccgugauggaugucauuuccagacgcgaccagcggggaucuggccagguggggacguauggacugaacaccuucacaaacauggaaguucagcucaucagacaaauggagagcgaaggcaucuuuuccccuagcgagcuggaaacccccaaucuggccgagcgcgugcucgacuggcuggagaagcacggggucgaacggcuuaaaagaauggcuaucucuggcgaugacuguguggucaagccuacagaugaccgcuucgccaccgcgcugacggcccucaacgauaugggaaaagugcggaaggacaucccccagugggagccguccaagggcuggaaugauuggcagcagguuccuuuuugcagccaucacuuccaucaacugauuaugaaagacgggagagaaaucgugguccccugucgcaaccaggaugagcuugugggacgggcuagaguuucucagggcgccggguggucccugcgcgaaacagcuugccucggaaagagcuacgcccagauguggcaacugauguauuuucaccggagagaccugcggcucgcugccaaugcgauuuguuccgccgugcccaucgauugggucccuaccucuagaacaaccuggagcauucacgcucaucaccaguggaugacgaccgaggacaugcuguccguguggaaccgcguguggaucgaggaaaauccguggauggaggacaaaacacauguuagcucuugggaagauguccccuaccuuggcaagcgggaggaccaguggugcgggucccugauuggccucaccgccagagccacaugggcuaccaacauccaaguggccaucaaucaggugcgcagacugauuggaaacgaaaauuaucuugauuacaugacaagcaugaaacgguucaaggacgagucugaucuggagggcgcgcucugguga

SEQ ID NO: 19377 - RNA, 9879 nt, Artificial Sequence
  derived and/or modified CDS sequence (opt5) from DENV-1__HQ624983__SS-prME
uccgugaccaugcugcucaugcugguccccaccgcccuugcuuuccaccugacgaccagaggcggggaaccucauaugaucguuuccaagcaggaacggggaaaaucucuccuguuuaagacaagcgccggcgugaacaugugcacccuuauugcgauggaccugggggaguucugugaagauacaaugaccuacaaaugcccgcgcaucuccgaagcugaacccgacgauguggacuguuggugcaaugccacagauaccugggucacguauggaaccuguucucaaacaggcgagcacagacgggacaagcgcagcguggcccucgcuccucauguugggcugggacuggagaccagaacagaaaccuggauguccucugagggcgccuggaaacagauucagcggguggaaacgugggcucuccgccaccccggcuuuacagucaucgcccuguuccuugcgcaugccauugggaccagcaucacacagaagggaaucauuuuuauccugcucaugcuggugaccccuuccauggcuaugagaugcguuggcauugggagccgggauuucguggagggacuuucuggcgccaccugggucgacguggugcuggagcacggguccugugucacaacgauggcuaaggauaaacccacccucgacaucgaacugcugaagacagagguuaccaacccugccgugcuccgcaaacugugcauugaagcgaagaucagcaauacaaccacggauucuagauguccgacacaaggagaggccacccuuguggaagaacaagacgcuaacuuugucugccggcgcaccuucguggauagaggcuggggcaauggguguggacuguuuggcaaagggucccucauuacaugcgccaaguucaagugcguuaccaaacuggagggaaagaucgugcaguacgaaaaccuuaaauauagcgucaucgugacaguucacacgggcgaccagcaucaaguggggaaugagucuaccgaacacggaacaaccgcuacaauuacaccccaggccccuuccacggagauccagcugaccgacuacggcgcccucacacuggauuguagcccccggaccggccuggacuuuaacgaaaugguccuccugacaaugaaggagaaauccuggcuugugcauaagcagugguuccuggaucucccucugcccuggaccucuggggcuagcacgucccaagagacauggaaucgccaggaccuucuggucaccuuuaaaacagcgcacgccaagaagcaggaagugguugugcucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugucauguguaccggcagcuucaaacuggagaaggaaguggccgagacgcagcacggaacaguucucgugcagauuaaguacgagggcaccgacgcgccgugcaaaaucccuuuuucuacccaagaugaaaagggggucacacagaacggacggcugaucaccgcuaaucccauugugacagacaaagagaagccugugaacaucgaagccgagccgcccuucggcgagagcuauauuguuaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggagucuucacaagcgugggcaaacuggugcaucagauuuuugggaccgcuuacggaguccuguucucuggcguguccuggacaaugaagaucgggauuggcguucuccugaccuggcuuggacugaauagcagaucuacgucccucagcaugaccuguaucgccgugggccuggucacacuguaccuuggggugaugguucaggcugauuccggaugcgugauuaacuggaaaggccgcgaacucaagugugggucuggaaucuuugucaccaaugaggugcacacauggaccgaacaauauaaguuccaggccgacagcccuaaacggcuguccgcggccauuggcaaggcuugggaggaggggguuugcggcaucagaucugccacacgccuggaaaacaucauguggaaacagauuagcaacgagcucaaucauauccugcuugaaaacgacaugaaguuuaccguggucgugggagauguggcuggcauucuggcccaggggaaaaagaugauccggccgcaacccauggaguacaaauauuccuggaaaagcuggggaaaggccaagauuaucggcgcugacguccagaauacgacauucaucauugaugggccuaacacccccgaauguccugacgaucagagagcguggaauaucugggagguugaggacuacggauuuggcauuuucaccacaaacaucuggcucaagcugcgcgauucuuauacccaggugugcgaccaccggcugauguccgccgcuauuaaagauagcaaggccgugcacgccgacaugggcuacuggaucgaaucugagaaaaaugaaacguggaaacuugcuagagccuccuucaucgaggucaagacauguauuuggcccaaaagccauacccucuggucuaacggggugcuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccguuguggucgaugagcacugcggaaaccggggccccagccugagaacgaccacagugaccggcaagaucauccacgaaugguguugccggucuuguacacucccuccccugcgcuuuaaaggggaggacggaugcugguauggcauggagauuagaccgguuaaggaaaaggaggaaaaucuggugaaauccauggucagcgcuggguccggagagguggacucuuucagccuuggccuccuguguaucuccauuaugaucgaagagguuaugcggucuagauggagccgcaagaugcugaugaccgggacgcucgccguguuuuuccugcuuauuaugggacagcugacauggaacgaucucauccggcugugcauuauggucggcgccaaugcuuccgacagaaugggcauggggaugaccuaccuggcccuuauggcgacauuuaaaaugcgcccuauguucgcugugggacugcucuuuagacggcugaccucucgcgaggugcuccugcuuaccaucggccugagccucgucgccuccguugaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuauggugcugucuauugugucccuuuuuccccugugucucagcaccacgucucagaagacaaccuggcugccuguccuccuggggucccuuggaugcaaaccgcugaccauguuccugaucgccgagaauaagauuuggggcagaaaaagcuggccccucaacgaaggcaucauggcgguggggaucguuuccauucugcuuagcucucugcucaagaacgaugugccucuggccggaccccucaucgcuggcgggaugcugauugccuguuacgucaucagcggauccucugcugaccuuagccuggagaaagccgccgagguguccugggaagaggaagcugagcauucuggcgcgagccacaauauucugguugaagugcaggaugacgggacaaugaagaucaaagaugaggagcgggacgauacccucacaauccugcuuaaggccacgcugcucgcugucuccggaguguauccucugucuauucccgccacccucuucgucugguacuuuuggcaaaagaaaaagcagcgcagcggcgugcugugggacacaccuagcccucccgaaguugagagagccgugcuugaugacggcaucuaucggauuaugcagcgcgggcugcugggaagaagccaggucggcguggggguuuuccaagaaaacguguuucauaccauguggcacgucacacggggagcugugcucauguaccagggcaaacgccuggagcccucuugggccuccgugaagaaagaccuuaucagcuacgggggaggcuggagacugcagggcucuuggaauaccggggaggaaguucaggucauugcgguggagcccggaaagaacccuaagaaugugcaaacggcucccggcaccuucaaaacauccgaaggggaggucggagccaucgcccucgauuuuaagccgggcaccagcggguccccuauugugaaccgggaaggaaaaaucguuggccuguauggcaaugggguggucacaaccucuggaacauacgugagcgcuaucgcccaggcgaaggcuucccaggagggcccccucccugagauugaagacgagguuuucagaaaacgcaaccugacgaucauggaucuucaccccgggagcggaaagacccggagauaucugcccgccauugugcgcgaagccaucaagcggaaacugagaacacucauucuggcuccuacccgcgucguggccucugagauggcugaagcccuuaagggcaugccgauccgguaccaaaccacagcgguuaaauccgagcauacggggaaggagaucguggaccugaugugccacgccaccuuuacaaugagacuccugagccccguccgcgugccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucugucgaagccuucccucagagcaaugcuguuauccaggaugaggaacgggacaucccggagcgcuccuggaacucuggauaugaguggauuacagauuuucccggcaaaaccgugugguucgugccuagcaucaaguccgggaaugacauugccaacugucugagaaagaauggaaaacgggucauccagcucagccgcaagaccuucgauacagaauaccagaagaccaagaacaacgacugggacuacgugguuacaaccgauauuucugagaugggcgccaauuuuagagcugaccgggugaucgaucccagacgcugccuuaaaccugucauucugaaggacgggcccgaacgggugauccuggccggcccgaugccuguuacgguggcguccgcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaagagcgcggccauugauggggaguaucggcucagaggagaggcucgcaaaacauuugucgaacugaugagacggggcgaccugccuguguggcucuccuacaaggucgccucugagggguuccaauauagcgaucgcagauggugcuuugacggcgaacggaacaaucaggugcuugaggaaaacauggauguugagaucuggaccaaagagggagaacgcaagaaacugagaccgcgguggcuggacgcuagaacguacuccgacccccucgcccugcgcgaguucaaggaauuugcugccggccggagaucugugagcggggaucuuauccuggagauuggaaagcucccucagcaccugacccagcgcgcgcaaaaugcccuggacaaccucgugaugcuucauaauuccgaacagggcgggcgggcuuauagacacgccauggaggagcugcccgauacaaucgaaacccugaugcuccuggcucuuauugccguccugacaggaggcguuacccucuucuuucugagcggccgggggcugggaaaaacaucuaucggccuccuuugugugauggccuccagcgugcugcuguggauggcuucugucgagccucauuggauugcggccuccaucauccucgaguucuuucugauggugcuucugauucccgagccggaccgccagagaaccccucaggauaaccaacucgcuuacguugugaucgggcugcuguucaugauucucacggucgccgccaaugagaugggacuucuggaaacaaccaagaaagaccugggcaucgggcacguggcugucgagaaccaccaucacgccgcgaugcucgauguggaccugcaucccgccagcgcuuggacccuuuacgccguugcuacaaccauuaucacaccuaugaugcggcacacgauugaaaacaccacagccaauaucucucugaccgcgaucgccaaccaggcugccauucucaugggacuggauaagggcuggcccaucagcaaaauggacauuggcgugccucugcucgcucuugggugcuauucccaggucaauccccugacacugaccgccgcugugcucaugcugguugcccauuacgcgaucauuggaccgggccuucaagccaaggcuacgcgcgaggcccagaagagaaccgcugccgggaucaugaaaaacccuacaguggauggaaucgucgccauugaccuggaucccgugguguaugacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcuguuagcauggccaacaucuuccgcggcuccuaccuggccggggcuggacucgccuuuucucugaugaaaagccugggcgggggaagacggggcacaggggcgcagggagaaacgcucggcgagaaguggaagcgccagcuuaaucaccuguccaaaucugaguucaacaccuauaagagaagcggcauuauggaggucgaccgguccgaagccaaagaggggcugaagagaggagagacaaccaaacacgcugugucucgcggcacagccaagcuccggugguuuguggaaagaaaucuggucaagccggaggggaaaguuaucgaucuuggauguggccgcgggggauggagcuacuauugcgcuggccugaagaaagugaccgaagugaagggcuacacgaaagggggacccggccaugaggaaccuauucccauggccacauacggguggaaccucgucaagcugcacuccggaaaagacguguucuuuguuccucccgagaagugugauacccugcucugcgacaucggcgagagcucuccuaauccgaccauugaagaggggcggacacuuagagugcugaagauggucgaacccuggcugcgcggaaaccaguucuguaucaaaauucucaauccuuauaugcccuccgugguugagacccuggagcaaaugcagcggaagcauggcggcaugcuugugagaaacccucugagccgcaauucuacacacgaaauguacugggucuccugcgggacgggaaacaucgugagcgcggugaauaugaccucucggaugcuccugaacagauuuacaauggcccaccgcaaacccaccuaugagcgggaugucgaccugggcgcugggacaagacauguugccguggaaccggagguggcuaaccucgauaucauuggacagcgcaucgaaaauauuaagcacgagcauaaauccaccuggcacuacgacgaggauaacccuuauaagacgugggccuaccauggcagcuaugaagucaagcccuccgggagcgcuucuagcauggugaauggaguugugaaacugcuuaccaagcccugggacgucaucccuauggugacacagauugccaugaccgauacaacccccuucggccaacagagaguuuuuaaagagaagguggacacacggaccccuaaagcgaagcgcggcacggcccagaucauggaagucacagcuaaguggcuguggggguuccucuccagaaacaaaaagccgcggaucuguaccagagaggaauuuacccggaaagugcgcucuaaugccgcuauuggagccguuuucguggacgagaaccaauggaauagcgccaaggaggcggucgaagaugagagauuuugggaccuggugcaccgggaacgcgagcuucacaaacagggcaagugcgcuacaugcgucuacaacaugauggggaagagagagaagaagcugggagaguucggcaaagccaaggggucccgggccaucugguacauguggcucggcgcucgcuuccuggaguuugaagcccugggauucaugaaugaggaucauugguuuucuagagaaaacagccucuccggcguggagggggagggacugcacaaacuuggcuauauucugcgggacaucucuaagauuagcgggggaaauauguacgcugaugacacggccggcugggauacccgcaucacagaagacgaucuccagaacgaggcgaaaaucaccgacauuauggaacccgagcaugcccugcuugcuaauuccaucuucaagcugacauaucagaacaagguugugagaguccaacggccugccaaaaaugggaccgugauggaugugauuagccgcagagaccagcggggcucuggacagguuggcacauacgggcucaacaccuuuacgaacauggaagcucagcugauccgccaaauggaguccgagggaauuuucagccccucugaacuggagaccccuaaucucgccgaaagagugcuggauuggcuugagaaguauggcgucgaacggcugaaaagaauggcgaucuccggggacgacugugugguuaagcccaucgaugaccgcuuugccacagcucucaccgcccugaacgauaugggaaaagugcggaaggacauuccgcagugggagccuagcaagggcuggaaugauuggcagcagguccccuucugcucccaccacuuucaucaacuuaucaugaaagacgggagagagauuguggucccuugucgcaaccaggaugaacuggugggccgggcuagaguuucucagggagccggcuggagccuccgcgagacagcuugccuggggaaguccuacgcccagauguggcaacugauguauuuccaccggagagaccuccgccuggcggccaaugcuaucuguagcgccgugcccgucgauugggugccuaccucucggacgacaugguccauucaugcccaccaucaguggaugaccgcugaagacaugcuuagcguuuggaacagaguguggaucgaggaaaaucccuggauggaggauaaaacacacauuucuagcugggaggacgucccguaccugggaaagcgcgaagaccaguggugcggcucccucaucgggcugaccgcccgggcgacgugggcuaccaacauccaaguggccauuaaucaggugagacggcuuaucggaaacgagaauuaccuggauuauaugacaucuaugaaaagauuuaagaacgaaagcgacccugagggcgcccucugguga

SEQ ID NO: 19378 - RNA, 9879 nt, Artificial Sequence
  derived and/or modified CDS sequence (opt5) from DENV-1__FJ384655__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggcaaagccugggaggagggggugugcggcauccggucugcuacaagacuggaaaauauuauguggaagcagaucagcaacgagcuuaaucauauccugcucgaaaacgacaugaaauucaccgucguggugggagacgccaauggcauucuggcucaggggaagaaaaugauccgcccgcaacccauggagcacaaguacuccuggaagucuuggggaaaagccaagauuaucggcgccgauauucagaacaccacauuuaucaucgacgggccugauacccccgaauguccugacgagcagcgggcuuggaauauuugggaggucgaagauuauggauucggcaucuuuacgacaaacauuuggcugaaacuuagagacagcuacacccagaugugcgaucaccgccucauguccgcggccaucaaggacagcaaagcuguucaugccgauaugggcuauuggauugagucugaaaagaaugagacauggaagcuggcccgggcuuccuucaucgaagugaaaaccuguaucuggcccaagagccacacacuguggucuaacggggugcucgaguccgagaugauuaucccgaaaauuuacggaggcccuaucagccaacauaauuauagacccggguacuucacccagacggccggaccuuggcaccugggcaagcuugaacuggacuuugaucucugcgaggggaccacagucgugguugacgaacacugcggaaaccgcggccccucucugcggaccacaaccgugacgggcaaaauuauccaugagugguguugcagaagcuguacacugccuccccuucgguuccgcggggaggauggaugcugguacggcauggaaaucagaccggucaaggagaaggaagagaaucucgugcgguccaugguuagcgcggggucuggagaaguggacuccuuuagccugggcauucugugugucuccaucaugauugaggaggugaugagaucucgcuggagccggaaaaugcucaugaccgggacacuggcuguuuuccuucugcucaucaugggacagcugaccuggaacgaccugauuagacuuugcaucauggugggcgccaaugccuccgauaagaugggcauggggaccacauaucuggcucucauggccacguuuaaaaugcgcccuauguucgcggucggacugcucuuuagacggcuggcuucucgcgaagugcuucugcucaccauuggccugagccugguggccuccgucgagcuucccaacucucuggaagagcucggggacggacuggccaugggcaucaugaugcucaagcugcuuacagaauuccaaccccaccaucuguggaccacacuccugagccugaccuuuaucaaaacgacacuuucccuggauuacgcuuggaagaccaccgccaugguucucagcauugugucucuguucccucucugucuguccacaaccagccagaagacaacguggcuuccggugcugcuggggucuuuuggaugcaaaccccucaccauguuccugaucacagagaacaagauuuggggcagaaaauccuggccucuuaaugagggcaucauggcuauugggaucgucagcauccugcucucuucccugcucaagaacgacgugccccuggccggaccucuuauugcgggcgggaugcugaucgccuguuauguuauuagcggauccagcgcugaucugucucucgaaaaagccgcugaggugagcugggaagaggaagccgagcacuccggcaccucucauaauauccuggucgaggugcaggacgauggggccaugaagauuaaagacgaagagcgggaugacacacuuaccauccugcucaaggcuacgcugcucgcgguuagcggaguguaccccauguccaucccugccacccuguuugucugguauuucuggcagaagaaaaagcaacgcucuggcgugcuuugggauacacccagcccgccugaagucgagggcgcugugcuggacgaugggauuuacagaauccugcagcggggacuccugggccgcucccagguuggggugggagucuuccaggacggcguguuucacaccauguggcacguuacaagaggggccgugcuuauguaucaaggaaaacggcuggagcccucuugggccagcgucaagaaagaccucauuuccuacggcggcggguggcgcuuccagggaagcuggaacaccggcgaagaggugcaggugaucgcuguugaaccugggaagaaucccaagaacguccagacaacgccgggaaccuuuaaaacaccugagggcgaagugggggccauugcgcuggauuucaagcccggaaccucuggcuccccuaucgugagcagagagggcaaaauugucgggcucuacggaaauggcgugguuaccacaucugggacguauguguccgcuaucgcccaagccaaggcuagccaggagggaccccugcccgaaaucgaggacgaagucuuuaaaaagcggaaccuuaccauuauggaucugcauccuggcuccgggaagacaagacgcuaccugccggccaucgugcgggaggcgauuaaaagaaagcuccgcacccugauccuugcucccacacggguuguggccucugaaauggccgaggcucugaaaggcaugccuauuagauaucagaccacggccgucaagagcgagcacacaggacgcgaaaucguggaccucaugugccaugcuaccuucaccaugcggcugcugucccccguuagagugccuaauuacaacaugaucauuauggaugaggcccacuuuacagaccccgcgagcaucgccgcucgcggcuauauuucuacccgggucgggaugggagaagccgcugccaucuucaugacagccaccccuccgggcuccguggaggcuuuuccccaaagcaaugcggugauucaggaugaagagagagacaucccugagcggucuuggaacagcggguacgauuggaucacggacuuccccggaaaaacagucugguuuguuccuuccauuaagucuggcaaugauaucgccaacugucuccgcaagaaugggaaaagagugauucagcuuagccggaagaccuucgacacagaauaucagaaaaccaagaacaacgacugggauuacguggucacgaccgacaucuccgagaugggcgcuaauuuccgcgccgauagagugauugacccccggagaugccugaaaccgguuauccugaaggauggaccugaacgcgugauucucgccggccccaugcccgucacaguggcuucugccgcgcaacggagagggcgcaucggacggaaccagaauaaggagggcgaccaguacguuuauauggggcagccucugaacaaugaugaggaccaugcucacuggaccgaagccaaaaugcuucuggauaacaucaauacacccgagggaauuaucccugcccucuuugaaccggagagagaaaagagcgcugccauugacggcggguaccgccugcggggcgaggcgagaaaaaccuucguggagcugaugcgcagaggagaucuccccgucuggcuuuccuauaagguggccagcgaaggcuuucaauacucugaccggcgcuggugcuucgauggggagagaaacaaucagguccuggaagagaacauggacguggaaaucuggacaaaagagggagagcggaagaaacugcgcccuagauggcucgacgcucggaccuauuccgauccccuggcccuuagagaauuuaaggaguucgcugccggccgccggagcguuuccggggaccugauucucgaaaucggaaagcugccucagcaccugacgcucagagcucagaaugcccuugauaaccuggugaugcugcauaauucugagcaaggcggcaaagcguaccgccacgccauggaagagcuccccgacacaaucgagacccugaugcuucuggcucucauugccgugcugaccgggggagucacacuguuuuuccucagcggcaaggggcuuggaaaaaccuccaucggccugcuguguguuacagcuucuagcgcccuccuguggauggccuccguggaaccgcauuggauugcugcgagcaucauucuugaguuuuuccugauggugcuccugaucccugaacccgaucggcagagaacgccucaggacaaccagcuggccuaugucgugaucgggcuccuuuuuaugauucugaccguugcugccaaugagaugggacugcucgagacaaccaagaaagaucugggcaucggccacguggccgcugaaaaccaccaacaugccacaaugcuugacgucgaucugcggcccgcgucugccuggacccucuacgcuguggccacgaccgucauuacaccuaugaugcgccacaccaucgagaacacaaccgcuaauauuucccugacggccaucgcgaaccaggccgcuauucugauggggcucgacaagggauggcccaucagcaagauggauaucggcgugccgcuucuggcccuggggugcuacucucagguuaauccucucacacugaccgcugccgugcuuaugcuggucgcucauuaugccauuaucggacccggccuccaagcgaaagccacaagagaagcucagaagcggaccgccgcugggauuaugaaaaaccccaccguggacggaaucguugccauugaucuggacccuguggucuacgacgccaaguucgagaaacagcugggccagaucaugcuccuuauccuguguacaucccaaauucugcucaugcgcacgaccugggcgcugugcgaaagcaucacacuugcuaccggcccgcugacaacccucugggaggggucucccggaaaguuuuggaauacgacaauugccgugagcauggcuaacaucuucagaggcuccuaucuggccggggccggacuggcuuucucucucaugaagagccuuggcgggggacggcgcggcaccggcgcccagggggagacccugggagaaaaauggaagagacagcugaaucagcucuccaaaagcgaguuuaacacauacaagcgguccggcauuauggaaguggaucgcucugaggcgaaagaagggcugaagagaggagagaccacaaagcacgccguuagccggggcacggcuaaacuuagaugguucgucgagcgcaaucuggugaagccugaagggaaagugaucgaccucggauguggccggggcgggugguccuauuacugcgccggacugaagaaagucaccgagguuaagggcuauacaaaagggggacccggccaugaagagccugugcccauggcuaccuacggguggaaccuggugaagcuccacucuggaaaggaugucuuuuucaugccuccggaaaaaugugacacacuucugugcgauaucggcgagagcucccccaauccuaccauugaggaaggcagaacgcugcgcgugcucaagaugguugagcccuggcugcgggggaaccaauuuuguaucaaaauucuuaauccuuacaugcccucuguggucgaaacccuggagcagaugcagagaaagcacggaggcaugcucgugcgcaacccgcugagccggaauuccacacaugagauguauuggguuagcugcgggaccggaaacaucgugucugccgucaauaugacauccagaaugcugcucaaccgcuucaccauggcgcaccggaaaccuacauacgaaagagacguggaucugggcgccgggacccgccauguggcugucgagcccgaaguugccaaccuugacauuaucggacagcggauugagaauaucaagaacgaacacaagagcacguggcacuaugaugaggacaaucccuacaaaacaugggcuuaucauggcucuuacgaggugaagccuuccggcagcgccucuuccauggugaacggggucgugagacugcucaccaaacccugggauguuaucccuauggugacccaaauugcuaugacagacacgaccccguuuggacagcagcgcgucuucaaggaaaaaguggacacaagaaccccccgggccaagcgcggcacagcgcaaaucauggagguuaccgccaaguggcuguggggguuucuuagcagaaauaaaaagccucggauuuguacaagagaagaguucacccggaaagugcgcuccaacgcugccaucggagcugucuuuguggaugaaaaucaguggaacagcgccaaggaggccguugaggacgaaagauucugggaucuggugcaccgggagcgcgaacuccauaaacagggcaagugcgcgacgugcgucuauaauaugauggggaagagagagaaaaagcugggcgaauuuggaaaagcuaagggcucucgggccauuugguacauguggcugggggcccgcuuccucgaguucgaggcucugggauuuaugaacgaagaccacugguucagcagagagaauucccuuucuggcguggaaggggagggacugcauaaacucggcuacauccugcgggauaucagcaagauucccgggggcaacauguaugccgacgauaccgcuggaugggacacacgcaucaccgaggaugaccuucagaaugaagccaaaauuacagauaucauggagccugaacacgcgcugcucgccaccuccauuuuuaagcugacguaccaaaacaaggucgugagaguucagcggcccgcuaaaaauggcacagugauggacgucaucucucgcagagaucagcgggggagcggacaggugggcaccuaugggcugaacacauucaccaacauggaggugcaacucauccgccagauggaauccgagggaauuuuucugccgucugagcuugaaacgccuaaucuggccgagagaguucucgacuggcuggaaaagcacggcgcugagcggcuuaaaagaauggccaucagcggggacgauuguguggucaagcccauugacgaucgcuucgcgaccgcccugaucgcucucaacgacaugggcaaagugcggaaggauauuccucagugggaacccuccaagggauggaaugacuggcagcaaguuccuuuuugcagccaucacuuccaucagcugaucaugaaagauggcagagagaucgugguccccugucgcaaccaggacgagcugguggggcgggccagagucucucagggagcuggcuggucccuccgcgaaacagccugccuggggaagagcuacgcucaaauguggcagcuuauguauuuucaccggagagaucugcgccucgccgcgaaugccauuuguucugcugugccgguugacugggugccuaccucccggacaaccuggagcauccacgcccaucaccaguggaugacaaccgaggauaugcuguccgucuggaacagaguguggauugaagagaaucccuggauggaagacaaaacgcauguuucuagcugggaggaggugcccuaccuuggaaagcgcgaagaccaauggugcggcucccugaucgggcucacagcccgggcuaccugggccaccaacauucaggucgcgaucaaucaggugagacggcugauuggcaacgagaauuaucuggauuacaugacaagcaugaaaagauucaagaacgaaucugacccugagggagcucucugguga

SEQ ID NO: 19379 - RNA, 9879 nt, Artificial Sequence
  derived and/or modified CDS sequence (opt5) from DENV-1__KC759167__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucugucacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggcccccgaaguggaggagcaggacgcuaacuucgugugccggcgcaccuuugucgauagaggcuggggcaauggguguggacuguucggcaaagggucucucauuacaugcgccaaguuuaagugcgugaccaaacuggaaggaaagaucguucaguacgagaaccuuaaauauuccgugaucgucacagugcacacgggcgaccagcaucaaguugggaaugaaagcaccgagcacggaacaaccgcuacaauuaccccucaggcccccacgaccgaaauccagcugacagacuacggcgcccucacccuggauuguucuccucggacaggccuggacuucaacgagauggugcuccugaccaugaaggagaaauccuggcuuguccauaagcagugguuucuggaucucccccugccguggacgagcggggcuuccacaucucaagaaaccuggaaucgccaggaccuucuggugacauucaaaaccgcgcacgccaagaagcaggaggucgugguucucggaagccaagaaggcgcuaugcacaccgcccugacaggggccacggagauucagaccuccggaacaaccacaaucuuugcuggccaucugaaaugcagacucaagauggauaaacugacccuuaaggggaugagcuaugugauguguacgggcucuuucaaacuggaaaaggaggucgccgagacacagcacggaaccgugcucguucagauuaaguacgaaggcaccgacgcgccuugcaaaauccccuucuccacacaagaugagaagggggugacccagaacggacggcugaucacagcuaauccuauugucacggacaaagaaaagcccgugaacaucgaggccaaacccccuuuuggcgagagcuguauugugaucggggccggagaaaaggcucugaagcuuucuugguucaaaaagggcagcuccauugggaaaauguuugaggccaccgcuagaggcgcccgccggauggcgauccucggagauacagccugggacuucggcucuaucgggggaguuuuuaccagcgucggcaagcuggugcaucagauuuucgggacagcuuauggagugcuguuuuccggcgucagcuggaccaugaaaaucgggauuggcgugcuccugacguggcuuggacugaauucuagauccaccagccucucuaugacaugcaucgccguuggccuggugacccuguaccuuggggucauggugcaggcugauuccggauguguuauuaacuggaagggccgcgaacucaagugcgggagcggaaucuucgugacaaaugagguccacaccuggacagaacaauacaaauuucaggccgacuccccgaagcggcugucugcggccauuggcaaagcuugggaggaggggguguguggcaucagaagcgccacccgccuggaaaacaucauguggaagcagauuuccaacgagcucaaucauauccugcuugaaaacgacaugaaauucacgguuguggucggagauguggcuggcauucuggcccaggggaagaaaaugauccggccccaaccuauggaguauaaguacucuuggaagagcuggggaaaagccaagauuaucggcgcugacgugcagaauacaaccuuuaucauugaugggcccaacaccccugaaugccccgacgaucagagagcguggaauaucugggaggucgaggacuauggauucggcauuuuuacaaccaacaucuggcucaaacugcgcgauuccuacacgcagguuugugaccaccggcugaugagcgccgcuauuaaggauucuaaagccgugcacgccgacaugggcuauuggaucgaauccgagaagaaugaaacauggaagcuugcuagagccagcuucaucgaggugaaaaccugcauuuggccgaagucucauacacucugguccaacgggguccuggaaagcgagaugaucauuccuaaaaucuacggaggccccauuucucaacacaauuaucgcccuggguacuucacccagacagcgggacccuggcaucugggcaagcucgagcuggauuuugaccuuugcgaagggaccacggugguuguggaugagcacuguggaaaccggggcccuagccugagaaccacaaccgucacaggcaaaaucauccacgaauggugcugucgguccugcacccccccgccucuccgcuucagaggggaggacggauguugguacggcauggagauucggcccgugaaggaaaaggaggaaaaucugguuaaaagcauggugucugcuggguccggagaggucgacagcuuuucccugggccuucucugcaucucuauuaugaucgaagaggugaugagaagccgcuggucccggaagaugcugaugacgggggcccuggccguuuuccuccugcuuauuaugggacagcugacauggaacgaucucaucagacuguguauuauggugggcgcuaaugccucugaccgcaugggcauggggaccacauaucuggcgcuuauggcuaccuuuaaaaugagacccauguucgccgucggacugcucuuucggaagcugaccagccgcgaggugcuccugcuuacaaucggccugucccucguggccucugucgaacugccuaacagccuggaggaacuuggggauggacuggcuaugggcaucaugauucucaaacugcucacggacuuccaaucccaucagcugugggccacccuucugagccucacauuuaucaagaccacauucucucugcacuacgcuuggaagaccauggccaugguucuguccauugugagccuuuuuccgcugugccucucuacgacaucccagaaaaccaccuggcugcccgugcuccuggggagccuuggauguaagccucugacaauguuccugaucgcggagaauaaaauuuggggcagacggucuuggccccucaacgaaggcaucauggccgucgggaucguguccauucugcuuagcucccugcucaagaacgauguuccucuggcuggaccccucaucgccggcgggaugcugauugcuugcuaugugaucagcggaucuagcgccgaccuuucccuggagaaagccgcugaggucucuugggaagaggaagcggagcauagcggcgccucccacaauauucugguggaaguucaggaugacgggaccaugaagaucaaagaugaggagcgcgacgauacacucacgauccugcuuaaggcuacccugcucgccgugucuggagucuacccucugagcauucccgccacacucuuugugugguauuucuggagaaagaaaaagcaacgguccggcguccugugggacaccccgucuccucccgaaguggagcgcgcuguucuugaugacggcaucuacagaauuaugcagcgggggcugcugggacgcagccaggugggcgucgggguguuccaggaaaacguuuuucauacaauguggcacgugaccagaggagccguccucauguaucaaggcaaacggcuggagccuuccugggcgagcgugaagaaagaccuuaucucuuacgggggaggcuggagacugcagggcuccuggaauacgggggagggagugcagguuauugcugucgaacccggcaagaacccgaagaaugugcagaccgccccugggacauucaaaacccccgagggagaagugggcgccaucgcucucgauuuuaagccugggacaagcggaucucccauugucaaccgcgagggcaaaaucgugggccuguacgggaauggaguugugaccacauccggcacguaugucagcgccaucgcgcaagcuaaggccucccaggaagggccccucccugagauugaggacgaaguguuccggaaaagaaaccugaccaucauggaucuucacccgggaucuggcaagacacgccgguaccugcccgccauuguuagagaggcuaucaagcgcaaacugcggacccucauucuggccccuaccagaguggucgcuagcgaaauggccgaggcgcuuaaggggaugcccauccgcuaucagacaacggccgugaaauccgaauacaccggcaaggagaucguugaccugaugugucaugcuacauuuaccaugcggcuccugagcccugugagaguccccaauuauaacaugauuaucauggaugaggcccacuucacagacccuucuuccauugcugcccggggauacaucagcacccgcgugggcaugggggaagccgcugcgauuuuuaugacggccacaccgcccggaucuguggaggcuuucccucaaagcaaugccgucauccaggaugaagagagagacauccccgaacgguccuggaacucuggcuaugaguggauuaccgauuuuccugggaaaaccguuugguucgugcccagcaucaaguccggaaaugacauugccaacugccugcgcaagaauggcaaaagagugauccagcucucucggaagacauuugauaccgaguaccagaaaacaaagaacaacgacugggacuacgucgugaccacggauauuagcgaaaugggggcuaauuucagagccgaccgcguuaucgauccgcggagaugccuuaaaccugugauucugaaggacggccccgagcgcgucauccuggcgggacccaugccugugacaguugcuuccgccgcccaacggagaggccgcaucgggcggaaccauaauaaggaaggagaucaguauauuuacaugggccagccccucaacaaugacgaggaucacgcucauuggaccgaggccaaaaugcugcuugacaacaucaauacaccugaagggauuaucccggcgcuguucgagcccgaaagagagaagagcgccgcuauugauggagaauaucgccucagaggcgaggcccggaaaaccuacguggagcugaugcgcagaggggaccugccugucuggcucucuuauaagguggcuuccgaaggcuuucaguacagcgaucggcgcugguauuucgacggagagagaaacaaucaaguccuugaagagaacauggauguggaaaucuggacgaaagagggcgagcggaagaaacugagaccccgcuggcuggacgcccggaccuacuccgacccucucgcucugagagaauuuaaggaguucgccgcggggcgccggucuguuagcggagaucuuauccuggaaauuggcaagcucccccagcaccugacacagagagcccagaaugcucuggacaaccucgugaugcuucacaauuccgagcaagggggacgggccuaccgccaugcuauggaagagcugccggauaccaucgagacacugaugcuccuggcccuuauugccgugcugaccggcggcgucacacucuuuuuccugucugggagaggacugggcaaaaccagcaucgggcuccuuuguguuauggcuuccagcgugcugcuguggauggcgucuguggaaccucacuggauugccgcuuccaucauccucgaguuuuuccugaugguccuucugauucccgaaccugaccggcagcgcacgccccaggauaaccagcucgccuaugugguuaucggacugcuguuuaugauucucacaguggccgcuaaugagaugggccuucuggagaccaccaagaaagaccuggggaucggacaugucgccgugggcaaccaccaccaugcggccaugcucgaugucgaccugcacccugcuagcgccuggacacuuuacgcuguggccaccacaauuaucacgcccaugaugagacauaccauugaaaacacaaccgcgaauaucucucugacagccaucgcuaaccaagccgcuauucucaugggccuggauaagggguggccgaucuccaaaauggacauuggaguuccucugcucgcccuuggcugcuauagccaggugaauccccugacccugacggcugccguccucaugcugguggcgcacuacgccaucauugggcccggacuucaggcuaaggccacccgggaggcucaaaagcgcacagccgccggcaucaugaaaaacccuaccguugaugggaucguggcgauugaccuggauccggucguguaugacgcuaaguucgaaaaacagcucggacagaucaugcugcugauucucuguacaucucagauccuucugaugagaaccacgugggcccugugcgagagcauuacacucgcuaccggcccccugacaacccuuugggaaggcuccccugggaaguuuuggaauaccacaaucgccgugucuauggccaacaucuuccggggaagcuaccuggcuggcgccgggcucgcguuuucccugaugaaaagccugggaggcgggcgcagaggaacgggcgcccaaggcgagacccucggggagaaguggaagcggcagcuuaaucagcuguccaaacuggaauucaacucuuauaagagaagcggaauuauggagguugaccgcuccgaagcuaaagagggccucaagcggggggaaacaaccaaacaugccgucucuagaggaacagcuaagcugcgcugguucguggagcggaaucuugugaagcccgagggcaaagucaucgaucugggguguggaagaggcggcuggagcuacuacugcgccgggcucaagaaaguuaccgaagugaagggauauacgaaaggcgggccuggacacgaggaacccauuccuauggcgacauacggcuggaaccuggugaagcugcacuccgggaaagacgucuuuuucaucccgcccgagaagugugauacccuccuuugcgacauuggagaaucuagcccuaaucccaccaucgaggagggccgcacacugcgggugcugaagaugguugaaccuuggcucagaggcaaccaguuuuguauuaaaauccugaaucccuauaugccguccguggucgagacccuugaacaaaugcagcgcaagcaugggggaaugcuggugcggaacccucucagcagaaauucuacacacgagauguacuggguuuccugcggcacggggaacaucgugagcgccgucaauaugaccucucgcaugcugcugaaccgguucacaauggcucauagaaaacccaccuaugagcgcgauguggaccucggagccggcacaagacacguggcugucgaacccgagguugccaaccuggauauuaucgggcagcggauugaaaauaucaagcacgagcauaaauccaccuggcacuacgacgaagauaacccuuauaagacgugggcuuaccauggaagcuacgaggugaagcccucuggcuccagcuccagcauggugaauggcgucgugaaacuucugaccaagccuugggacguuauuccgauggugacacagaucgccaugaccgauacaacccccuuugggcaacagcgcgucuucaaagagaagguggacacaagaaccccuaaagcgaagcggggaacggcccagaucauggaaguuacagcuaaguggcucuggggcuuucugucuagaaacaaaaagccccggauuuguacccgcgaggaauucaccagaaaagugcggagcaaugccgcuaucggggccgucuuuguggacgagaaccaauggaauuccgccaaggaagcgguugaggaugagcgcuucugggaccuugugcacagagaacgggagcugcauaaacagggaaagugcgcuacaugcgucuauaacaugaugggcaagcgcgaaaaaaagcucggggaguuuggcaaagccaagggaucuagagccauuugguacauguggcugggcgcucgguuccuggaauuugaggcccucggguucaugaaugaggaucacugguucagccgcgaaaacucccugucuggaguggagggcgaagggcuucacaaacugggauauauccucagagacauuagcaagaucccuggcgggaauauguacgcugaugacacggccggcugggauacccggaucacagaggacgaucugcagaacgaggcgcgcauuaccgacaucauggaacccgagcaugcccuucuggcuaaauccauuuuuaagcucacauaucagaauaaggucgugagaguucaacggccggccaaaaacggaaccgugauggaugucaucucucgcagagaccagcggggcagcgggcaggugggaacauacggccugaauaccuucacgaacauggaagcucagcugauuagacaaauggaguccgaagagaucuuuagcccuucugagcucgaaacccccaaccuggccgagcgcgugcuugauuggcuggaaaaguaugggaucgagcggcucaaaagaauggcgauuuccggagacgacuguguugugaagccuaucgauaaucgcuucgccacagcucugaccgcccuuaacgacaugggcaaaguccggaaggauauuccccagugggaaccuagcaagggguggaaugacuggcagcaggugccccugugcucucaccauuuucaccaacucaucaugaaagauggcagagagauuguugugccgugucgcaaccaggacgagcuggucggacgggcuagagugucccagggcgccggguggagccugcgcgaaacagcuugccucggaaaguccuacgcccagauguggcaacugauguacuuccaccggagagaucuucgccuggcggccaaugcuaucuguucugccgucccuguggacuggauucccaccagccggacgacaugguccauccaugcccaccaucaguggaugaccacagaggauaugcucagcguuuggaacagaguguggaucgaagagaaucccuggauggaagacaaaacccacauuucuuccuggggcgaugucccuuaucuggggaagcgggaggaccaguggugcggaagccuuaucggccugacggcuagagccaccugggcgacaaacauucaaguggcuaucaaucagguucgccggcucauugggaacgagaauuaccuggacuauaugaccucuaugaaaagauuuaagaacgaaagcgauccggagggcgcccugugguga

SEQ ID NO: 19380 - RNA, 9879 nt, Artificial Sequence
  derived and/or modified CDS sequence (opt5) from DENV-1__JQ048541__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuuccugacccaagaugaaaagggggugacacagaacggacggcuuaucacggcuaaucccauugucaccgacaaagagaagccugugaacaucgaagccgagccccccuuuggcgaguccuauauugugaucggggccggagaaaaagcucucaagcugagcugguucaagaaaggcucuagcauugggaagauguuugaggccacagcuagaggcgcccgccggauggcgauccugggagauaccgccugggacuucggcuccaucgggggaguuuuuacaucugucggcaaacucgugcaucagauuuucgggaccgcuuacggagugcuguuuagcggcgucuccuggacgaugaagaucgggauuggcgugcuucugaccuggcucggacugaauagcagaucuacaucccugagcaugaccuguaucgccguuggccuugugacacucuaccugggggucauggugcaggcugauucuggaugcguuauuaacuggaaaggccgcgaacugaaguguggguccggaaucuucgugaccaaugagguccacacauggaccgaacaauauaaguuucaggccgacagcccuaaacggcucuccgcggccauuggcaaggcuugggaggagggggugugcggcaucagaucugccacgcgccuggaaaacaucauguggaaacagauuagcaacgagcuuaaucauauccugcucgaaaacgacaugaaguucacaguuguggucggagauguggcuggcauucuggcccaggggaaaaagaugauccggccgcaacccauggagcacaaauacuccuggaagucuuggggaaaggccaaaauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaagcuucgcgauagcuacacacagguuugcgaccaccggcucauguccgccgcuauuaaagauagcaaggccgugcaugccgacaugggcuauuggaucgaaucugagaaaaaugaaaccuggaagcuggcuagagccuccuucaucgaggugaagacauguauuuggcccaaaagccacacccuguggucuaacgggguccucgaauccgagaugaucauuccgaagaucuacggaggcccuauuagccaacauaaacugcgccccggguauuucacacagaccgcgggaccuuggcaccuuggcaagcuggagcucgauuuugaccugugcgaagggacgaccgugguuguggaugagcacugcggaaaucggggccccucucugagaacaaccacagucaccggcaaaaucauccaugaaugguguugccggagcuguacgcuuccuccccuccgcuucagaggggaggacggaugcugguacggcauggagauucggccggugaaggaaaaggaggaaaaccugguuaaauccauggugagcgcugggucuggagaggucgacuccuuuagccugggccuccuguguaucuccauuaugaucgaagaggugaugagaucucgcuggagccggaagaugcuuaugacagggacccuggccguuuucuuucuccugauuaugggacagcugacauggaaugaucuuaucagauccugcauuauggugggcgccaacgcuucugaccgcaugggcauggggaccaccuaccuggcccucauggcgacauucaaaaugagaccuauguuugcugucggacugcucuuccggcgccugacgagcagagaggugcuucugcucaccaucggccugucccugguggccucugucgaacuucccaauagccuggaggaacucggggauggacuggccaugggcaucaugauucucaagcugcuuacagacuuucaaucccaccagcugugggcuacccuccugagccugacauucaucaaaaccacguuuucucuucauuaugccuggaagacaauggcuaugguucuguccauugugagccucuucccccugugucucucuaccaccucccagaagacaaccuggcugccugugcuucuggggagccugggaugcaaaccgcucacaauguuucugaucgccgagaacaagauuuggggccggaaaucuuggccccuuaaugaaggcaucauggcggucgggaucguguccauucugcucagcucccugcucaagaacgauguuccucuggccggaccccuuaucgcuggcgggaugcugauugccuguuacgugaucagcggaucuagcgcugaccugucccucgagaaagccgccgaggucucuugggaagaggaagcugagcacagcggcgcgucccauaacauucugguggaaguucaggaugacgggacgaugaagaucaaagaugaggagcgcgacgauacccuuacaauccugcucaaggccacccugcucgcugugucuggagucuauccucugagcauucccgccacacuuuucgugugguacuucuggcaaaagaaaaagcagagauccggcguccugugggacaccccuucucccccggaaguggagcgggccguucuggaugacggcaucuaucgcauuaugcagagagggcuccugggacggagccaggugggcgucgggguguuucaagaaaauguuuuccacacgauguggcacgugacccgcggagcuguccuuauguaccagggcaaaagacuggagccuuccugggccagcgugaagaaagaccucaucucuuaugggggaggcuggcggcugcagggcuccuggaacacaggggaggaagugcagguuauugcggucgagcccggaaagaauccuaagaacgugcaaaccgcucccggcacauuuaaaaccccggaaggggaggugggagccaucgcccucgauuucaagccuggcacaagcgggucucccauugucaauagagaaggaaaaaucgugggccuguacggcaacgggguugugacgaccuccggaacauacgucagcgcuaucgcccaggcgaaggcuucccaggagggcccucuucccgagauugaagacgagguguuucgcaaacggaaucugaccaucauggaucugcaucccgggucuggaaagaccagacgcuaucucccugccauuguucgggaagccaucaagagaaaacugcgcacacuuauucuggcuccgacgcggguggucgccagcgagauggcugaagcccucaagggcaugcccaucagauaccaaaccacagcggugaaauccgagcacaccgggaaggagaucguugaccugaugugccaugccacauucaccaugcgccugcucagcccugugcggguccccaacuauaauaugauuaucauggaugaagcucacuuuacggacccuucuuccauugccgcuagaggcuacaucagcacacgggugggaaugggcgaggccgccgcuauuuucaugaccgcgacccccccugggucuguggaagccuuuccgcagagcaacgcugucauccaggaugaggaacgcgacauccccgagagauccuggaauucuggauaugaguggauuacagauuucccuggcaaaaccguuugguuugugcccagcaucaaguccgggaacgacauugccaauugucuucggaagaacggaaaacgcgugauccagcugucuagaaagacauucgauaccgaauaccaaaaaacgaagaauaacgacugggacuaugucgugacaaccgauauuagcgagaugggcgccaacuuccgggcugacagaguuaucgauccucgccggugccugaaacccgugauucucaaggacgggccggaaagagucauccuggccggcccuaugcccgugacaguugcguccgcugcccagcgccggggaagaaucggccgcaaucauaacaaggagggggaucaguacauuuacaugggacagccccuuaauaacgacgaggaucacgcccacuggaccgaagcuaaaaugcugcucgacaauaucaacacgccugagggcauuauccccgcccuguuugaaccugagcgggaaaagagcgcggccauugauggggaguauagacugcgcggagaggcuagaaaaaccuucguggaacucaugcggcgcggcgaccuuccggucuggcugucuuacaagguggccuccgagggguuucaauauagcgauagacgguggugcuucgacggcgaacgcaauaaccagguccuggaggaaaauauggauguggagaucuggacaaaagagggagaaagaaagaaacuccggcccagauggcuggacgcucgcaccuacuccgacccucuugcccugcgggaguuuaaggaauucgcugccggcagacgcucuguuagcggggaucucauccuggagauuggaaagcugccccagcaucucacacagcgggcgcaaaacgcccuugacaaucuggugaugcugcacaacuccgaacagggcgggagagcuuaucggcaugccauggaggagcucccugauaccaucgaaacacugaugcuucuggcucucauugccgugcugaccggaggcgucacgcuguuuuuccucucuggccgcgggcuuggaaaaacaagcaucggccugcuguguguuauggccuccagcgugcuccuguggauggcuucuguggagccccacuggauugcggccuccaucauccuugaauuuuuccugaugguccuccugauuccggagccugacagacagcggaccccccaggauaaucaacuggcuuacgugguuaucgggcuccuuuuuaugauucugaccguggccgccaacgagaugggacugcucgaaacaaccaagaaagaccugggcaucgggcacgucgcuguggagaaucaucaccaugccacaaugcuugaugucgaccugcacccugcgagcgccuggacgcucuaugcuguggccaccacaauuaucacccccaugaugcgccauacaauugaaaacaccacggcuaacaucucucugaccgccaucgcgaaucaggccgcuauucugaugggacucgauaagggcuggccuaucuccaaaauggacauuggcguuccccuucuggcccuggggugcuacagccaggugaacccgcucacacugaccgcugccguccuuaugcugguggcucacuacgccaucauuggaccuggccuccaagcgaaggccacaagagaggcucagaagcggaccgccgcugggaucaugaaaaaucccacgguugauggaaucguggccauugaccuggaucccgucguguaugacgccaaguucgaaaaacagcugggccagaucaugcuccuuauucuguguacaucucaaauccugcucaugcgcaccacaugggcgcugugcgagagcauuacccuugcuaccgggccucugacaacgcucugggagggauccccgggcaaguuuuggaacaccacaaucgccgugucuauggcuaauaucuucagaggcagcuaccuggccggggccggacuggcuuucucccucaugaaaagccuuggcgggggacggcgcggcaccggggcccagggagaaacacugggcgagaaguggaagagacagcugaaccagcucuccaaaucugaauuuaauaccuauaagcggagcggcauuauggagguugacagauccgaagcgaaagaggggcugaagcgcggagagacgacaaaacacgccgucucucggggcaccgcuaagcuuagaugguucguggaacgcaaccuggugaagcccgaggggaaagucaucgaucucggauguggccgggggggauggagcuacuauugcgccggccugaagaaaguuaccgaagugaagggcuacacaaaagggggaccuggccaugaggaacccauuccuauggcuaccuauggguggaaucuggugaagcucuacuccggaaaagacgucuuuuucaugcccccugagaagugugauacacuucugugcgacaucggcgagucuagcccgaaccccacgauugaagaggggagaacccugcgcgugcucaagaugguugaaccuuggcugcggggaaaucaauuuuguaucaaagugcuuaaccccuacaugccuuccgucguggagacacuggagcagaugcagagaaagcacggcggcaugcucguucgcaauccccugagccggaacucuacccaugaaauguauuggguguccugcgggacaggaaauauugucagcgccgugaacaugaccucuagaaugcugcucaaucgcuucacgauggcgcaccggaaaccgaccuacgagagagauguggaccugggcgccgggacacgccacgucgcuguugaaccugagguggccaaccuugauaucaucggacagagaauugaaaacaucaagcaugagcacaaauccaccuggcauuaugacgaggauaaucccuacaagacaugggcuuaucacggcagcuacgaagugaagcccucuggguccgccagcuccauggucaacggagugguuaaacugcucaccaagccuugggacgugauucccauggucacacaaaucgcuaugaccgauacgacaccuuuuggccagcagcggguguucaaagagaagguugacacccgcaccccgaaagccaagagaggcacagcgcaaauuauggaagugacggcccgguggcuguggggguuucuuagcagaaauaagaaaccccggaucuguacccgcgaggaauucacaagaaagguccggucuaacgcugccaucggagcuguguuuauugacgagaaucaguggaacagcgccaaagaggccguugaagaugagcgcuucugggaccuggugcauagagaacgggagcuccacaagcagggcaaaugcgcgaccugcgucuauaauaugauggggaagcgcgaaaagaaacugggagaguuuggcaaggcuaaaggguccagagccaucugguacauguggcugggcgcccgguuccucgaguucgaagcucugggauuuaugaacgaggaucacugguucucucgcgaaaauagccuuuccggcguggagggggagggacugcauaagcucggcuacauucugagagacaucucuaaaauuccugggggaaacauguaugccgaugacacagcuggcugggauacccggaucacagaagacgaucuucagaaugaggccaagaucaccgacauuauggaacccgagcacgcgcugcucgccaaagcuaucuuuaagcugacguaccaaaacaaggucgugcgcguucagagaccugccaaaaaugggaccgugauggaugucauuagccggcgcgaccagagaggcuccggacaggugggcacauaugggcugaacaccuucacaaauauggaagcucaacucauccggcagauggagucugagggaauuuuuagccccuccgaacuggagaccccgaaccuugccgaaagagugcuggauuggcucgagaaguacggcguugaacgccugaaacggauggcgaucagcggggacgacuguguggucaagccuaucgaugacagauucgccacggcucuuacagcccugaacgauaugggaaaagugcgcaaggacauuccccagugggagccuucuaagggcuggaaugauuggcagcaaguucccuuuugcucccaucacuuccaccagcucaucaugaaagacgggcgggagauuguggucccuuguagaaaccaggaugaacuggugggccgcgcucgggucagccagggagccggcugggggcugagagagaccgcuugccucggaaagucuuaugcccaaauguggcagcugauguacuuucaucgccgggaccuuagacuggcggccaaugcuaucuguuccgccgugcccguugauugggugccgacaagccgcaccacgugguccauucacgcccaucaccaguggaugaccacagaagacaugcucucugucuggaaccggguguggaucgaggaaaauccuuggauggaggauaaaacccauauuagcuccugggaggacguucccuaucugggcaagagagaagaccaauggugcgggagccuuaucggacugacagcucgggccaccugggcgacaaacauccagguggcuauuaaucaggucagacgccucaucggcaacgagaauuaccuggauuacaugaccucuaugaaacgguucaagaacgaauccgaccccgagggggcccugugguga

SEQ ID NO: 19381 - RNA, 9879 nt, Artificial Sequence
  derived and/or modified CDS sequence (opt5) from DENV-1__JN697056__SS-prME
agcgugaccaugcugcucaugcugcuucccacagcccugacguuccaccucaccacaagaggcggggagccucauaugaucgucuccaagcaggaacggggaaaaucucugcuuuuuaagaccagcgcuggcguuaacaugugcacacugauugccauggaccucggggagcugugugaugacaccaugacauacaaaugcccgcgcaucaccgaaacggagcccgaugacguggauuguuggugcaaugcgaccgaaacaugggugaccuauggaacauguucccaaaccggcgagcacagacgggacaagcgcucugucgcucuggccccucauauugggcucggacuggagacgagaacagaaaccuggaugagcuccgagggcgccuggcggcagauccagaaaguggaaacaugggcucuucgccaccccggcuucaccguuauugcccuguuucucgcucaugccaucgggaccucuaucacacagaagggaauuaucuucauucugcuuaugcuggugacgccuagcauggcgaugagaugcgucggcaucgggaaccgggauuuuguggagggacucuccggcgccaccuggguugacgugguccuggagcacgggagcugugugacaaccauggcuaaggauaaacccacacuggacauugaacuccugaagaccgaggugacgaauccugccguccuucgcaaacugugcaucgaagcuaagauuucuaacacaaccaccgauuccagauguccgacacaaggagaggccacccucguugaagagcaggacacaaauuucgugugccggcgcacguuuguggauagaggcuggggcaacggguguggacuguucggcaaagggagccuuaucaccugcgcgaaguuuaagugcgucacaaaacuggagggaaagaucgugcaguacgaaaaucucaaauauucuguuauugugaccguccacacaggcgaccagcaucaaguggggaacgagaccacggaacacggaaccaucgccacaauuaccccccaggcuccuacauccgagauccagcugaccgacuacggcgcccugacgcucgauuguagcccccggacaggccuggacuucaaugaaaugguucuucugaccaugaaggagaaaucuuggcucgugcauaagcagugguuucuggaucuuccucugcccuggacauccggggcuagcaccucccaagagaccuggaaccgccaggaccuccuggucacauucaaaacggcccacgccaagaagcaggaaguggucgugcugggaucucaagagggcgcuaugcacaccgcgcucacaggggccaccgaaauucagacaagcggaaccacgacaaucuuugcuggccaucugaaaugcagacuuaagauggauaaacugacccucaaggggaucuccuauguuauguguaccggcccguucaaacuggagaaggaaguggccgagacacagcacggaaccguccuggugcagguuaaguacgagggcacagacgccccuugcaaaauucccuucagcucucaagaugaaaagggggugacgcagaauggacggcuugucaccgcuaacccuaucgugacagacaaagagaagcccgugaauauugaagccgagcccccuuuuggcgaguccuauaucguugucggggcgggagaaaaagcucucaagcugagcugguucaagaaaggcucuagcauugggaagauguuugaggccaccgccagaggcgcucgccggauggccauccugggagauacagcuugggacuucggcuccaucgggggaguguuuaccucugugggcaaacucguccaucagauuuucgggacggccuacggagugcuguuuagcggcguuuccuggaccaugaagaucgggauuggcauccuucugacauggcucggacugaacagcagaucuaccucccugagcaugacauguauugcggugggcaugaucacccuuuaccucggggucauggugcaggccgauucuggaugcguuauuaauuggaaaggccgcgaacugaaguguggguccggaaucuucgugacaaacgagguccacaccuggacggaacaauauaaguuucaggcugacagcccgaaacggcuguccgccgcuaucggcaaggccugggaggagggggugugcggcauuagaucugcgacacgccucgaaaacaucauguggaaacagauuagcaaugagcugaaccauauccuucuggaaaaugacaugaaguucaccguuguggucggagauguguccggcauucucgcccaggggaaaaagucuauccggccccaaccuauggagcacaaauacagcuggaaguccuggggaaaggcuaaaaucauuggcgccgacgugcagaacaccacauuuaucauugaugggcccaauaccccugaaugucccgacgaucagagagcuuggaacaucugggaggucgaggacuauggauucggcauuuuuacgacaaauaucuggcugaagcugcgcgauagcuacacccagguuugcgaccaccggcuuaugucugccgccaucaaagauuccaaggcugugcaugcggacaugggcuauuggauugaaagcgagaaaaacgaaacauggaagcucgccagagcuucuuucaucgaggugaagaccuguauuuggccgaaaucccacacacuguggagcaaugggguccuggaaucugagaugaucauuccuaagaucuacggaggccccaucagccaacauaacuaucgcccuggguacuucacccagacggccggacccuggcaccucggcaaacuggagcuugauuuugaccugugcgaagggaccacagugguuguggaugagcacugcggaaaucggggcccuucccucagaaccacaaccgucacgggcaagauuauccaugaaugguguugccggagcuguacacugcccccgcugcgcuucaaaggggaggacggaugcugguacggcauggagauuagaccugugaaggaaaaggaggaaaaccuuguuaaaucuaugguguccgccgggagcggagaggucgacuccuuuucucucggccugcuguguaucagcauuaugaucgaagaggugaugcgguccagauggucuaagaaaaugcucaugaccgggacacuggcuguuuuccuucugcucaccaugggacagcugaccuggaaugaucugauucgccuuugcaucauggugggcgccaacgcgagcgacaauaugggcauggggacaacguaucuggcucucauggccaccuuucggaugagacccauguucgccgucggacugcucuuucgcagacugacaucccgggaggugcuucugcucaccgugggccugucucuggucgcuagcguugaacuucccaacucccuggaggaacucggggauggacuggccaugggcaucaugauucucaagcugcuuacagacuuccaaagccaccagcugugggcgacccuccugucucugacguuugugaaaacaaccuucucccuucauuacgcuuggaagaccauggccaugauccugagcauugugucucuccugccucucugucuguccacaaccagccagaagacaacguggcuuccgguccugcuggggucucucggaugcaaaccccugaccauguuucuuaucacagagaacaagauuuggggccgcaaauccuggccucugaaugaaggcaucauggccguggggaucguuagcauucuccuguccagccuccugaagaacgaugugccccuugcuggaccucugaucgccggcgggaugcugauugcuuguuaugucaucucuggaagcuccgccgaccucucucuggagaaagcggccgaggugagcugggaagaggaagcugagcacuccggcgccucucauaauauucuuguugaaauccaggaugacgggaccaugaagaucaaagaugaggagagagacgauacaauuaccauccugcucaaggcuacgcugcucgccauuagcggaguguaccccauguccaucccugccacccuguucgucugguauuuuuggcaaaagcggaaacagcgcucuggcgugcuuugggacacacccagcccgccugaagucgagagagcugugcuggaugacggcauuuaccggauccugcagcgcgggcuccugggaagaucccagguuggcgugggggucuuccaagaaggaguguuccacaccauguggcacguuacacggggcgcggugcuuauguaucaggggaagcgccuggagcccagcugggccucugucaaaaaggaccucauuuccuacggaggcggcuggagauuucaggggagcuggaacaccggagaggaagugcaggugaucgcuguugagccuggcaaaaaucccaagaacguccaaacagccccggggacguucaagaccucugaaggagaggugggcgccaucgcucuggauuuuaaaccugggacauccggaagccccauugugaaucgggaaggcaagaucgucggccucuacgggaacggagugguuaccaccuccggcacauaugugucugccauugcgcaggcuaaagccagccaggaggggccucugcccgagaucgaagacgaggucuucagaaagcgcaaucuuacgauuauggaucugcaucccggauccggcaaaacccggagauaccugccugccaucgugcgcgaagcuaucaagcggaagcucagaacacugguucuugccccgacccgcguggucgcgagcgagauggcugaagcccugaaagggaugcccauucgguaucaaacaaccgccgugaagucugagcacacgggcagagagaucguugaccucaugugccaugcuacauuuaccaugcgccugcuguccccugugcggguccccaacuacaauaugauuaucauggaugaagcccacuucaccgacccugcuagcauugccgcgagaggauauaucucuacacgggugggcaugggggaggccgcugccaucuuuaugaccgcuacacccccuggaagcguggaagccuucccgcaguccaacgccgucauucucgaugaggaaaaagacauccccgagcgcucuuggaauagcggcuacgauuggauuaccgacuuuccugggaagacgguuugguucgugcccuccaucaaaucuggaaacgauauugcuaauugucuuagaaagaacggcaagcgggugauccagcugagccgcaaaacauuugacaccgaguaucagaagacaaaaaacaaugacugggauuacgucgugaccacggacauuuccgaaaugggggcgaacuucagagccgaucggguuaucgacccuagacgcugccugaagcccgugauccucaaagauggcccggagcgggucauucuggcuggaccuaugcccgugaccguugccagcgccgcucaaagacgcggccggaucgggagaaaucagaacaaggaaggagaccaguacauuuauaugggccagccccuuaauaacgaugaggaccaugcccacuggacagaggcgaagaugcugcucgauaauaucaacaccccugaagggauuauccccgcucuguucgagccugaacgcgagaaaucugccgccaucgacggagaauaccggcugagaggcgaggcucgcaagacauuuguggagcucaugagacggggggaucuuccggucuggcuguccuauaaaguggccagcgaaggcuuccaauacuccgaccgcagauggugcuuugauggagagcggaauaaccagguccuggaagagaauauggacguggaaauuuggaccaaggagggcgagcgcaaaaagcucagaccccgguggcuggacgcgagaacauauucugauccucuugcccugcgcgaauucaaagaguuugcugccgggcggagaagcguuuccggagaccucauccuggaaauuggcaagcugccccagcaccucacccagcgcgcucaaaacgcccuugauaaucuggugaugcugcauaacucugagcaggggggaaaggcuuaccggcacgccauggaagagcucccugacacgaucgagacacugaugcuucuggcgcucauugccgugcugaccggcggcgucacccuguucuuucucagcgggagaggacuuggcaaaacauccaucgggcugcuguguguuaugagcucuuccgcucuccuguggauggccagcguggaaccccauuggaucgcugccucuauuauccuugaguucuuucugauggugcuccugauuccggaaccugaucggcagcgcaccccccaggacaaucaacuggccuaugucgugaucggacuccuuuucaugauucugacaguugcugcgaacgagaugggccugcucgagacgaccaagaaagaucuggggaucggacacgccgcugccgaaaaccaccaucacgccgcuaugcuugacguggaucugcauccugccuccgcguggacacucuacgccgucgcuaccacaauuaucacccccaugaugagacacacgaucgagaauaccacagccaacauuagccugaccgcuaucgccaaucaggcggccauucugaugggccucgacaagggcuggccuaucucuaaaauggauauuggggugccccuucuggcucugggaugcuacagccaggucaacccgcucacacugaccgccgcugugcuuaugcugguugcccauuaugcuaucaucggcccugggcuccaagccaaggcgacgcgggaagcccagaagcgcacagcugccggaauuaugaaaaaucccaccguggacggcaucgucgcuauugaucuggaccccgugguuuacgacgccaaguuugagaaacagcuggggcagaucaugcuccuuauucuguguacaucccaaauccugcucaugagaaccaccugggcccugugcgaaucuaucacacuugcgacgggaccucugaccacacucugggagggcagcccgggcaaguucuggaacaccacaauugcuguguccauggccaauaucuuucgggggagcuaucuggcuggagccggccuggccuucucccucaugaaaucucuugggggaggccgcagagggaccggagcucagggcgagacgcugggcgaaaaguggaagcggcagcugaaccagcucagcaaauccgaguucaauauuuacaagcgcucugggaucgucgaaguggauagaagcgaggccaaagaaggacugaagcggggcgagacaaccaaacacgcgguguccagagggaccgccaagcuucgcugguuuguugagcggaaccuggucaagcccgaaggaaaagugauugaccucggcugugggagaggaggcuggucuuauuacugcgcuggccugaagaaagugacagaggucaagggguauaccaaaggaggcccugggcacgaagagcccaucccuauggccacauacggauggaaucugguuaagcucuacagcggcaaagauguguucuuuauucccccugaaaagugugacacgcuucugugcgauaucggggaguccagcccgaaccccaccaucgaggaaggacgcacacugcgggugcucaagauggucgagccuuggcugagaggcaaucaauucuguauuaaaauccuuaaccccuauaugccuucugugguugaaacccuggagcagaugcagcgcaagcauggcgggaugcucgugcggaauccccuguccagaaacagcacacacgagauguacugggucucuugcggaaccggcaauauuguguccgcuguuaacaugacgagccgcaugcugcucaaccgguuuaccauggcccauagaaaaccgacauaugaacgcgacguggaucugggggcgggaacccggcacgucgccguggagccugaaguggcuaaucuugacaucauuggccagagaaucgagaacaucaagaaugaacacaaaucuacauggcauuacgaugaggacaaccccuauaagaccugggccuaccacggguccuaugaggucaagcccagcggauccgcuagcucuaugguuaauggcguggugcgccugcucacaaaaccuugggaugucauucccauggugacccaaaucgccaugacggacacaaccccuuucggccagcagagaguuuuuaaggaaaaaguggacacccggacaccgaaggcuaaacgcgggacggcccaaauuauggaggucaccgcgaaguggcuguggggauuccuuagcagaaacaagaaaccccggaucuguacaagagaagaguuuacccggaaggugcgcuccaaugccgcuauuggcgccguuuucguggaugaaaaccaguggaauucugcuaaagaggccgucgaggacgaaagauuuugggaucuggugcggcgcgagagagaacuccauaagcaggggaaaugcgccacaugcguuuacaacaugaugggaaagcgggagaagaaacugggcgaauucgggaaggcgaaaggcagccgcgcuaucugguacauguggcugggagccagauuucucgaguucgaggcccugggcuucaugaaugaagaccacugguuuucccgggagaacucucuuagcgggguggaaggagagggccugcauaagcucggguauauccugcgcgauauuuccaaaaucccuggaggcaauauguacgcugacgauaccgccgggugggacacaagaauuaccgaggaugaccuucagaacgaagcuaagaucacggauauuauggagcccgaacacgcccugcucgcgaccucuaucuucaaacugacauaucaaaauaaggucgugcggguccagcgcccugccaagaacggcaccgugauggacguuaucagcagacgggaucagcgcggauccggccagguggggacauacggacugaacaccuuuacgaauaugggcgcucaacucauuagacagauggagagcgaagggaucuuccugcccucugagcuugagacaccgaaccuggccggacggguccucgacuggcuggaaaaacacggcauugagagacuucgccggauggcuaucuccggggacgauuguguggugaagccuauugacgauagauuugccaccgcgcugacagcccucaaugacaugggcaaaguucgcaaggauaucccccagugggaaccuagcaaaggauggaacgacuggcagcaagugcccuucugcucucaucacuuucaucagcugauuaugaaggauggccgggagaucgucgugccuuguagaaaucaggacgaacugguugggcgcgcucgggugucccagggagccggcuggagccucagagagaccgcuugccuggggaaguccuaugcccaaauguggcagcuuauguacuuccaccgccgggaucugagacucgcugccaacgcgaucuguucugccguccccguggacugggucccgacgagccgcaccacaugguccauucacgcucaucaccaguggaugaccacagaggauaugcugagcguguggaaucggguuuggaucgaagagaacccuuggauggaagacaaaacccaugugucuuccugggaggacguccccuaucuuggaaagagagaagaucaauggugcggcagccugauugggcucacagcccgggccaccugggcuacgaauauccagguggccauuaaccagguuagacgccugaucggcaaugagaacuaccuggacuacaugacaucuaugaaacgguuuaagaaugagagcgaucccgaaggagcgcucugguga

SEQ ID NO: 19382 - RNA, 9879 nt, Artificial Sequence
  derived and/or modified CDS sequence (opt5) from DENV-1__JN697057__SS-prME
agcgugaccaugcugcucaugcugaugcccacagcccuugcuuuccaccugacgacccggggaggggaaccucauaugaucgucuccaagcaggaacggggaaaaucucuccuguuuaagaccagcgccggcguuaacaucugcacccuuaucgccauggaccugggggagcucugugaagauacaaugaccuacaaaugcccccgcauuacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauccagcggguugaaacaugggcucugcgccaccccggcuucaccgugauugcccuuuuucuggcgcaugccaucgggacaucuaucacccagaagggaauuaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugaucacaugcgccaaguuuaagugcgugacaaaacuugagggaaagaucguucaguacgaaaaccugaaauauuccgugauugucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaaucccuuucuccacccaagaugaaaagggggugacacagaacggacggcugauuacggcuaaucccaucgucaccgacaaagagaagccugugaacauugaagccgagccgcccuuuggcgagagcuauaucgugauuggggccggagaaaaagcucuuaagguuucuugguucaagaaaggcagcuccaucgggaagauguuugaggccacagcuagaggcgcccgccggauggcgauccucggagauaccgccugggacuucggcucuauugggggagucuuuacaagcgugggcaaacuggugcaucagaucuucgggaccgcuuacggaguccuguuuuccggcgugagcuggacgaugaagauugggaucggcguucuccugaccuggcuuggacucaauucuagauccacaagccucucuaugaccuguauugccgugggccuggucacacuguaccuuggggugaugguucaggcugauuccggaugcgugaucaacuggaaaggccgcgaacucaagugugggagcggaauuuucgucaccaaugaggugcacacauggaccgaacaauauaaguuucaggccgacuccccuaaacggcugucugcggccaucggcaaggcuugggaggaggggguuugcggcaucagaagcgccacgcgccuggaaaacauuauguggaaacagaucuccaacgagcucaaucauauucugcuugaaaacgacaugaaguucacaguggucgugggagauguggcuggcauccuggcccaggggaaaaagaugauucggccgcaacccauggagcacaaauacucuuggaaaagcuggggaaaggccaagaucaucggcgcugacguccagaauaccaccuuuauuaucgaugggccuaacacacccgaauguccugacgaucagagagcguggaauauuugggagguugaggacuauggauucggcaucuuuaccacgaacauuuggcucaagcugcgcgauuccuacacacaggugugcgaccaccggcugaugagcgccgcuaucaaagauucuaaggccgugcaugccgacaugggcuauuggaucgaauccgagaaaaaugaaaccuggaaacuugcuagagccagcuucauugaggucaagacauguaucuggcccaagucucacacccucugguccaacggggugcuggaaagcgagaugauuaucccgaagauuuacggaggcccuaucucucaacauaauuaucgccccggguacuucacacagaccgcgggaccuuggcaccugggcaaacucgagcuggauuuugaccuuugcgaagggacgaccguuguggucgaugagcacugcggaaaccggggccccagccugagaacaaccacagugaccggcaagaucauucaugaaugguguugccgguccuguacgcucccuccccugcgcuucagaggggaggacggaugcugguacggcauggagauccggccgguuaaagaaaaggaggaaaaucuggugaaaagcauggucucugcuggguccggagagguggacagcuuuucccuuggccuccuguguauuucuaucaugauugaagagguuaugagaagccgcuggucccggaaaaugcugaugacagggacccucgccguguucuuucugcuuaucaugggacagcugacauggaacgaucucauuagacugugcaucauggucggcgccaaugcuucugaccgcaugggcauggggaccaccuaucuggcccuuauggcgacauucaagaugagaccuauguuugcugugggacugcuguuccggcgccugacgagcagagaggugcuccugcuuaccaucggccugucccucgucgccucuguugaacugcccaacagccuggaggaacuuggggauggacuggccaugggcauuaugauccucaaacugcucacagacuuucaaucccaccagcugugggugacccuucugagccucacauucauuaagaccgcuuuuucucugcauuacgccuggaaaacgauggcuauggugcuguccaucgucagccuuuucccccugugucucucuacaaccucccagaagaccacauggcugccugugcuccuggggagccuuggaugcaagccgcugaccauguuucugauugccgagaauaaaaucuggggccggaagucuuggccccucaacgaaggcaucauggcgguugggauuguguccauccugcuuagcucccugcucaaaaacgaugucccucuggccggaccccucauugcuggcgggaugcugaucgccuguuaugugauuagcggaucuagcgcugaccuuucccuggagaaggccgccgagguuucuugggaagaggaagcugagcacagcggcgcgucccauaauauccugguggaaguccaggaugacgggacaaugaaaaucaaggaugaggagcgcgacgauacgcucaccauucugcuuaaagccacacugcucgcugugucuggagucuacccucugagcauccccgccacccucuucgugugguauuucuggcaaaagaagaaacagagauccggcguucugugggacacaccuucucccccggaaguggagcgggccguccuugaugacggcauuuaccgcaucaugcagagagggcugcugggacggagccaggugggcguugggguguuucaagaaaacgucuuccacaccauguggcacgugacgcgcggagcugugcucauguaucagggcaagagacuggagccuuccugggccagcguuaaaaaggaccuuauuucuuacgggggaggcuggcggcugcagggcuccuggaauaccggggaggaaguccaggugaucgcgguggagcccggcaagaacccuaagaauguccaaacagcucccggcaccuuuaagacaccggaaggggaggugggagccauugcccucgauuucaaaccuggcaccagcgggucucccaucguuaacagagaacgcaagaucgugggacuguacggcaauggcgucgugacaacguccgggaccuauguuagcgcuauugcccaggcgaaggcuucccaggagggaccucuccccgagaucgaagacgagguguuucggaagagaaaccugacaauuauggaucuucaucccggcucugggaaaacccgccgguaccugccugccaucgucagagaagccauuaagcgcaagcugcggacccucauccuggcuccgacaagagugguugccagcgagauggcugaagcccuuaaaggaaugcccauccgcuaucaaacgaccgcggugaaguccgagcacacaggcaaagagauugucgaccugaugugccaugccaccuucacaaugcggcuccugagcccugugagagugcccaauuacaacaugaucauuauggaugaagcucacuuuaccgacccuucuuccaucgccgcucggggguauauuagcacgcgcgucggcaugggagaggccgccgcuaucuucaugacagcgacacccccuggcucuguugaagccuuuccgcagagcaaugcugugauccaggaugaggaaagagacauucccgagcgguccuggaacucuggguacgaguggaucaccgauuucccuggaaagacagugugguuuguccccagcauuaaauccggcaaugacaucgccaacugucugcgcaagaaugggaagagagugauucagcucucucggaaaaccuucgauacagaauaucaaaagaccaaaaacaacgacugggacuacguugugacgacagauaucagcgagaugggagccaauuucagagcugaccgcgucauugauccucggagaugccuuaagcccgugauccugaaagacggcccggaacgcguuauccuggccgggccuaugcccgugaccgucgcguccgcugcccagcggagaggccgcauuggacggaaccauaauaaggagggcgaucaguacaucuauauggggcagccccucaacaaugacgaggaucacgcccacuggacagaagcuaagaugcugcuugacaacauuaauaccccugagggaaucauucccgcccuguuugaaccugagagagagaaaagcgcggccaucgauggcgaguaccgccucagaggggaggcucggaagacguucguggaacugaugcgcagaggagaccugccggucuggcucucuuauaaaguggccuccgagggcuuucaauacagcgaucggcgcuggugcuucgacggggaaagaaacaaucagguucuugaggaaaacauggauguggagaucuggaccaaggagggcgaacggaaaaagcugagaccccgcuggcuggacgcucggacauauuccgacccucucgcccugagagaguuuaaagaguucgcugccggacgccggucugugagcggcgaucuuauucuggagaucgggaagcucccccagcaucugacccagagagcgcaaaaugcccuggacaaccucgucaugcuucacaauuccgaacagggaggccgggcuuaccgccaugccauggaggagcugccugauacaauugaaacccugaugcuccuggcucuuaucgccguucugacagggggagugacccucuuuuuccugucuggcagaggccuggggaagacgagcauuggacuccuuugugugauggccuccagcguccugcuguggauggcuucuguggagccccacuggaucgcggccuccaucauucucgaauuuuuccugaugguucuucugaucccggagccugaccggcagcgcacaccccaggauaaccaacucgcuuauguggucauuggccugcuguuuaugauccucaccguggccgccaaugagauggggcuucuggaaaccaccaaaaaggaccugggaauuggccacgucgcuguggagaaccaucaccaugccgcgaugcucgauguugaccugcacccugccagcgcuuggacccuuuacgccguggcuacaacgaucauuacccccaugaugagacauacaaucgaaaacaccacagccaauaucucucugaccgcgauugccaaccaggcugccauccucauggggcuggauaaaggauggccuauuuccaagauggacaucggcgucccccugcucgcucuuggcugcuacagccaggugaauccgcugacgcugaccgccgcuguucucaugcuggccgcgcacuaugccauuaucgggccuggacuucaagcuaaagccacacgggaggcucagaagcgcaccgccgccggcaucaugaagaaccccacaguggaugggauugucgcgaucgaccuggaucccgugguguacgacgcuaaauucgaaaagcagcucggacagauuaugcugcugauccucuguaccucucaaauucuucugaugagaacgacaugggcccugugcgagagcaucacccucgcuacaggcccucugaccacccuuugggagggguccccgggaaaauuuuggaauacaacgaucgccguuucuauggccaacauuuuccggggcagcuaucuggcuggcgccgggcucgcguucucccugaugaaaagccugggaggcgggcgcagaggaaccggcgcccagggggaaacacucggagagaaauggaagcggcagcuuaaucagcuguccaagucugaauuuaacaccuacaaaagaagcggcaucauggaggucgaccgcuccgaagcuaaggagggccugaaaagaggggaaacaaccaagcacgccgugucuagaggaacggcuaaacuccgcugguucguggaacggaaucuggucaagcccgagggcaagguuguggaucuuggguguggaagaggcggguggagcuauuacugcgccggacugaaaaaggugacagaagucaaaggcuauaccaagggcgggccuggacaugaggaacccauuccuauggcgaccuacggcuggaaccucgugaaacugcacuccgggaaggacgucuuuuucauucccccugagaaaugugauacacugcucugcgacauuggagagucuagcccgaaucccaccaucgaagagggccgcacacuucgggugcugaagauggucgaaccuuggcugagagggaaccaauuuuguauuaagauccucaaucccuacaugccuuccgugguugagacgcuggagcagaugcagcgcaaacauggaggcaugcuugugcggaacccccugagcagaaauucuacccacgaaauguauugggucuccugcggcacagggaacaucgugagcgccgugaauaugaccucucgcaugcuccugaaccgguucacaauggcucacagaaagccgaccuacgagcgcgaugucgaccugggagccggcacgagacauguugcuguggaaccugagguggccaaccucgauauuaucgggcagcggauugaaaauaucaaacacgagcauaaguccaccuggcacuaugacgaggauaaccccuacaaaacaugggcuuaucauggaagcuacgaagucaagcccucuggcuccgccagcuccauggugaaugggguugugaagcugcuuaccaaaccuugggacgucauucccauggugacacaaaucgcgaugaccgauacaaccccuuuuggacagcagcgcguuuucaaggagaaaguggacacgagaacaccgaaggccaaacggggcaccgcucaaaucauggaagucaccgccagauggcuguggggcuuucucagccggaacaagaagccccgcauuuguacaagagaggaguucacgcggaaagugcgcucuaaugcugccaucggggccguuuuuguggacgagaaccaguggaauagcgcgaaggaggcugucgaagaugagagauucugggaccuggugcaccgggaacgcgagcuucacaaacagggaaagugcgcgaccugcgucuauaacaugaugggcaaaagagaaaagaagcugggggaguuuggaaaagccaagggcucccgggcuauuugguacauguggcucggggcccgcuuccuggaguucgaagcucugggcuuuaugaaugaggaucauugguucucuagagaaaacagccucuccggaguggagggcgaggggcugcacaaacuuggauacauccugcgggacauuucuaagaucccuggcgggaauauguaugccgaugacacagcgggaugggauacccgcaucacagaagacgaucuccagaacgaggccaaaauuaccgacaucauggaacccaagcaugcucugcuugccaaagcuauuuuuaagcugacauaccaaaauaagguugugagaguccagcggccugccaaaaacggcaccgugauggaugugaucagccgcagagaccagcggggguccggccagguuggaacguauggccucaauaccuucacaaacauggaggcgcaacugauuagacagauggaaucugaggggaucuuuagccccuccgagcuggaaaccccgaaccucgccgagcgcgugcuggauuggcuugaaaaguacggagucgagcggcugaaaagaauggcuaucagcggcgacgacugugugguuaagccuauugaugaccgcuucgccacagcucucaccgcccugaaugauauggggaaagugcggaaggacaucccccagugggaaccuucuaagggauggaacgauuggcagcaaguccccuuuugcucccaccacuuccaucagcuuauuaugaaagacggcagagagaucguggucccuugucgcaaucaggaugagcugguggggcgggcuagaguuagccagggcgccggauggucucuccgcgaaacggcgugccugggcaaguccuaugcccaaauguggcagcugauguacuuucaccggagagaccuccgccuggcugccaacgccauuuguagcgcugugcccgucgauugggugccgacaucccggaccacauggucuauccaugcccaccaucaguggaugaccacggaggacaugcuuagcguuuggaauagaguguggauugaagagaacccuuggauggaagauaaaacccacaucuccagcugggaggacguccccuaucuggggaagcgggaggaccaauggugcggaucucucaucggccugacagcgagagcuaccugggccacaaauauucagguggccaucaaccaggugcgccggcuuauugggaaugaaaacuaccuggauuacaugaccuccaugaaaagauucaagaaugagagcgaccccgaaggagcucucugguga

SEQ ID NO: 19383 - RNA, 9879 nt, Artificial Sequence
  derived and/or modified CDS sequence (opt5) from DENV-1__HQ624984__SS-prME
agcgugaccaugcugcucaugcugaugcccacggcccuugcuuuccaccugacgaccagaggcggggagccucauaugaucgucuccaagcaggaacgggggaaaucucuccuguuuaagacaagcgccggcguuaauaugugcacccuuaucgcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagucugccuggaaacagauucagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcuguggacucuucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuucagcacccaagaugaaaagggcguuacacagaacgggcggcugauuacggcuaaucccaucgugaccgacaaagagaagccugucaacauugaagccgagccgcccuuuggagagucuuauaucgugauuggcgccggggaaaaagcucuuaagcucagcugguucaagaaaggauccucuaucggcaagauguuugaggccacagcuagaggggcccgccggauggcgauccugggcgauaccgccugggacuucggaagcauuggcgggguguuuacauccguuggaaaacugguccaucagaucuucggcaccgcuuacggggugcucuuuagcggagugucuuggacgaugaagauuggcaucgggguccugcuuaccuggcugggccucaauuccagaagcacaucucuguccaugaccuguauugccgugggacugguuacacuuuaccucggcgugaugguccaggcugauagcgggugcgugaucaacuggaaaggacgcgaacugaaguguggcuccgggauuuucguuaccaaugaggugcacacauggaccgaacaauauaaguuucaggccgacucuccuaaacggcugagcgcggccaucggaaaggcuugggaggagggcgucugcgggaucagauccgccacgcgccucgaaaacauuauguggaaacagaucucuaacgagcugaaucauauucuucuggaaaacgacaugaaguucacagugguugugggcgaugucgcuggaauccucgcccagggcaaaaagaugauucggccgcaacccauggaguacaaauauagcuggaaguccugggggaaggccaaaaucaucggagcugacgugcagaauaccaccuuuauuaucgauggcccuaacacacccgaauguccugacgaucagagagcguggaauauuugggagguggaggacuacggguucggaaucuuuaccacgaacauuuggcugaagcugcgcgauagcuauacacaggucugcgaccaccggcuuaugucugccgcuaucaaagauuccaaggccguucacgccgacaugggcuacuggaucgaaagcgagaaaaaugaaaccuggaagcucgcuagagccucuuucauugaggugaagacauguaucuggcccaaaucccauacccuguggagcaacggcgugcuggaaucugagaugauuaucccgaagauuuaugggggaccuaucagccaacacaauuaccgccccggcuacuucacacagaccgcggggccuuggcaucucggaaaacuggagcuugauuuugaccugugcgaaggcacgaccgucgugguugaugagcacugcgggaaccggggacccucccucagaacaaccacagugaccggcaagaucauucacgaaugguguugccggagcuguacgcugccuccccugcgcuucagaggcgaggacgggugcugguauggaauggagauccggccggucaaagaaaaggaggaaaaucuugugaagucuaugguuuccgcuggcagcggggagguggacuccuuuucucucggacugcuguguauuagcaucaugauugaagaggucaugagaucccgcuggucucggaaaaugcucaugacaggcacccuggccguguuccuucugcucaucauggggcagcugacauggaacgaucugauuagacuuugcaucaugguuggagccaaugcuagcgaccgcaugggcaugggcaccaccuaccuggcccucauggcgacauuuaagaugagaccuauguucgcuguggggcugcucuuucggcgccugacguccagagagguccuucugcucaccaucggacugucucugguggccagcguggaacuucccaacucccuggaggaacucggcgaugggcuggccaugggaauuaugauccucaaacugcuuacagacuuccaaagccaucagcugugggcuacccuccugucucugacauuuauuaagaccacguucucccuucacuaugccuggaaaacaauggcuaugguccugagcaucguuucucucuuuccccugugucucuccaccaccagccagaagacaaccuggcugccugugcuucugggcucucuggggugcaagccgcucacaauguuccugauugccgagaauaaaaucuggggacggcgcuccuggccccuuaacgaaggcaucauggcggugggcauugucagcauccugcucuccagccugcucaagaacgaugugccucuggccgggccccuuauugcuggaggcaugcugaucgccuguuacguuauuucugggagcuccgcugaccugucucucgagaaagccgccgaggugagcugggaagaggaagcugagcauuccggagcgucucacaauauccuggucgaagugcaggaugacggcacgaugaagaucaaagaugaggagagagacgauacccuuacaauucugcucaaggccacccugcucgcuguuagcgggguguauccucuguccauccccgccacacuuuuugucugguacuucuggcagaagaagaagcagcggucuggagugcugugggacaccccuuccccucccgaagucgagcgcgccgugcuggaugacggcauuuauagaaucaugcagcggggccuccuggggcgcucccagguuggagugggcgucuuccaagaaaacguguuucauacgauguggcacguuaccagaggggcugugcuuauguaccagggaaaacggcuggagcccagcugggccucugucaagaaagaccucauuuccuacggcgggggauggagacugcagggcagcuggaauacaggcgaggaagugcaagugaucgcgguugagcccgggaagaacccuaaaaauguccaaaccgcucccggaacauucaagaccucugaaggcgaggugggggccauugcccucgauuuuaagccgggaacauccggcagcccuaucgugaaccgcgaagggaaaaucgucggacuguauggcaauggcgugguuacgaccuccgggacauacgugucugcuauugcccaggcgaaggcuagccaggagggaccccuuccugagaucgaagacgaggucuuccggaaaagaaaccugaccauuauggaucugcaccccggcuccgggaagacccgccgguaucuccccgccaucgugagagaagccauuaaacgcaagcugcggacacuuauccuggcuccuacgagaguuguggccagcgagauggcugaagcccucaagggaaugccgauccgcuaccaaaccacagcggucaaaucugagcauaccggcaaggagauuguggaccugaugugccacgccacauuuaccaugcggcugcucucccccguuagagugccuaauuauaacaugaucauuauggaugaagcucauuucacggaccccagcucuaucgccgcucggggguacauuagcacacgcgucggcaugggagaggccgccgcuaucuuuaugaccgcgaccccucccggcuccguggaagccuucccucagucuaaugcucuuauccaggaugaggaaagagacauuccggagcggagcuggaacuccggguaugaguggaucacagauuuucccggaaaaaccgugugguucgucccuucuauuaagagcggcaaugacaucgccaacugucugcgcaaaaaugggaagagaguuauucagcugucccggaagacauuugauaccgaauaccagaaaacgaagaacaacgacugggacuacguggugacaaccgauaucagcgagaugggagccaauuucagagcugaccgcgucauugauccccggagaugccucaaaccugugauccugaaggacggccccgaacgcguuauccuugccgggccgaugccugugacagucgcgucugcugcccagcggagaggccgcauuggacggaaccacaauaaagagggcgaucaguauaucuacauggggcagccccugaacaaugacgaggaucaugcccacuggaccgaagcuaagaugcuccuggacaacauuaauacgcccgagggaaucauuccugcccuguucgaacccgagagagaaaaguccgcggccaucgauggcgaguaucgccucagaggggaggcucggaaaaccuuuguggaacuuaugcgcagaggagaccugccuguuuggcugagcuacaagguggccuccgagggcuuccaauauucugaucggcgcuggugcuuugacggggaaagaaacaaucagguccucgaggaaaacauggauguggagaucuggacaaaagagggcgaacggaagaaacugagaccgcgcuggcuugacgcucggaccuacagcgacccccuggcccucagagaguucaaggaauuugcugccggacgccgguccgucucuggcgaucugauucuggagaucgggaaacucccucagcaccuuacacagagagcgcaaaaugcccuggacaaccuggugaugcuccauaauagcgaacagggaggccgggcuuaucgccacgccauggaggagcugcccgauaccauugaaacacuuaugcugcucgcucugaucgccguucugaccgggggagugacacucuucuuucuuuccggcagaggccuggggaagacaagcauuggacugcucugugugauggccucuuccguccugcuuuggauggcuagcguugagccucauuggaucgcggccucuaucauucuggaguucuuucucauggugcugcugauccccgagccggaccggcagcgcaccccucaggauaaccaacucgcuuacguggucauuggccuucuguucaugauccugaccguggccgccaaugagauggggcuccuggaaacaaccaagaaagaccuuggaauuggccacguugcuguggggaaccaccaucacgccgcgaugcuggaugucgaccuccaucccgccuccgcuuggacacuguacgccguggcuacgaccaucauuacaccuaugaugagacacaccaucgagaacacaaccgccaauaucagccugacggcgauugccaaccaggcugccauccucaugggacuugauaagggcuggcccauuucuaaaauggacaucggcgucccucugcuggcucucgggugcuauagccaggugaauccccugacccuuacagccgcuguucugaugcucguggcccauuacgcgauuaucggaccgggccugcaagccaaggcuacccgggaagcccagaaacgcacagcugccgggaucaugaagaacccuaccgucgauggaauuguggccaucgaccuggaucccguuguguaugacgcgaaguuugagaaacagcucggccagauuaugcuucugauccuguguacgucccaaauucuccugaugagaacaaccugggcucuuugcgaaucuaucacacuggccaccgggccccucaccacacugugggagggaagcccuggcaaguucuggaauacgaccaucgcugucuccauggccaacauuuuucggggcagcuaccuggccggggcuggacucgccuucucccuuaugaaaucucugggcgggggacgcagaggcacaggggcgcagggagagacccugggcgaaaaguggaaacggcagcucaaucagcugagcaaguccgaguucaacacauauaagagaucuggcaucaccgaaguggaccgcagcgaggccaaagaagggcuuaagcggggagagacgacaaaacacgcuguguccagaggcaccgccaagcugcgcugguuuguugagcggaaucucgucaaaccggaagggaaggugauugaucugggauguggcagagggggauggucuuacuauugcgcuggccugaagaaagugaccgaggucaagggcuacacaaaagggggacccggccacgaagaaccuauccccauggccaccuacggguggaaccucguuaaacuucauagcggaaaagacguguucuuuauuccucccgaaaagugugauacacugcugugcgacaucggcgaguccagcccuaauccgacgauugaggaagggcgcacccuccgggugcugaaaauggucgagcccuggcuuagaggaaaccaauucuguaucaagauccugaauccuuauaugcccucugugguugaaacacucgagcagaugcagcgcaagcacggcggcaugcuggugcggaacccucuguccagaaauagcacccaugagauguacugggucucuugcgggacaggaaacauuguguccgcgguuaauaugaccagccgcaugcuccugaaccgguuuacgauggcccacagaaaacccaccuaugaacgcgauguggaccuuggcgcugggacaagacacgucgccguggagccggaaguggcuaaccuggauaucauuggacagcggaucgagaauauuaagcaugaacacaaaucuaccuggcauuacgacgaggauaacccuuauaagacaugggccuaccacggcuccuaugaggucaaacccagcggguccgcuagcucuaugguuaauggaguggugaagcuccugaccaagcccugggacgucaucccuauggugacacaaaucgccaugaccgauacgacacccuucggccagcagcgcguuuuuaaagaaaagguggacaccagaaccccuaaagcgaagcggggcacagcccaaauuauggaggucacggcuaaauggcuuuggggguuccugagcagaaacaagaagccgcggaucuguacccgcgaagaguuuacaagaaaagugcgguccaaugccgcuauuggagccguuuucguggacgaaaaccaguggaacucugccaaggaggcggucgaggaugaacgcuuuugggaccucgugcauagagagcgggaacugcacaaacagggcaagugcgcuaccugcguuuacaacaugauggggaaacgcgagaagaagcugggagaguucggcaaagccaaggggagcagagccaucugguacauguggcucggcgcucgguuucuggaguucgaggcccuuggauucaugaaugaagaucacugguuuucccgcgagaacucucugagcggcguggaaggggagggacuccauaaacugggcuauauucuuagagacaucuccaagauccccgggggaaauauguacgcugaugacacagccggcugggauacccggauuacagaggacgaucugcagaacgaagcgcgcaucaccgacauuauggagccugaacacgcccuccuggcuaaaucuaucuucaagcugacguaucaaaauaaagucgugagaguccagcggcccgccaagaacgggaccgugauggauguuauuagccgcagagaccagcggggcuccggacaggugggcacauacgggcucaauaccuuuacaaacauggaggcucaacugaucagacagauggaaagcgagggaaucuucucuccuuccgagcuugaaacccccaaccuggccgagcgcguccucgauuggcuggaaaaguauggcguggagcggcuuaaaagaauggcgauuagcggggacgacugugugguuaagccgaucgaugaccgcuuugccacggcucugacagcccucaaugauaugggaaaagugcggaaggacauuccucagugggaacccucuaaaggcuggaacgauuggcagcaagucccuuucugcucccaucacuuucaccagcugaucaugaaggacgggagagagauugugguucccugucgcaaucaggaugagcuggugggccgggcuagagucagccagggagccggcuggucccuccgcgaaaccgcuugccuggggaagucuuacgcccaaauguggcagcuuauguauuuccaucggagagaccugcgccucgcggccaacgcuaucuguagcgccgugccugucgauuggauucccacaucccggaccacguggagcauccacgcccaucaccaguggaugaccacagaggacaugcugucuguguggaauagaguuuggaucgaagagaacccguggauggaagauaaaacccauauuuccagcuggggagacgugccuuaccuuggcaagcgggaggaccaauggugcgggucucugaucggacucacagcuagagccaccugggcgacaaauauucaggucgcuaucaaccaggugcgccggcugauuggcaaugagaacuaccuggauuauaugaccagcaugaaaagauuuaagaaugaauccgaccccgagggggcccucugguga

SEQ ID NO: 19384 - RNA, 9879 nt, Artificial Sequence
  derived and/or modified CDS sequence (opt5) from DENV-1__HQ891314__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucacggaaauggugcuucugacaaugaaggagaaauccuggcucguccauaagcagugguuucuggaucuuccucugcccuggaccagcggggcuuccacaucucaagagaccuggaaccgccaggaccuccuggugaccuucaaaacagcgcacgccaagaagcaggaagucgugguucugggaagccaagagggcgcuaugcacacggcccucaccggggccacagaaauccagaccuccggaacaaccacgauuuuugcuggccaucugaaaugcagacuuaagauggauaaacugacacucaaggggaugagcuaugugauguguaccggcucuuucaaacuggagaaggaagucgccgagacccagcacggaacagugcugguucagaucaaguacgagggcaccgacgcgccgugcaaaauuccuuucuccacacaagaugaaaagggggugacgcagaauggacggcuuaucaccgcuaaccccaucgucacagacaaagagaagccugugaauauugaagccgagccccccuuuggcgagagcuauaucgugauuggggccggagaaaaagcucucaagcugucuugguucaagaaaggcagcuccaucgggaagauguuugaggccaccgcuagaggcgcccgccggauggcgauucugggagauacagccugggacuucggcucuaucgggggaguuuuuaccagcgucggcaaacucgugcaucagaucuucgggacggcuuacggagugcuguuuuccggcgucagcuggaccaugaagauugggaucggcgugcuucugacauggcucggacugaacucuagauccaccagccugucuaugacauguauugccguuggccuugugacccucuaccugggggucauggugcaggcugauuccggaugcguuaucaauuggaaaggccgcgaacugaagugugggagcggaauuuucgugacaaacgagguccacaccuggacggaacaauauaaguuucaggccgacuccccuaaacggcucucugcggccaucggcaaggcuugggaggagggggugugcggcauuagaagcgccacacgccuggaaaauaucauguggaaacagaucuccaacgagcuuaaccauauucugcucgaaaaugacaugaaguucaccguuguggucggagauguggcuggcauccuggcccaggggaaaaagaugauucggccgcaacccauggagcacaaauacucuuggaagaacuggggaaaggccaaaaucauuggcgcugacgugcagaauagcaccuuuaucaucgaugggccuaacacacccgaauguuccgacgaucagagagcguggaauauuugggaggucgaggacuauggauucggcaucuuuaccacgaacauuuggcugaagcuucgcgauagcuacacacagguuugcgaccaccggcucaugucugccgcuaucaaagauuccaaggccgugcaugccgacaugggcuauuggauugaaagcgagaaaaaugaaaccuggaagcuggcuagagccucuuucaucgaggugaagacauguaucuggccuaaaucccacacccuguggagcaacgggguccucgaaucugagaugauuauccccaagauuuacggaggcccgaucagccaacauaauuaucgcccuggguacuucacacagaccgcgggacccuggcaccugggcaaacuugagcuggauuuugaccucugcgaagggacgaccgugguuguggaugagcacugcggaaaccggggcccuucccugagaacaaccacagucaccggcaagauuauccaugaaugguguugccggagcuguacgcugcccccucuucgcuucagaggggaggacggaugcugguacggcauggagauccggcccgugaaagaaaaggaggaaaaucucguuaagucuaugguguccgcugggagcggagaggucgacuccuuuucucugggccugcucuguauuagcaucaugauugaagaggugaugagaucccgcuggucucggaaaaugcugaugacagggacccuugccguuuucuuucugcucaucaugggacagcugacauggaacgaucugauuagacuuugcaucauggugggcgccaaugcuagcgaccgcaugggcauggggaccaccuaucuggcccucauggcgacauucaagaugagaccgauguuugcugucggacugcucuuccggcgccugacguccagagaggugcuucugcucaccauuggccugucucugguggccagcgucgaacuuccuaacucccuggaggaacucggggauggacuggccaugggcaucaugauccucaaacugcuuacagacuuucaaagccaccagcugugggcuacccuccugucuaugacauucauuaagaccacguuuucccugcauuacgccuggaaaacaauggcuaugguucuuagcaucgugucucuguucccccucugucuguccaccaccagccagaagacaaccuggcuccccgugcugcuugggucucugggaugcaagccucugacaauguuucucauugccgagaauaaaaucuggggccggaaguccuggccgcugaacgaaggcauuauggcggucgggaucgugagcauccuucuguccagccuccugaaaaacgauguuccccucgccggaccucugauugcuggcgggaugcuuaucgccuguuaugugauuucuggaagcuccgcugaccugucucuggagaaggccgccgaggucagcugggaagaggaagcugagcacuccggcgcgucucauaauauccucguggaaguucaggaugacgggacgaugaaaauuaaggaugaggagcgcgacgauacccugacaauccuucugaaagccacccuccuggcugugagcggagucuacccccucuccaucccugccacacuguucgugugguauuucuggcaaaagaagaaacagagaucuggcguccuuugggacacccccagcccucccaagguggaacgggccguucuggaugacggcauuuaccgcaucaugcagagagggcugcucggacggucccaggugggcgucgggguguuucaagagaacguuuuccacacgauguggcacgugacccgcggagcuguccugauguaucagggcaaaagacuugaaccgagcugggccucugugaagaaagaccugauuuccuacgggggaggcuggcggcuccagggcagcuggaauacaggggaggaggugcagguuaucgcggucgaaccuggaaagaaccccaagaaugugcaaaccgcuccuggcacauuuaaaacccccgagggggaagugggagccauugcccuggauuucaagccgggcacaucuggguccccuaucgucaacagagagggaaaaauugugggccucuacggcaaugggguugugacgaccagcggaacauaugucuccgcuaucgcccaggcgaaggcuucucaggaaggcccccugccugagaucgaggacgaaguguuucgcaaacggaaccuuaccauuauggaucugcaucccgggagcggaaagaccagacgcuaccugcccgccaucguucgggaggccauuaagagaaaaaugcgcacacucauccuggcuccuacgcggguggucgccuccgaaauggcugaggcccuuaagggcaugccgauuagauaucaaaccacagcggugaaaagcgaacacaccgggaaggagaucguugaccugaugugccaugccacauucaccaugcgccuccugucucccgugcgggucccuaauuacaacaugaucauuauggaugaggcucacuuuacggaccccuccagcaucgccgcuagaggcuauauuucuacacgggugggaaugggcgaagccgccgcuaucuucaugaccgcgaccccucccgggagcguggaggccuuuccucaguccaaugcugucauucaggaugaagagcgcgacaucccggaaagaucuuggaacagcggauacgaguggaucacagauuuccccggcaaaaccguuugguuugugccuuccauuaaggccgggaaugacaucgccaacugucugcggaagaauggaaaacgcgugauucagcucucuagaaagacauucgauaccgaguaucaaaaaacgaagaacaacgacugggacuacgucgugacaaccgauaucagcgaaaugggcgcuaauuuccgggccgacagaguuauugauccccgccggugccuuaaaccugugauccugaaggacgggcccgagagagucauucuggcgggcccgaugccugugacaguugcuuccgccgcccagcgccggggaagaaucggccgcaaccauaauaaggaaggggaucaguacaucuauaugggacagccccucaacaaugacgaggaucacgcucacuggaccgaggccaaaaugcugcuugacaacauuaauacgcccgaaggcaucauuccugcgcuguuugagcccgaacgggagaagagcgccgcuaucgauggggaauacagacuccgcggagaggccagaaaaaccuucguggagcugaugcggcgcggcgaccugccugucuggcucucuuauaagguggcuuccgaaggguuucaauacagcgauagacgguggugcuucgacggcgagcgcaacaaucagguccuugaagagaacauggauguggaaauuuggacaaaagagggagagagaaagaaacugcggccgagauggcuggacgcccgcaccuauuccgacccccucgcucugcgggaauuuaaggaguucgccgcgggcagacgcucuguuagcggggaucuuauccuggaaaucggaaagcucccucagcaucugacacagcgggcccaaaaugcucuggacaaccucgugaugcuucacaauuccgagcagggcgggagagccuaccggcaugcuauggaagagcugcccgauaccauugagacacugaugcuccuggcccuuaucgccgugcugaccggaggcgucacgcucuuuuuccugucuggcaaagggcugggaaagacaagcauuggccuccuuuguguuauggcuuccagcgcgcugcuguggauggccucuguggaaccucacuggaucgcugccuccauuauccucgaguuuuuccugauggugcuucugauccccgaaccggaccgccagagaaccccucaggauaaccaacucgccuaugucgugauugggcugcuguuuaugauccucaccguugcugccaaugagaugggacuucuggagacaaccaaaaaggaccugggcauugggcacguggcggucgaaaaccaucaccaugccgcuaugcucgauguggaccugcaccccgccagcgcuuggacacuuuacgccgucgcgacgaccaucauuacaccuaugaugcggcauaccaucgagaacacaaccgccaauauuucucugacggcuaucgccaaccaggcugccauccucaugggacuggauaaaggcuggcccauuuccaagauggacaucggcgugccucugcucgcucuugggugcuacagccagguuaauccccugacccugacagccgcggugcucaugcuggucgcccacuaugcuauuaucggaccgggccuucaagccaaggcuacccgcgaagcccagaaaagaacagccgcggggauuaugaagaacccuaccaucgauggaaucguggcuauugaccuggaucccguuguguacgacgccaaauucgagaagcagcucggccagaucaugcugcugauucucuguacgucucaaauccuucugaugcggacaaccugggcucugugcgaaagcauuacacucgccaccgggccccugaccacacuuugggagggauccccuggcaaauuuuggaauacgaccaucgccgucucuauggcuaacaucuuccgcggcagcuaucuggccggggcgggacucgccuucucccugaugaagagccugggcgggggaagacggggcacaggggcucagggagagacccucggcgaaaaguggaaacgccagcuuaaucagcuguccaagucugaguuuaacacauacaaaagaagcggcauuauggaaguggaccgguccgaggccaaggaagggcugaaaagaggagagaccacgaagcacgcugugucucgcggcacagccaagcuccggugguucguugagagaaaucuggucaaaccggaagggaaggugaucgaucuuggauguggccgcgggggauggagcuauuacugcgcgggccugaaaaaggugaccgaggucaaaggcuauaccaaggggggacccggccaugaagagccuauucccauggccacauacggguggaaccucguuaaacugcacuccggaaaggacguguuuuucaucccucccgaaaagugugauacccugcucugcgacauuggcgagucuagcccuaauccgacaaucgaggaagggcggacgcuuagagugcugaaaauggucgagcccuggcugcgcggaaaccaauuuuguauuaagauccucaauccuuacaugcccuccgugguugaaacccuggagcagaugcagcggaaacauggcggcaugcuugugagaaacccucugagccgcaauucuacacacgagauguauugggucuccugcgggaccggaaacaucgugagcgcuguuaauaugacaucucggaugcuccugaacagauucaccauggcccaccgcaagcccacguacgaacgggauguggaccugggcgcugggaccagacaugucgccguggagccggaaguggcuaaccucgauauuaucggacagcgcauugagaauaucaaacacgaacauaaguccacauggcacuaugacgaggauaacccuuacaagaccugggccuaucauggcagcuacgaggucaaacccucuggguccgcgagcuccaugguuaauggaguggugaagcugcuuacaaaacccugggacgucauuccuauggugacccaaaucgccaugacagauaccacgcccuuuggccagcagagaguuuucaaggaaaaaguggacacacggaccccuaaggcuaagcgcggcaccgcccaaaucauggaggucacagcuagauggcuguggagcuuucucucucggaacaaaaagccgagaauuuguacgcgggaagaguucacccgcaaagugagaagcaaugccgccaucggggcgguuuuuguggacgaaaaccaguggaauuccgcuaaggaggccgucgaggaugaccgguucugggaucuggugcaccgcgaaagagagcuucacaaacagggaaagugcgccacaugcguuuauaacaugaugggcaagcgggaaaaaaagcugggggaguuuggaaaagcuaagggcucucgcgccauuugguacauguggcucggggcuagauuccuggaauucgaggcccugggcuuuaugaaugaggaccauugguucagccgggaaaacucccucucuggaguggagggcgaagggcugcacaaacuuggauacauccugcgcgauauuagcaagauccccggcgggaauauguaugcggacgauaccgccggaugggacacaagaaucaccgaggaugaccuccagaacgaggcuaaaauuacagauaucauggaaccugagcaugcccugcuugcuaaguccauuuuuaagcugaccuaccaaaauaaagucgugcggguccagcgccccgccaagaacggcacggugauggacguuaucucuagacgggaucagcgcgggagcggccaggugggaaccuauggccucaauacauucaccaacauggaagcgcaacugauuagacagauggaguccgaagagaucuuuagcccuaacgagcuggaaacacccaaucucgccgagcggguccuggacuggcuugaaaaauacgggguggagagacugaagcgcauggcuaucucuggagacgauugugugguuaaaccgauugacgaucgguucgccaccgcucucacggcccugaacgacaugggcaaggugagaaaggauaucccucagugggaacccuccaaaggguggaaugacuggcagcaagucccuuuuugcagccaccacuuccaucagcuuauuaugaaggauggacgcgagaucgugguucccugucggaaccaggacgagcuggugggcagagcucgcgucucucagggggccggcuggucccuccgggaaacagcgugccugggaaaaagcuaugcccaaauguggcagcugauguacuuucacagacgcgaucuccggcuggcugccaaugccauuuguuccgcugugccugucgacugggugcccaccucuagaacaaccuggagcauccaugcccaccaucaguggaugacgaccgaggauaugcuuuccguuuggaaccgcguguggauugaagagaauccguggauggaagacaagacacgggucagcucuugggaggacgugccuuaucugggcaaaagagaggaucaauggugcgggucccucaucggacugaccgcgcgggcuacaugggccaccaacauccagguugccauuaaucaggugagacgccuuaucggcaacgaaaauuacagcgacuacaugacaucuaugaagcgguucaagaacgagagcgaacccgagggggcucugugguga

SEQ ID NO: 19385 - RNA, 9879 nt, Artificial Sequence
  derived and/or modified CDS sequence (opt5) from DENV-1__HQ891315__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccccccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacugaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggagcacaaauacucuuggaagaauuggggaaaggccaaaaucauuggcgcugacgugcagaacagcaccuuuaucaucgaugggccuaauacccccgaauguuccgacgaucagagagcguggaacauuugggaggucgaggacuauggauucggcaucuuuacaaccaauauuuggcugaagcuucgcgauagcuacacgcagguuugcgaccaccggcucaugucugccgcuaucaaagauuccaaggccgugcaugccgacaugggcuauuggauugaaagcgagaaaaacgaaacauggaagcuggcuagagccucuuucaucgaggugaagaccuguaucuggccuaaaucccacacacuguggagcaaugggguccucgaaucugagaugauuauccccaagauuuacggaggcccgaucagccaacauaacuaucgcccuggguacuucacccagacagcgggacccuggcaccugggcaaacuugagcuggauuuugaccucugcgaagggaccacggugguuguggaugagcacugcggaaaucggggcccuucccugagaaccacaaccgucacaggcaagauuauccaugaaugguguugccggagcuguacccugcccccucuucgcuucagaggggaggacggaugcugguacggcauggagauccggcccgugaaagaaaaggaggaaaaccucguuaagucuauuguguccgcugggagcggagaggucgacuccuuuucucugggccugcucuguaucagcauuaugaucgaagaggugaugagaucccgcuggucucggaaaaugcugaugacggggacacuugccguuuucuuucugcucauuaugggacagcugaccuggaaugaucugaucagacuuugcauuauggugggcgccaacgcuagcgaccgcaugggcauggggacaaccuaucuggcccucauggcgaccuucaagaugagaccgauguuugcugucggacugcucuuccggcgccugacauccagagaggugcuucugcucacgaucggccugucucugguggccagcgucgaacuuccuaauucccuggaggaacucggggauggacuggccaugggcaucaugauucucaaacugcuuaccgacuuucaaagccaccagcugugggcuacacuccugucuaugaccuucaucaagacaaccuuuucccugcauuacgccuggaaaacgauggcuaugguucuuagcauugugucucuguucccccucugucuguccacaaccagccagaagaccacauggcuccccgugcugcuugggucucugggaugcaagccucugaccauguuucucaucgccgagaacaaaauuuggggccggaaguccuggccgcugaacgaaggcaucauggcggucgggaucgugagcauucuucuguccagccuccugaaaaaugauguuccccucgccggaccucugaucgcuggcgggaugcuuauugccuguuaugugaucucuggaagcuccgcugaccugucucuggagaaggccgccgaggucagcugggaagaggaagcugagcacuccggcgcgucucauaacauucucguggaaguucaggaugacgggacaaugaaaaucaaggaugaggagcgcgacgauacgcugaccauccuucugaaagccacacuccuggcugugagcggagucuacccccucuccauuccugccacccuguucgugugguauuucuggcaaaagaagaaacagagaucuggcguccuuugggacacacccagcccucccaagguggaacgggccguucuggaugacggcaucuaccgcauuaugcagagagggcugcucggacggucccaggugggcgucgggguguuucaagagaauguuuuccacaccauguggcacgugacgcgcggagcuguccugauguaucagggcaaaagacuugaaccgagcugggccucugugaagaaagaccugaucuccuacgggggaggcuggcggcuccagggcagcuggaacaccggggaggaggugcagguuauugcggucgaaccuggaaagaaucccaagaacgugcaaacagcuccuggcaccuuuaaaacacccgagggggaagugggagccaucgcccuggauuucaagccgggcaccucuggguccccuauugucaauagagagggaaaaaucgugggccucuacggcaacgggguugugacaacgagcggaaccuaugucuccgcuaucgcccaggcgaaggcuucucaggaaggcccccugccugagauugaggacgaaguguuucgcaaacggaaucuuacaaucauggaucugcaucccgggagcggaaagaccagacgcuaccugcccgccauuguucgggaggccaucaagagaaaaaugcgcacccucauucuggcuccuacacggguggucgccuccgaaauggcugaggcccuuaagggcaugccgaucagauaucaaacgaccgcggugaaaagcgaacacacagggaaggagaucguugaccugaugugccaugccaccuucacaaugcgccuccugucucccgugcgggucccuaacuacaauaugauuaucauggaugaggcucacuuuaccgaccccuccagcauugccgcuagaggcuauaucucuacgcgggugggaaugggcgaagccgccgcuauuuucaugacagcgaccccucccgggagcguggaggccuuuccucaguccaacgcugucauccaggaugaagagcgcgacaucccggaaagaucuuggaauagcggauacgaguggauuaccgauuuccccggcaaaacaguuugguuugugccuuccaucaaggccgggaacgacauugccaauugucugcggaagaacggaaaacgcgugauccagcucucuagaaagaccuucgauacagaguaucaaaaaaccaagaacaaugacugggacuacgucgugacgacagauauuagcgaaaugggcgcuaacuuccgggccgacagaguuaucgauccccgccggugccuuaaaccugugauucugaaggacgggcccgagagagucauccuggcgggcccgaugccugugaccguugcuuccgccgcccagcgccggggaagaaucggccgcaaucauaacaaggaaggggaucaguacauuuauaugggacagccccucaauaacgacgaggaucacgcucacuggacagaggccaaaaugcugcuugacaauaucaacacccccgaaggcauuaucccugcgcuguuugagcccgaacgggagaagagcgccgcuauugauggggaauacagacuccgcggagaggccagaaaaacguucguggagcugaugcggcgcggcgaccugccugucuggcucucuuauaagguggcuuccgaaggguuucaauacagcgauagacgguggugcuucgacggcgagcgcaauaaccagguccuugaagagaauauggauguggaaaucuggaccaaagagggagagagaaagaaacugcggccgagauggcuggacgcccgcacauauuccgacccccucgcucugcgggaauuuaaggaguucgccgcgggcagacgcucuguuagcggggaucuuauccuggaaauuggaaagcucccucagcaucugacccagcgggcccaaaacgcucuggacaaucucgugaugcuucacaacuccgagcagggcgggagagccuaccggcaugcuauggaagagcugcccgauacaaucgagacccugaugcuccuggcccuuauugccgugcugacaggaggcgucacccucuuuuuccugucuggcaaagggcugggaaagacgagcaucggccuccuuuguguuauggcuuccagcgcgcugcuguggauggccucuguggaaccucacuggauugcugccuccaucauccucgaguuuuuccugauggugcuucugauucccgaaccggaccgccagagaacaccucaggauaaucaacucgccuaugucgugaucgggcugcuguuuaugauucucaccguugcugccaacgagaugggacuucuggagaccacaaaaaaggaccugggcaucgggcacguggcggucgaaaaccaucaccaugccgcuaugcucgauguggaccugcaccccgccagcgcuuggacccuuuacgccgucgcgacaacgauuaucaccccuaugaugcggcauacaauugagaauaccacagccaacaucucucugaccgcuaucgccaaucaggcugccauucucaugggacuggauaaaggcuggcccaucuccaagauggacauuggcgugccucugcucgcucuugggugcuacagccagguuaacccccugacgcugaccgccgcggugcucaugcuggucgcccacuaugcuaucauuggaccgggccuucaagccaaggcuacacgcgaagcccagaaaagaaccgccgcggggaucaugaagaauccuacaaucgauggaauuguggcuaucgaccuggaucccguuguguacgacgccaaauucgagaagcagcucggccagauuaugcugcugauccucuguaccucucaaauucuucugaugcggacgacaugggcucugugcgaaagcaucacccucgccacagggccccugaccacccuuugggagggauccccuggcaaauuuuggaacacaacgaucgccgucucuauggcuaauauuuuccgcggcagcuaucuggccggggcgggacucgccuucucccugaugaagagccugggcgggggaagacggggcaccggggcucagggagagacacucggcgaaaaguggaaacgccagcuuaaccagcuguccaagucugaguuuaauaccuacaaaagaagcggcaucauggaaguggaccgguccgaggccaaggaagggcugaaaagaggagagacaaccaagcacgcugugucucgcggcacggccaagcuccggugguucguugagagaaaccuggucaaaccggaagggaaggugauugaucuuggauguggccgcgggggauggagcuauuacugcgcgggccugaaaaaggugacagaggucaaaggcuauaccaaggggggacccggccaugaagagccuauccccauggccaccuacggguggaaucucguuaaacugcacuccggaaaggacguguuuuucauuccucccgaaaagugugauacacugcucugcgacaucggcgagucuagcccuaacccgaccauugaggaagggcggacacuuagagugcugaaaauggucgagcccuggcugcgcggaaaucaauuuuguaucaagauccucaacccuuacaugcccuccgugguugaaacgcuggagcagaugcagcggaaacauggcggcaugcuugugagaaauccucugagccgcaacucuacccacgagauguauugggucuccugcgggacaggaaauauugugagcgcuguuaacaugaccucucggaugcuccugaacagauucacaauggcccaccgcaagcccaccuacgaacgggauguggaccugggcgcugggacgagacaugucgccguggagccggaaguggcuaaucucgauaucauuggacagcgcaucgagaacauuaaacacgaacauaaguccaccuggcacuaugacgaggauaauccuuacaagacaugggccuaucauggcagcuacgaggucaaacccucuggguccgcgagcuccaugguuaacggaguggugaagcugcuuaccaaacccugggacgucaucccuauggugacacaaaucgccaugaccgauacaacccccuuuggccagcagagaguuuucaaggaaaaaguggacacgcggacaccuaaggcuaagcgcggcaccgcccaaauuauggaggucaccgcuagauggcuguggagcuuucucucucggaauaaaaagccgagaaucuguacacgggaagaguucacgcgcaaagugagaagcaacgccgccauuggggcgguuuuuguggacgaaaaucaguggaacuccgcuaaggaggccgucgaggaugaccgguucugggaucuggugcaccgcgaaagagagcuucacaaacagggaaagugcgccaccugcguuuauaauaugaugggcaagcgggaaaaaaagcugggggaguuuggaaaagcuaagggcucucgcgccaucugguacauguggcucggggcuagauuccuggaauucgaggcccugggcuuuaugaacgaggaccauugguucagccgggaaaauucccucucuggaguggagggcgaagggcugcacaaacuuggauacauucugcgcgauaucagcaagauccccggcgggaacauguaugcggacgauacagccggaugggacaccagaauuacagaggaugaccuccagaaugaggcuaaaaucaccgauauuauggaaccugagcaugcccugcuugcuaaguccaucuuuaagcugacauaccaaaacaaagucgugcggguccagcgccccgccaagaauggcaccgugauggacguuauuucuagacgggaucagcgcgggagcggccaggugggaacguauggccucaacaccuucacaaacauggaagcgcaacugaucagacagauggaguccgaagagaucuuuagcccuaaugagcuggaaacccccaaccucgccgagcggguccuggacuggcuugaaaaauacgggguggagagacugaagcgcauggcuauuucuggagacgauugugugguuaaaccgaucgacgaucgguucgccacagcucucaccgcccugaaugacaugggcaaggugagaaaggauauuccucagugggaacccuccaaaggguggaacgacuggcagcaagucccuuuuugcagccaccacuuccaucagcuuaucaugaaggauggacgcgagauugugguucccugucggaaucaggacgagcuggugggcagagcucgcgucucucagggggccggcuggucccuccgggaaacggcgugccugggaaaaagcuaugcccaaauguggcagcugauguacuuucacagacgcgaucuccggcuggcugccaacgccaucuguuccgcugugccugucgacugggugcccacaucuagaaccacauggagcauucaugcccaccaucaguggaugaccacggaggauaugcuuuccguuuggaaucgcguguggaucgaagagaacccguggauggaagacaagacccgggucagcucuugggaggacgugccuuaucugggcaaaagagaggaucaauggugcgggucccucaucggacugacagcgcgggcuaccugggccacaaauauucagguugccaucaaccaggugagacgccuuauuggcaaugaaaacuacagcgacuacaugaccucuaugaagcgguucaagaaugagagcgaacccgagggggcucugugguga

SEQ ID NO: 19386 - RNA, 9879 nt, Artificial Sequence
  derived and/or modified CDS sequence (opt5) from DENV-1__HQ891316__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccccccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacugaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggagcacaaauacucuuggaagaauuggggaaaggccaaaaucauuggcgcugacgugcagaacagcaccuuuaucaucgaugggccuaauacccccgaauguuccgacgaucagagagcguggaacauuugggaggucgaggacuauggauucggcaucuuuacaaccaauauuuggcugaagcuucgcgauagcuacacgcagguuugcgaccaccggcucaugucugccgcuaucaaagauuccaaggccgugcaugccgacaugggcuauuggauugaaagcgagaaaaacgaaacauggaagcuggcuagagccucuuucaucgaggugaagaccuguaucuggccuaaaucccacacacuguggagcaaugggguccucgaaucugagaugauuauccccaagauuuacggaggcccgaucagccaacauaacuaucgcccuggguacuucacccagacagcgggacccuggcaccugggcaaacuugagcuggauuuugaccucugcgaagggaccacggugguuguggaugagcacugcggaaaucggggcccuucccugagaaccacaaccgucacaggcaagauuauccaugaaugguguugccggagcuguacccugcccccucuucgcuucagaggggaggacggaugcugguacggcauggagauccggcccgugaaagaaaaggaggaaaaccucguuaagucuaugguguccgcugggagcggagaggucgacuccuuuucucugggccugcucuguauuagcaucaugauugaagaggugaugagaucccgcuggucucggaaaaugcugaugacggggacacuugccguuuucuuucugcucaucaugggacagcugaccuggaaugaucugauuagacuuugcaucauggugggcgccaacgcuagcgaccgcaugggcauggggacaaccuaucuggcccucauggcgaccuucaagaugagaccgauguuugcugucggacugcucuuccggcgccugacauccagagaggugcuucugcucacgauuggccugucucugguggccagcgucgaacuuccuaauucccuggaggaacucggggauggacuggccaugggcaucaugauccucaaacugcuuaccgacuuucaaagccaccagcugugggcuacacuccugucuaugaccuucauuaagacaaccuuuucccugcauuacgccuggaaaacgauggcuaugguucuuagcaucgugucucuguucccccucugucuguccacaaccagccagaagaccacauggcuccccgugcugcuugggucucugggaugcaagccucugaccauguuucucauugccgagaacaaaaucuggggccggaaguccuggccgcugaacgaaggcauuauggcggucgggaucgugagcauccuucuguccagccuccugaaaaaugauguuccccucgccggaccucugauugcuggcgggaugcuuaucgccuguuaugugauuucuggaagcuccgcugaccugucucuggagaaggccgccgaggucagcugggaagaggaagcugagcacuccggcgcgucucauaacauccucguggaaguucaggaugacgggacaaugaaaauuaaggaugaggagcgcgacgauacgcugaccauccuucugaaagccacacuccuggcugugagcggagucuacccccucuccaucccugccacccuguucgugugguauuucuggcaaaagaagaaacagagaucuggcguccuuugggacacacccagcccucccaagguggaacgggccguucuggaugacggcauuuaccgcaucaugcagagagggcugcucggacggucccaggugggcgucgggguguuucaagagaauguuuuccacaccauguggcacgugacgcgcggagcuguccugauguaucagggcaaaagacuugaaccgagcugggccucugugaagaaagaccugauuuccuacgggggaggcuggcggcuccagggcagcuggaacaccggggaggaggugcagguuaucgcggucgaaccuggaaagaaucccaagaacgugcaaacagcuccuggcaccuuuaaaacacccgagggggaagugggagccauugcccuggauuucaagccgggcaccucuggguccccuaucgucaauagagagggaaaaauugugggccucuacggcaacgggguugugacaacgagcggaaccuaugucuccgcuaucgcccaggcgaaggcuucucaggaaggcccccugccugagaucgaggacgaaguguuucgcaaacggaaucuuacaauuauggaucugcaucccgggagcggaaagaccagacgcuaccugcccgccaucguucgggaggccauuaagagaaaaaugcgcacccucauccuggcuccuacacggguggucgccuccgaaauggcugaggcccuuaagggcaugccgauuagauaucaaacgaccgcggugaaaagcgaacacacagggaaggagaucguugaccugaugugccaugccaccuucacaaugcgccuccugucucccgugcgggucccuaacuacaauaugaucauuauggaugaggcucacuuuaccgaccccuccagcaucgccgcuagaggcuauauuucuacgcgggugggaaugggcgaagccgccgcuaucuucaugacagcgaccccucccgggagcguggaggccuuuccucaguccaacgcugucauucaggaugaagagcgcgacaucccggaaagaucuuggaauagcggauacgaguggaucaccgauuuccccggcaaaacaguuugguuugugccuuccauuaaggccgggaacgacaucgccaauugucugcggaagaacggaaaacgcgugauucagcucucuagaaagaccuucgauacagaguaucaaaaaaccaagaacaaugacugggacuacgucgugacgacagauaucagcgaaaugggcgcuaacuuccgggccgacagaguuauugauccccgccggugccuuaaaccugugauccugaaggacgggcccgagagagucauucuggcgggcccgaugccugugaccguugcuuccgccgcccagcgccggggaagaaucggccgcaaucauaacaaggaaggggaucaguacaucuauaugggacagccccucaauaacgacgaggaucacgcucacuggacagaggccaaaaugcugcuugacaauauuaacacccccgaaggcaucauuccugcgcuguuugagcccgaacgggagaagagcgccgcuaucgauggggaauacagacuccgcggagaggccagaaaaacguucguggagcugaugcggcgcggcgaccugccugucuggcucucuuauaagguggcuuccgaaggguuucaauacagcgauagacgguggugcuucgacggcgagcgcaauaaccagguccuugaagagaauauggauguggaaauuuggaccaaagagggagagagaaagaaacugcggccgagauggcuggacgcccgcacauauuccgacccccucgcucugcgggaauuuaaggaguucgccgcgggcagacgcucuguuagcggggaucuuauccuggaaaucggaaagcucccucagcaucugacccagcgggcccaaaacgcucuggacaaucucgugaugcuucacaacuccgagcagggcgggagagccuaccggcaugcuauggaagagcugcccgauacaauugagacccugaugcuccuggcccuuaucgccgugcugacaggaggcgucacccucuuuuuccugucuggcaaagggcugggaaagacgagcauuggccuccuuuguguuauggcuuccagcgcgcugcuguggauggccucuguggaaccucacuggaucgcugccuccauuauccucgaguuuuuccugauggugcuucugauccccgaaccggaccgccagagaacaccucaggauaaucaacucgccuaugucgugauugggcugcuguuuaugauccucaccguugcugccaacgagaugggacuucuggagaccacaaaaaaggaccugggcauugggcacguggcggucgaaaaccaucaccaugccgcuaugcucgauguggaccugcaccccgccagcgcuuggacccuuuacgccgucgcgacaacgaucauuaccccuaugaugcggcauacaaucgagaauaccacagccaacauuucucugaccgcuaucgccaaucaggcugccauccucaugggacuggauaaaggcuggcccauuuccaagauggacaucggcgugccucugcucgcucuugggugcuacagccagguuaacccccugacgcugaccgccgcggugcucaugcuggucgcccacuaugcuauuaucggaccgggccuucaagccaaggcuacacgcgaagcccagaaaagaaccgccgcggggauuaugaagaauccuacaaucgauggaaucguggcuauugaccuggaucccguuguguacgacgccaaauucgagaagcagcucggccagaucaugcugcugauucucuguaccucucaaauccuucugaugcggacgacaugggcucugugcgaaagcauuacccucgccacagggccccugaccacccuuugggagggauccccuggcaaauuuuggaacacaacgaucgccgucucuauggcuaauaucuuccgcggcagcuaucuggccggggcgggacucgccuucucccugaugaagagccugggcgggggaagacggggcaccggggcucagggagagacacucggcgaaaaguggaaacgccagcuuaaccagcuguccaagucugaguuuaauaccuacaaaagaagcggcauuauggaaguggaccgguccgaggccaaggaagggcugaaaagaggagagacaaccaagcacgcugugucucgcggcacggccaagcuccggugguucguugagagaaaccuggucaaaccggaagggaaggugaucgaucuuggauguggccgcgggggauggagcuauuacugcgcgggccugaaaaaggugacagaggucaaaggcuauaccaaggggggacccggccaugaagagccuauucccauggccaccuacggguggaaucucguuaaacugcacuccggaaaggacguguuuuucaucccucccgaaaagugugauacacugcucugcgacauuggcgagucuagcccuaacccgaccaucgaggaagggcggacacuuagagugcugaaaauggucgagcccuggcugcgcggaaaucaauuuuguauuaagauccucaacccuuacaugcccuccgugguugaaacgcuggagcagaugcagcggaaacauggcggcaugcuugugagaaauccucugagccgcaacucuacccacgagauguauugggucuccugcgggacaggaaauaucgugagcgcuguuaacaugaccucucggaugcuccugaacagauucacaauggcccaccgcaagcccaccuacgaacgggauguggaccugggcgcugggacgagacaugucgccguggagccggaaguggcuaaucucgauauuaucggacagcgcauugagaacaucaaacacgaacauaaguccaccuggcacuaugacgaggauaauccuuacaagacaugggccuaucauggcagcuacgaggucaaacccucuggguccgcgagcuccaugguuaacggaguggugaagcugcuuaccaaacccugggacgucauuccuauggugacacaaaucgccaugaccgauacaacccccuuuggccagcagagaguuuucaaggaaaaaguggacacgcggacaccuaaggcuaagcgcggcaccgcccaaaucauggaggucaccgcuagauggcuguggagcuuucucucucggaauaaaaagccgagaauuuguacacgggaagaguucacgcgcaaagugagaagcaacgccgccaucggggcgguuuuuguggacgaaaaucaguggaacuccgcuaaggaggccgucgaggaugaccgguucugggaucuggugcaccgcgaaagagagcuucacaaacagggaaagugcgccaccugcguuuauaauaugaugggcaagcgggaaaaaaagcugggggaguuuggaaaagcuaagggcucucgcgccauuugguacauguggcucggggcuagauuccuggaauucgaggcccugggcuuuaugaacgaggaccauugguucagccgggaaaauucccucucuggaguggagggcgaagggcugcacaaacuuggauacauccugcgcgauauuagcaagauccccggcgggaacauguaugcggacgauacagccggaugggacaccagaaucacagaggaugaccuccagaaugaggcuaaaauuaccgauaucauggaaccugagcaugcccugcuugcuaaguccauuuuuaagcugacauaccaaaacaaagucgugcggguccagcgccccgccaagaauggcaccgugauggacguuaucucuagacgggaucagcgcgggagcggccaggugggaacguauggccucaacaccuucacaaacauggaagcgcaacugauuagacagauggaguccgaagagaucuuuagcccuaaugagcuggaaacccccaaccucgccgagcggguccuggacuggcuugaaaaauacgggguggagagacugaagcgcauggcuaucucuggagacgauugugugguuaaaccgauugacgaucgguucgccacagcucucaccgcccugaaugacaugggcaaggugagaaaggauaucccucagugggaacccuccaaaggguggaacgacuggcagcaagucccuuuuugcagccaccacuuccaucagcuuauuaugaaggauggacgcgagaucgugguucccugucggaaucaggacgagcuggugggcagagcucgcgucucucagggggccggcuggucccuccgggaaacggcgugccugggaaaaagcuaugcccaaauguggcagcugauguacuuucacagacgcgaucuccggcuggcugccaacgccauuuguuccgcugugccugucgacugggugcccacaucuagaaccacauggagcauccaugcccaccaucaguggaugaccacggaggauaugcuuuccguuuggaaucgcguguggauugaagagaacccguggauggaagacaagacccgggucagcucuugggaggacgugccuuaucugggcaaaagagaggaucaauggugcgggucccucaucggacugacagcgcgggcuaccugggccacaaauauccagguugccauuaaccaggugagacgccuuaucggcaaugaaaacuacagcgacuacaugaccucuaugaagcgguucaagaaugagagcgaacccgagggggcucugugguga

SEQ ID NO: 19387 - RNA, 9879 nt, Artificial Sequence
  derived and/or modified CDS sequence (opt5) from DENV-1__JN054256__SS-prME
agcgugaccaugcugcucaugcugaugcccacagcccuugcuuuccaccugacgaccagagagggcgaaccucauaugaucgucuccaagcaggagcgggggaaaucucuccuguuuaagacaagcgccggaguuaacaugugcacccuuauugcgauggaccugggcgaacucugugaggauacaaugaccuacaaaugcccgcgcaucacagaagcugagcccgacgauguggacuguuggugcaaugccaccgauacgugggugaccuaugggacauguucccaaaccggagagcacagacgggacaagcgcucugucgcccuggcuccucaugugggccuggggcucgaaacaagaaccgagacguggaugagcuccgaaggagccuggaaacagauucagcggguugagacaugggcucugcgccaccccggcuucaccgugaucgcccuuuuucuggcgcaugccauuggcacaucuaucacccagaaggggaucauuuucauccuccugaugcuugucaccccuagcauggcuaugagaugcgugggaauuggcucccgggauuuuguugaggggcugagcggagccacauggguggacgucgugcucgaacacggcucuugugugacgaccauggcuaaggauaaacccacacuggacaucgagcugcucaagaccgaagucacaaacccugccguucugcgcaaacuuugcauugaggcgaagaucuccaauaccacgacagauagcagauguccgacccaaggggaagccacccugguggaggagcaggacgcuaacuucgugugccggcgcacauuugucgauagaggauggggcaauggcugugggcucuucggaaaaggcucucugcuuaccugcgccaaguuuaagugcgugacaaaacuggaagggaagauuguucaguacgagaaccucaaauauuccgugaucgucacggugcacaccggagaccagcaucaaguuggcaaugaaagcacagagcacgggaccacagcuaccaucacgccccaggccccuaccacagaaauucagcugaccgacuacggagcccugacacucgauuguucuccccggaccggccuggacuucacggagauggugcuucugacaaugaaggagaaauccuggcucguccauaagcagugguuucuggaucuuccucugcccuggaccagcggcgcuuccacaucucaagaaaccuggaaccgccaggaccuccuggugaccuucaaaacagcgcacgccaagaagcaggaggucgugguucuggggagccaagaaggagcuaugcacacggcccucaccggcgccacagagauccagaccuccgggacaaccacgauuuuugcuggacaucugaaaugcagacuuaagauggauaaacugacacucaagggcaugagcuaugugauguguaccgggucuuucaaacuggaaaaggaggucgccgagacccagcacggcacagugcugguucagaucaaguacgaaggaaccgacgcgccgugcaaaauuccuuucuccacacaagaugagaagggcgugacgcagaaugggcggcuuaucaccgcuaaccccaucgucacagacaaagaaaagccugugaauauugaggccgagccccccuuuggagaaagcuauaucgugauuggcgccggggagaaagcucucaagcugucuugguucaagaaaggaagcuccaucggcaagauguuugaagccaccgcuagaggggcccgccggauggcgauucugggcgauacagccugggacuucggaucuaucggcgggguuuuuaccagcgucggaaaacucgugcaucagaucuucggcacggcuuacggggugcuguuuuccggagucagcuggaccaugaagauuggcaucggggugcuucugacauggcucggccugaacucuagauccaccagccugucuaugacauguauugccguuggacuugugacccucuaccugggcgucauggugcaggcugauuccgggugcguuaucaauuggaaaggacgcgagcugaaguguggcagcgggauuuucgugacaaacgaaguccacaccuggacggagcaauauaaguuucaggccgacuccccuaaacggcucucugcggccaucggaaaggcuugggaggaaggcgugugcgggauuagaagcgccacacgccuggagaauaucauguggaaacagaucuccaacgaacuuaaccauauucugcucgagaaugacaugaagcugaccguuguggucggcgauguggcuggaauccuggcccagggcaaaaagaugauucggccgcaacccauggaacacaaauacucuuggaagaacugggggaaggccaaaaucauuggagcugacgugcagaauagcaccuucaucaucgauggcccuaacacacccgaguguuccgacgaucagagagcguggaauauuugggaggucgaagacuauggguuuggaaucuucaccacgaacauuuggcuuaagcuccgcgauagcuacacacagguuugcgaccaccggcugaugucugccgcuaucaaagauuccaaggccgugcaugccgacaugggcuauuggauugagagcgaaaaaaaugagaccuggaagcuggcuagagccucuuuuaucgaagugaagacauguaucuggccuaaaucccacacccucuggagcaacggcguccuggagucugagaugauuauccccaagauuuacgggggaccgaucagccaacauaauuaucgcccuggcuacuucacacagaccgcggggcccuggcaccuuggaaaacuggaacucgauuucgaccugugcgagggcacgaccgugguuguggaugaacacugcgggaaccggggaccuucccugagaacaaccacagucaccggcaagauuauccaugagugguguugccggagcuguacgcuucccccucuccgcuuuagaggcgaggacgggugcugguacggaauggaaauccggcccgugaaagagaaggaagagaaucugguuaagucuaugguguccgcuggcagcggggaagucgacuccuucucucugggacuccuguguauuagcaucaugauugaggaggugaugagaucccgcuggucucggaaaaugcuuaugacaggcacccuggccguuuuuuuccuccugaucauggggcagcugacauggaacgaucuuauuagacugugcaucauggugggagccaaugcuagcgaccgcaugggcaugggcaccaccuaucucgcccugauggcgacauuuaagaugagaccgauguucgcugucgggcuccuguuucggcgccuuacguccagagaagugcugcuccugaccauuggacugucucuuguggccagcgucgagcugccuaacucccucgaagagcugggcgaugggcucgccaugggaaucaugauccugaaacuucugauugacuuccaaagccaccagcucugggcuacacugcugucuaugaccuuuaucaagacaaccuucucccuucauuacgccuggaaaacgauggcuaugguucugagcauugugucucucuuuccccugugucucuccacaaccagccagaagaccacauggcugcccgugcuucugggcucucuggggugcaagccucucaccauguuccugaucgccgaaaauaaaauuuggggacggaaguccuggccgcuuaacgagggcaucauggcggucggcaucgugagcauucugcucuccagccugcucaaaaacgauguuccccuggccgggccucuuaucgcuggaggcaugcugauugccuguuaugugaucucugggagcuccgcugaccugucucucgagaaggccgccgaagucagcugggaggaagaggcugaacacuccggagcgucucauaauauucugguggagguucaggaugacggcacaaugaaaaucaaggaugaggaacgcgacgauacgcuuaccauccugcucaaagccacacugcucgcugugagcggggucuacccccuguccauuccugccacccuuuuugugugguauuucuggcaaaagaagaaacagagaucuggaguccugugggacacacccagcccucccaagguggagcgggccguucuggaugacggcaucuaccgcauuaugcagagaggccuccuggggcggucccaggugggagucggcguguuccaagaaaacguuuuucacaccauguggcacgugacgcgcggggcuguccuuauguaucagggaaaaagacuggagccgagcugggccucugugaagaaagaccucaucuccuacggcgggggauggcggcugcagggcagcuggaauaccggcgaggaagugcagguuauugcggucgagccugggaagaaccccaagaaugugcaaacagcuccuggaaccuucaaaacacccgaaggcgaggugggggccaucgcccucgauuuuaagccgggaaccucuggcuccccuauugucaacagagaagggaaaaucgugggacuguacggcaauggcguugugacaacgagcgggaccuaugucuccgcuaucgcccaggcgaaggcuucucaggagggaccccuuccugagauugaagacgagguguuccgcaaacggaaccugacaaucauggaucugcaucccggcagcgggaagaccagacgcuaccuccccgccauuguucgggaagccaucaagagaaaaaugcgcacccugauucuugcuccuacacggguggucgccuccgagauggcugaagcccugaagggaaugccgaucagauaucaaacgaccgcggugaaaagcgagcacacaggcaaggagaucguugaccucaugugccaugccaccuuuacaaugcgccugcugucucccgugcgggucccuaauuacaacaugauuaucauggaugaagcucacuucaccgaccccuccagcauugccgcuagaggguauaucucuacgcgggugggcaugggagaggccgccgcuauuuuuaugacagcgaccccucccggcagcguggaagccuucccucaguccaaugcugucauccaggaugaggaacgcgacaucccggagagaucuuggaacagcggguacgaguggauuaccgauuuucccggaaaaacaguuugguucgugccuuccaucaaggccggcaaugacauugccaacugucuccggaagaaugggaaacgcgugauccagcuuucuagaaagaccuuugauacagaauaucaaaaaaccaagaacaacgacugggacuacgucgugacgacagauauuagcgagaugggagcuaauuuccgggccgacagaguuaucgauccccgccggugccugaaaccugugauucugaaggacggccccgaaagagucauccucgcggggccgaugccugugaccguugcuuccgccgcccagcgccggggcagaaucggacgcaaccauaauaaggagggcgaucaguacauuuauauggggcagccccugaacaaugacgaggaucacgcucacuggacagaagccaaaaugcuucuggacaacaucaauacccccgagggaauuaucccugcgcucuucgaacccgagcgggaaaagagcgccgcuauugauggcgaguacagacugcgcggggaggccagaaaaacguuuguggaacugaugcggcgcggagaccucccugucuggcuuucuuauaagguggcuuccgagggcuuccaauacagcgauagacgguggugcuuugacggggaacgcaacaaucagguccuggaggaaaacauggauguggagaucuggaccaaagagggcgaaagaaagaaacugcggccgagauggcucgacgcccgcacauauuccgacccccuggcucuucgggaguucaaggaauuugccgcgggaagacgcucuguuagcggcgaucugauccucgagauugggaagcugccucagcaucugacccagcgggcccaaaaugcucucgacaaccuugugaugcugcacaauuccgaacagggaggcagagccuaccggcaugcuauggaggagcugcccgauacaaucgaaacccucaugcugcuugcccugauugccgugcucacagggggagucacccuguucuuucugucuggcaaaggccucgggaagacgagcaucggacuucuguguguuauggcuuccagcgcgcugcucuggauggccucuguggagccucacuggauugcugccuccaucauccuggaauucuuucuuauggugcugcucauucccgagccggaccgccagagaacaccucaggauaaccaacuggccuaugucgugaucggccugcucuucaugauucuuaccguugcugccaaugagauggggcugcuggaaaccacaaaaaaggaccucggaaucggccacguggcggucgagaaccaucaccaugccgcuaugcuggauguggaccuucaccccgccagcgcuuggacccuguacgccgucgcgacaacgauuaucaccccuaugaugcggcauacaauugaaaacaccacagccaauaucucucucaccgcuaucgccaaccaggcugccauucugauggggcuggauaaaggauggcccaucuccaagauggacauuggcgugccucuccuugcucugggcugcuacagccagguuaauccccugacgcucaccgccgcggugcugaugcuugucgcccacuaugcuaucauugggccgggacugcaagccaaggcuacacgcgaggcccagaaaagaaccgccgcgggcaucaugaagaacccuacaaucgaugggauuguggcuaucgaccucgaucccguuguguacgacgccaaauuugaaaagcagcugggacagauuaugcugcucauccuuuguaccucucaaauucugcugaugcggacgacaugggcucucugcgagagcaucacccuggccacaggcccccuuaccacccugugggagggguccccuggaaaauucuggaauacaacgaucgccgucucuauggcuaacauuuuucgcggcagcuaucucgccggcgcggggcuggccuucucccugaugaagagccucggaggcgggagacggggaaccggcgcucagggggaaacacuuggagagaaguggaaacgccagcugaaucagcuguccaagucugaauucaacaccuacaaaagaagcggcaucauggagguggaccgguccgaagccaaggagggccucaaaagaggggagacaaccaagcacgcugugucucgcggaacggccaagcugcggugguuuguugaaagaaaucuugucaaaccggagggcaaggugauugaucugggguguggacgcggcggguggagcuauuacugcgcgggacucaaaaaggugacagaagucaaaggcuauaccaagggcgggcccggacaugaggaaccuauccccauggccaccuacggcuggaaccugguuaaacugcacuccgggaaggacguguucuuuauuccucccgagaagugugauacacuccuuugcgacaucggagagucuagcccuaauccgaccauugaagagggccggacacugagagugcugaaaauggucgaacccuggcuccgcgggaaccaauucuguaucaagauccugaauccuuacaugcccuccgugguugagacgcuugagcagaugcagcggaaacauggaggcaugcuggugagaaacccucucagccgcaauucuacccacgaaauguauugggucuccugcggcacagggaacauugugagcgcuguuaauaugaccucucggaugcugcugaacagauuuacaauggcccaccgcaagcccaccuacgagcgggauguggaccucggagcuggcacgagacaugucgccguggaaccggagguggcuaaccuggauaucauugggcagcgcaucgaaaauauuaaacacgagcauaaguccaccuggcacuaugacgaggauaacccuuacaagacaugggccuaucauggaagcuacgaagucaaacccucuggcuccgcgagcuccaugguuaaugggguggugaagcuucugaccaaacccugggacgucaucccuauggugacacaaaucgccaugaccgauacaacccccuucggacagcagagaguuuuuaaggagaaaguggacacgcggacaccuaaggcuaagcgcggcaccgcccaaauuauggaagucaccgcuagauggcucuggagcuuccugucucggaacaaaaagccgagaaucuguacacgggaggaauuuacgcgcaaagugagaagcaaugccgccauuggcgcgguuuucguggacgagaaccaguggaauuccgcuaaggaggccgucgaagaugaccgguuuugggaucuugugcaccgcgagagagaacugcacaaacaggggaagugcgccaccugcguuuauaacaugaugggaaagcgggagaaaaagcucggcgaauucgggaaagcuaagggaucucgcgccaucugguacauguggcugggcgcuagauuucuggaguucgaggcccucggguucaugaaugaagaccauugguuuagccgggagaacucccugucuggcguggaaggagagggccuucacaaacugggguacauucuccgcgauaucagcaagauccccggaggcaauauguaugcggacgauacagccgggugggacaccagaauuacagaggaugaccugcagaacgaagcuaaaaucaccgauauuauggagccugaacaugcccuucuggcuaaguccaucuucaagcucacauaccaaaauaaagucgugcggguccagcgccccgccaagaacggaaccgugauggacguuauuucuagacgggaucagcgcggcagcgggcaggugggcacguauggacugaauaccuuuacaaacauggaggcgcaacugaucagacagauggaauccgaggagaucuucagcccuaacgaacucgagacccccaaucuggccgaacggguccuugacuggcuggagaaauacggcguggaaagacucaagcgcauggcuauuucuggggacgauugugugguuaaaccgaucgacgaucgguuugccacagcucugaccgcccuuaacgacaugggaaaggugagaaaggauauuccucagugggagcccuccaaaggcuggaaugacuggcagcaagucccuuucugcagccaccacuuucaucagcugaucaugaaggaugggcgcgagauugugguucccugucggaaccaggacgaacucgugggaagagcucgcgucucucagggcgccggguggucccugcgggagacggcgugccugggcaaaagcuaugcccaaauguggcagcucauguacuuccacagacgcgaucugcggcuugcugccaaugccaucuguuccgcugugccugucgacugggugcccacaucuagaaccacauggagcauucaugcccaccaucaguggaugaccacggaagauaugcuguccguuuggaaccgcguguggaucgaggaaaauccguggauggaggacaagacccgggucagcucuugggaggacgugccuuaucucggaaaaagagaagaucaauggugcggcucccugaucgggcuuacagcgcgggcuaccugggccacaaacauucagguugccaucaaucaggugagacgccugauuggaaacgagaauuacagcgacuacaugaccucuaugaagcgguuuaagaacgaaagcgagcccgagggcgcucucugguga

SEQ ID NO: 19388 - RNA, 9879 nt, Artificial Sequence
  derived and/or modified CDS sequence (opt5) from DENV-1__JN054255__SS-prME
agcgugacaaugcugcugaugcugaugcccacagcccuugcuuuccaccugacgacccggggcggggagccucauaugaucguguccaagcaggaacggggaaagucucuccuguuuaagacaagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagauguccggaacaaccacaauuuuugcuggccaucugaaaugcagacuuaagauggauaaacugacccucaaggggaugagcuaugugauguguacgggcucuuucaaacuggagaaggaagucgccgagacacagcacggaaccgugcugguucagaucaaguacgagggcaccgacgcgccgugcaaaauuccuuucuccacacaagaugaaaagggggugacccagaacggacggcuuaucacagcuaaucccaucgucacggacaaagagaagccugugaacauugaagccgagccgcccuuuggcgagagcuauaucgugauuggggccggagaaaaagcucucaagcugucuugguucaagaaaggcagcuccaucgggaagauguuugaggccaccgcuagaggcgcccgccggauggcgauucugggagauacagccugggacuucggcucuaucgggggaguuuuuaccagcgucggcaaacucgugcaucagaucuucgggacagcuuacggagugcuguuuuccggcgucagcuggaccaugaagauugggaucggcgugcuucugacguggcucggacucaauucuagauccaccagccugucuaugacauguauugccguuggccuugugacccucuaccugggggucauggugcaggcugauuccggaugcguuaucaacuggaaaggccgcgaacugaagugugggagcggaauuuucgugacaaaugagguccacaccuggacagaacaauauaaguuucaggccgacuccccuaaacggcucucugcggccaucggcaaggcuugggaggagggggugugcggcauuagaagcgccacccgccuggaaaacaucauguggaaacagaucuccaacgagcuuaaucauauucugcucgaaaacgacaugaaguucacgguuguggucggagauguggcuggcauccuggcccaggggaaaaagaugauucggccgcaacccauggagcacaaauacucuuggaagaauuggggaaaggccaaaaucauuggcgcugacgugcagaacagcacauuuaucaucgaugggccuaauacccccgaauguuccgacgaucagagagcguggaacauuugggaggucgaggacuauggauucggcaucuuuaccacaaauauuuggcugaaacuucgcgauagcuacacccagguuugcgaccaccggcucaugucugccgcuaucaaagauuccaaggccgugcaugccgacaugggcuauuggauugaaagcgagaaaaacgaaacguggaagcuggcuagagccucuuucaucgaggugaagacauguaucuggccuaaaucccacacccuguggagcaaugggguccucgaaucugagaugauuauccccaagauuuacggaggcccgaucagccaacauaacuaucgcccuggguacuucacacagaccgcgggacccuggcaccugggcaaacuugagcuggauuuugaccucugcgaagggacaaccgugguuguggaugagcacugcggaaaucggggcccuucccugagaacgaccacagucaccggcaagauuauccaugaaugguguugccggagcuguacacugcccccucuucgcuucagaggggaggacggaugcugguacggcauggagauccggcccgugaaagaaaaggaggaaaaccucguuaagucuaugguguccgcugggagcggagaggucgacuccuuuucucugggccugcucuguauuagcaucaugauugaagaggugaugagaucccgcuggucucggaaaaugcugaugaccgggacgcuugccguuuucuuucugcucaucaugggacagcugacauggaaugaucugauuagacuuugcaucauggugggcgccaacgcuagcgaccgcaugggcauggggaccacauaucuggcccucauggcgaccuucaagaugagaccgauguuugcugucggacugcuguuccggcgccugaccuccagagaggugcuucugcucacaauuggccugucucugguggccagcgucgaacuuccuaauucccuggaggaacucggggauggacuggccaugggcaucaugauccucaaacugcuuacggacuuucaaagccaccagcugugggcuacccuccugucuaugacauucauuaagaccacauuuucccugcauuacgccuggaaaaccauggcuaugguucuuagcaucgugucucuguucccccucugucuguccacgacaagccagaagaccaccuggcuccccgugcugcuugggucucugggaugcaagccucugacaauguuucucauugccgagaacaaaaucuggggccggaaguccuggccgcugaacgaaggcauuauggcggucgggaucgugagcauccuucuguccagccuccugaaaaaugauguuccccucgccggaccucugauugcuggcgggaugcuuaucgccuguuaugugauuucuggaagcuccgcugaccugucucuggagaaggccgccgaggucagcugggaagaggaagcugagcacuccggcgcgucucauaacauccucguggaaguucaggaugacgggaccaugaaaauuaaggaugaggagcgcgacgauacacugacgauccuucugaaagccacccuccuggcugugagcggagucuacccccucuccaucccugccacacuguucgugugguauuucuggcaaaagaagaaacagagaucuggcguccuuugggacacccccagcccucccaagguggaaaaagccguucuggaugacggcauuuaccggaucaugcagcgcgggcugcucggaagaucccaggugggcgucgggguguuucaagagaauguuuuccacacaauguggcacgugacccggggagcuguccugauguaucagggcaagcgccuugaaccgagcugggccucugugaaaaaggaccugauuuccuacgggggaggcuggagacuccagggcagcuggaacacgggggaggaggugcagguuaucgcggucgaaccuggaaagaaucccaaaaacgugcaaaccgcuccuggcacauuuaagacccccgagggggaagugggagccauugcccuggauuucaaaccgggcacaucuggguccccuaucgucaaucgggagggaaagauugugggccucuacggcaacgggguugugaccacaagcggaacguaugucuccggcaucgcucaggccaaagcgucucaggaagggccccugccugagaucgaggacgaaguguuuagaaagcgcaaucuuaccauuauggaucugcaucccggaagcggcaagacacggagauaccugcccgcuaucguucgcgaggccauuaaacggaagaugagaacccucauccuggccccuacccgcguggucgcuuccgaaauggccgaggcucuuaaagggaugccgauucgguaucaaacaacggccgucaagagcgaacacaccggcaaagagaucguugaccugaugugccaugcgacauucaccaugagacuccugucucccgugcgcgucccuaacuacaauaugaucauuauggaugaggcccacuuuacagaccccuccagcaucgcugcccggggauauauuucuaccagagugggcaugggggaagcugccgccaucuucaugacggcuacaccucccggaagcguggaggcguuuccucaguccaacgccgucauucaggaugaggaacgggacaucccggaacgcucuuggaauagcggcuacgaguggaucaccgauuuccccgggaagaccguuugguuugugccuuccauuaaggcuggaaacgacaucgccaauugucugcgcaagaauggcaagcgggugauucagcucucucgcaaaacauucgauaccgaguaucaaaagaccaagaacaaugacugggacuacgucgugaccacggauaucagcgaaaugggggccaacuucagagcugaccggguuauugaucccagacgcugccuuaagccugugauccugaaggacggccccgagcgggucauucuggccggaccgaugccugugacaguugcguccgcugcccagagacgcggccggaucgggagaaaucauaacaaagaaggagaucaguacaucuauaugggccagccccucaauaacgacgagaaucacgcccacuggaccgaggcuaagaugcugcuugauaacauuaauacacccgaagggaucauuccugcccuguuugagcccgaacgcgagaaaagcgcggccaucgacggagaauaccggcucagaggcgaggcucgcaagaccuucguggagcugaugagaagaggggaucugccugucuggcucucuuauaaaguggccuccgaaggcuuucaauacagcgaccgcagauggugcuucgauggagagcggaacaaucagguccuugaagagaacauggacguggaaauuuggacgaaggagggcgagcgcaaaaagcugagaccgcgguggcuggaugcuagaaccuauuccgacccccucgcccugcgcgaauuuaaggaguucgcugccgggcggagaucuguuagcggagaccuuauccuggaaaucggcaaacucccucagcaucugacacagcgcgcgcaaaaugcccuggauaaccucgugaugcuucacaauuccgagcaagggggacgggcuuacagacaugccauggaggaacugcccgacaccauugagacacugaugcuccuggcucuuaucgccgugcugaccggcggcgucacacucuuuuuccugucugggaagggacugggcaaaaccagcauugggcuccuuuguguuauggccuccagcgcucugcuguggauggcgucuguggaaccucacuggaucgccgcuuccauuauccucgaguuuuuccugauggugcuucugauccccgaaccggaucggcagcgcacgccucaggacaaccaacucgccuaugucgugauuggacugcuguuuaugauccucacaguugccgcuaacgagaugggccuucuggagaccaccaagaaagaucuggggauuggacacguggccgucgaaaaucaucaccaugcggccaugcucgacaucgaucugcaccccgcuagcgccuggacacuuuacgcuguggccaccacaauuaucacgccuaugaugagacauaccauugagaacacaaccgcgaauaucucucugacagccaucgcuaaccaggccgcuauucucaugggccuggacaagggcuggcccaucuccaagauggauauuggggucccucugcucgcccuuggaugcuacagccaggugaauccccugacccugacggcugccguucucaugcugguggcgcacuaugccaucauuggcccggggcuucaagcuaaagccacccgggaagcucagaagcgcacagccgccggaaucaugaaaaacccuaccaucgacggcauugucgcgaucgaucuggaccccgugguuuacgaugcuaaguucgagaaacagcucgggcagauuaugcugcugauccucuguacaucucaaauucuucugaugagaaccacgugggcccugugcgaaagcaucacacucgcuaccggaccccugacaacccuuugggagggcuccccuggcaaguuuuggaauaccacaaucgccgugucuauggccaacauuuuccgggggagcuaucuggcuggagccggccucgcguucucccugaugaaaagccucgggggaggccgcagagggacgggagcccagggcgagacccucggcgaaaaauggaagcggcagcuuaaucagcuguccaaaucugaguuuaacacauacaagcgcagcgggaucauggaagucgacagauccgaggcuaaagaaggacugaagcggggcgagaccacaaagcacgccgugucuagagggaccgcuaaacuccgcugguucguggagcggaaucugguuaagccggaaggaaaagucauugaccuuggcugugggagaggaggcuggagcuauuacugcgccggccugaagaaagugacggaggugaagggguauacaaaaggaggccccgggcaugaggaaccuauccccauggcgaccuacggauggaaccucgucaagcugcacuccggcaaggauguguuuuucauuccucccgaaaaaugugacacccugcucugcgauaucggggagucuagcccuaauccgacaauugaggaaggacgcacccuucggguucugaagaugguggagcccuggcugagaggcaaccaauuuuguaucaaaauccucaauccuuacaugcccuccgucguggaaacacuggagcagaugcagcgcaagcauggcgggaugcuuguucggaacccucugagcagaaauucuacgcacgagauguauuggguguccugcggaaccggcaacauugucagcgccgugaacaugacaucucgcaugcuccugaaucgguucaccauggcucacagaaaacccacauacgaacgcgacguugaucugggggccggaacccggcauguggcugucgagccggaaguggccaaccucgacaucauuggccagagaaucgagaauauuaagcacgaacauaaguccacguggcacuaugaugaggacaacccuuacaaaaccugggcuuaucaugggagcuacgaggugaagcccucuggauccgccagcuccauggucaauggcaugguuaaacugcuuacaaagcccugggaugugaucccuauggugacccaaaucgcgaugacagacaccacacccuuuggccagcagcgcgucuucaaagaaaagguggauaccagaacgccuaaggccaaacgggggacagcucaaauuauggagguuaccgcccgcuggcuguggagcuuucucucuagaaacaagaaaccgcggaucuguaccagagaagaguucacacggaaggugcgcagcaaugcugccauuggagccgucuuuguggacgaaaaccaguggaacuccgcgaaagaggcuguugaggacgauagauucugggaccuggugcaccgggaacgcgagcuucacaagcagggcaagugcgccacgugcgucuauaacaugauggggaaaagagaaaagaaacugggagaguuuggcaaggccaaagggucucgggcuaucugguacauguggcucggcgcccgcuuccuggaguucgaggcucugggauuuaugaaugaggaucauugguucagcagagaaaacucccucucuggcguggagggggaaggacugcacaaacuuggcuacauucugcgggacaucagcaaaauccccgggggaaauauguaugccgaugacaccgcgggcugggauacacgcauuaccgaggacgaucuccagaacgaggccaagaucacagacauuauggaaccugagcaugcucugcuugccaaguccaucuuuaaacugaccuaccaaaauaagguugugagaguccagcggcccucuaaaaacgggacagugauggaugucauuagccgcagagaccagcggggcuccggacaggugggcaccuaugggcucaacacguucaccaauauggaagcucaacugauccgccagauggagagcgaagagaucuuuucuccuaacgagcuggaaacacccaaucucgccaagagaguucuggauuggcuugagaaauacggaguggaacggcugaagagaauggcgauuuccggcgacgacugugucgugaagccgaucgaugaccgcuucgccaccgcucucacagcccugaacgauauggggaaagugcggaaggacauuccucagugggagcccagcaaaggauggaaugauuggcagcaaguuccuuuuugcucucaccacuuccaucagcuuaucaugaaggacggcagagaaauugugguccccugucgcaaccaggaugagcugguggggcgggcuagaguuucccagggcgccggauggagccuccgcgagaccgcuugccugggcaaauccuaugcccaaauguggcagcugauguacuuucaccggagagaccuccgccuggcggccaaugcuaucuguucugccgugccugucgauugggugcccacgagccggacaaccugguccauucaugcccaccaucaguggaugacaaccgaagacaugcuuagcgucuggaacagaguguggaucgaggaaaauccguggauggaggauaagacgcgcguuucuuccugggaagacgugccuuaucuggggaagcgggaggaccaauggugcggaagccucaucggccugaccgcuagagccacaugggcgaccaacauucaggucgcuaucaaucaggugcggagacuuauugggaacgagaauuacucugauuacaugacaagcaugaaacgcuucaagaacgaauccgagcccgaaggagcccugugguga

SEQ ID NO: 19389 - RNA, 9879 nt, Artificial Sequence
  derived and/or modified CDS sequence (opt5) from DENV-1__KP406801__SS-prME
agcgugaccaugcugcucaugcugcuucccaccgcccuggcuuuccaccucacgacccggggcggggaaccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcauacaauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccaaggagaggcgacacucguggaagaacaggaugccaacuucgugugccggcgcaccuuugucgacagaggcuggggcaauggguguggacuguucggcaaagggagccuucugacaugcgcuaaguuuaagugcgugacgaaacucgagggaaagauuguucaguacgaaaaccugaaauauucugugaucgucaccgugcacacaggcgaucagcaucaaguugggaaugagaccacagaacacggaaccaucgccacgauuacaccccaggcuccuacauccgagauccagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggccagcaccucccaagagacauggaaucgccaggaucugcuggugaccuucaaaaccgcucacgcgaagaagcaggaagucgugguucucggaucucaagagggcgccaugcacacagcucuggccggggccacggaaauucagaugagcggaaccacaaccaucuuugcuggccaucuuaaaugcagacugaagauggacaaacucacacugaaggggguguccuaugucauguguaccggcagcuucaaacuggagaaggaaguggccgagacgcagcacggaacaguucuugugcaggucaaguacgagggcaccgaugcgccgugcaaaauuccuuucucuauccaagacgaaaagggggugacccagaacggacggcucaucacagcuaaucccauugccaccgauaaagagaagccugugaacaucgaaacagagccgcccuuuggcgaguccuauauuguuaucggggccggagaaaaagcucugaagcugagcugguucaagaaaggcucuagcauugggaagauguuugaggccacggcuagaggcgcccgccggauggcgauccucggagacaccgccugggauuucggcuccaucgggggagucuuuacaucugugggcaaacuggugcaucaggucuucgggaccgcuuacggagugcuuuuuagcggcguuuccuggacaaugaagauugggaucggcauucugcucaccuggcugggacugaauagcagaucuacgucccuuagcaugaccuguaucgccgugggcauggucacacucuaccugggggugaugguucaggcugacucuggaugcgugauuaacuggaaaggccgcgaacugaaguguggguccggaaucuucgucaccaacgaggugcacacauggaccgaacaauauaaguuucaggccgauagcccuaaacggcucuccgcggccauuggcaaggcuugggaggaggggguuugcggcaucagaucugccacacgccuggaaaauaucauguggaaacagauuagcaacgagcuuaaucauauccugcucgaaaacgacaugaaguucaccguggucgugggagacgcuaauggcauucugacgcaggggaaaaagaugauccggccgcaacccauggagcacaaauacuccuggaagucuuggggaaaggccaaaauuaucggcgccgauacacagaacaccaccuuuaucauugacgggccugauacacccgaauguccugacgaucagagagcuuggaauaucugggagguggaggacuauggauucggcauuuuuaccacgaacaucuggcugaaacuucgcgauagcuacacacagaugugcgaccaccggcucauguccgcggccauuaaagauagcaaggcuguccaugccgacaugggcuauuggaucgaaucugagaaaaaugaaaccuggaagcuggccagagcuuccuucaucgagguuaagacauguauuuggccccgcagccacacccuguggucuaacggggugcucgaauccgagaugaucauuccgaaaaucuacggaggcccuauuagccaacauaauuaucggcccggguacuucacacagaccgccggaccuuggcaccugggcaaacuugagcuggauuuugaccucugcgaagggacgaccguggucguggaugagcacugcggaaacagaggccccucucugcggacaaccacaguuaccggcaaaaucauccaugaaugguguugccgcagcuguacgcugccuccccuuagauucaagggggaggacggaugcugguacggcauggagauucggccggugaaagaaaaggaggaaaaucucgucagauccauggugagcgcggggucuggagagguugacuccuuuagccugggccugcucuguguguccaucaugauugaagaggucaugcgcucucgguggagcagaaagaugcugaugacagggacccuugcuguguucuuucugcucaucaugggacagcugacauggaacgaucugauucgccuuugcaucaugguuggcgccaauguguccgacagaaugggcauggggaccaccuaucuggcccucauggcuacauucaaaaugcggccuauguuugccgucggacuccuguuccgcagacugacgucucgggaggugcuucugcucaccauuggccugagccugguggcguccgucgaacuucccaacucucuggaggaacucggggauggacuggcuaugggcaucaugaugcucaagcugcuuacagacuuucaaagccaccagcuguggaccacacuccugucccugaccuucaucaaaacgacacuuagccuggauuacgccuggaagaccauugccaugguucucucuaucgugucccuguuuccccucugucugagcaccacaucucagaaaaccacauggcuuccugugcugcugggguccuucggaugcaagccgcucacgauguuucugauuaccgagaacaagaucuggggccgcagaagcuggccccuuaaugaaggcauuauggcugucgggaucgugucuauccugcucuccagccugcucaaaaacgacguuccucuggccggaccccuuauugcuggcgggaugcugaucgccuguuaugugauuuccggaagcucugcggaucugagccucgagaaggccgcugaggucuccugggaagaggaagccgagcauucuggcgcuagccacaauauccugguggaaguucaggacgaugggacaaugaaaauuaaggacgaggagcgggaugacacccuuacaauccugcucaaagccacccugcucgccguguccggagucuacccuaugucuauccccgcuacgcuguucgugugguauuucuggcaaaagaaaaagcagcgcagcggcguccuuugggauaccccuagcccucccgaaguggagagagcgguucuggacgacggcauuuaccggauccugcagcgcgggcuccugggaagaucucaggugggcgucgggguguuucaagauggaguuuuccauacaauguggcacgugacccggggcgccguccuuauguaucaggggaagagacuggaacccagcugggcuuccgugaaaaaggaccucauuagcuacggaggcggcuggcgcuuucaggggucuuggaacacaggagaggaggugcagguuaucgccgucgaacccggcaaaaauccuaagaacgugcaaaccacacccgggacguucaaaaccccggagggagaagugggcgccauugcucuggauuuuaagccugggacauccggaagccccaucgucaaucgggagggcaagauugugggccucuacgggaacggaguugugaccaccucuggcacauaugucuccgccaucgcgcaggcuaaagccagccaggaagggccucugcccgagaucgaggacgaaguguucaagaaaagaaaucuuacgauuauggaucugcaccccggauccggcaagacccgccgguaccugccugccaucguuagagaggcuauuaaacgcaagcuccggacacugauccuugccccgaccagaguggucgcgucugaaauggcugaggcccugaaggggaugcccauucgcuaucaaacaaccgccgugaaaagcgaacauacgggccgggagaucguugaccucaugugccacgcuacauuuaccaugagacugcuguccccugugcggguccccaacuacaauaugaucauuauggaugaggcccauuucaccgacccugcuagcaucgccgcgcgcggauauauuucuacaagagugggcaugggggaagccgcugccaucuuuaugaccgcuacacccccuggauccguggaggccuucccgcagagcaacgccgucauucaggaugaagaacgggacauccccgaacgcucuuggaauagcggcuacgauuggaucaccgacuuuccugggaagacgguuugguucgugcccuccauuaaaucuggaaacgacaucgcuaauugucucagaaagaacggcaaacgggugauucagcuuagcagaaagacauucgauaccgaguaucaaaagaccaagaacaaugacugggauuacgucgugaccacggacaucuccgagaugggggcgaacuuucgcgccgaucggguuauugacccuagacgcugccugaagcccgugauccugaaagauggcccggaacgggucauucucgcuggaccuaugcccgugaccguugccucugccgcucagagacgcggccggaucgggagaaaucagaacaaggagggagaccaguacaucuauaugggccaaccccugaauaacgaugaagaccacgcccauuggacagaggcgaaaaugcuucuggauaauauuaacaccccugaggggaucauucccgcucucuucgaaccugagcgcgaaaagagcgccgccaucgacggagaguacagacugcggggcgaagcucgcaagacauuuguggagcugaugagaagaggggaucucccggucuggcuuuccuauaaaguggccagcgagggcuuccaguacucugaccgcagauggugcuuugacggagaacggaauaaccagguccuggaggaaaauauggauguggagauuuggaccaaggaaggcgagcgcaagaaacugcgcccccgguggcucgacgcgagaacauauuccgauccucuggcccuucgcgaguucaaagaauuugcugccgggcggagaagcguuuccggagaccugauccucgagaucggcaagcugccccagcaccugacccuccgggcucaaaacgcccuugauaaucuggugaugcugcacaacucugaacaagggggaaaggcuuaccgccaugccauggaggaacucccugacacgauugagacacugaugcuucuggcgcucaucgccgugcugaccggcggcgucacccuguucuuucucagcgggaagggacuuggcaagacauccauugggcugcuguguguuauggcuucuagcgugcuccuguggauggccuccguggagccccacuggaucgcugccagcauuauccuugaguucuuucugaugguccuccugaucccggagccugauagacagcggacaccccaggacaaucaacuggccuaugugguuauuggacuccuuuucaugauccugacaguggcugcgaacgaaaugggccugcucgagacgaccaaaaaggaucuggggauuggacaugucguggccgagaaccaccaccaugcuacaaugcuugacaucgaucugcacccugccucugccuggacccucuacgcugucgccacaaccauuaucacgcccaugaugcgccauaccauugaaaauacaaccgcgaacaucucccugacagccaucgcuaaucaggccgcuauucugaugggccucgacaaaggcuggccuaucagcaagauggauauuggggugccccuucuggcccugggaugcuacucucagguuaacccgcucacccugacggcggccgugcuuaugcuggucgcucacuaugccaucauuggcccugggcuccaagcuaaagccacaagagaggcucagaagcggaccgccgcgggaaucaugaagaaucccacaguggacggcaucguugccauugaccuggaucccguggucuacgacgcuaaauuugaaaagcagcuggggcagaucaugcuccuuauucuguguaccucccaaauccugcucaugcgcaccacaugggcccugugcgagagcauuacgcuugcuaccggaccucugacaacccucugggaaggcucuccgggcaaauucuggaacacaaccaucgccgugagcauggccaauaucuucagaggguccuaucuggcgggagcuggccuggccuuuucucucaugaagucccuugggggaggccggcgcgggacgggagcucagggcgagacacugggcgagaaauggaagagacagcugaaccagcucuccaagagcgaguucaauaccuacaaacgguccgggauuauggagguggauagaucugaagccaaggagggacugaaacgcggcgaaaccacaaagcaugccguuagccgggggaccgcuaaacuuagaugguuugucgagcgcaaccuggugcggcccgagggaaaggugaucgaccucggcugugggagaggaggcugguccuauuacugcgccggccugaagaaagucacagaaguuaagggguauacgaaaggaggcccugggcacgaggaacccauuccuauggcgaccuacggauggaaucuggugaagcucuacucuggcaaagauguguucuuuacacccccugagaagugugacacccuucugugcgauaucggggaaagcuccccgaaccccacaauugaggagggacgcacccugcggguccucaaaaugguggaaccuuggcugagaggcaaucaauucuguaucaagauucuuaaccccuauaugccuucuguuguggagacgcuggaacagaugcagcgcaagcacggcgggaugcucguccggaauccccugagcagaaacuccacccaugagauguacugggugagcugcggaacaggcaauaucguuucugccgugaacaugaccucccgcaugcugcucaaccgguuuacaauggcucacagaaaaccgaccuaugagcgcgacgucgaucugggggccggaacaagacauguggcuguggaaccugagaucgccaaucuugacauuaucggccagcggauugaaaacaucaagaaugagcacaaaagcaccuggcacuacgaugaagacaaccccuauaagacgugggcguaccaugggucuuaugaggucaaacccuccggaagcgccucuuccaugguuaauggcguggugcgccugcucacaaagccuugggacgucauucccauggugacccaaaucgcuaugaccgauacaacgccuuucggccagcagagaguuuuuaaggagaaaguggacacccggacaccgagacccaagcgggggaccgcccaaaucauggaagucacagcuaaauggcuguggggauuccuuagccgcaacaagaaaccuagaauuuguacccgggaggaauuuacacgcaaggugagauccaaugccgcuaucggcgccguuuucguggaugagaaccaguggaauagcgcgaaggaagccgucgaggacgagaaauuuugggaucuggugcaccgggaacgcgagcuccauaagcaggggaaaugcgcuaccugcguuuacaacaugaugggaaagagagagaaaaagcugggcgaguucgggaaggccaaaggcucucgggcuauuugguacauguggcugggagcccgcuuccucgaauuugaggcccugggcuucaugaaugaggaccacugguuuagcagagaaaacucccuuucugggguggagggagaaggccugcauaagcucggguauauccugcgggauauuagcaaaauccccggaggcaauauguacgcggacgauacggcugggugggacacccgcaucacagaggaugaccuucagaacgaggccaagauuaccgauaucauggaaccugagcacgcccugcucgcuacauccauuuucaaacugaccuaucaaaauaaggucgugagaguccagcggcccgccaaaucuggcacggugauggacguuaucagccgcagagaccagcggggauccggccagguggggacauacggacugaacaccuuuacaaacauggaaguccaacucauuagacagauggagucugaaggcaucuucagcccguccgagcuggagaauagcaaccuugcugaacgcgugcuggauuggcucgagaagcacgggguggaacggcugaagagaauggccaucucuggagacgauuguguugugaaaccuaccgacgaucgcuuugcgacggcccuuaccgcucugaaugacaugggcaagguccggaaagauauuccccagugggagccuuccaagggguggaacgacuggcagcaagugcccuucugcagccaucacuuucaucagcucaucaugaaagauggcagagaaauuguugugccuugucgcaaucaggacgagcuggucggacgggccagagugucucagggcgcuggguggucccugcgcgagacagccugccucggaaagagcuaugcgcaaauguggcagcugauguacuuccaccggagagaucuucgccuggccgcuaacgccaucuguuccgcuguccccguggacuggguuccgaccucucggacaaccuggagcauucacgcccaucaccaguggaugacaaccgaagacaugcucuccguguggaauagagucuggaucgaggaaaacccuuggauggaggauaagacgcaugugagcucuugggaagacguucccuaucugggcaaacgggaggaucaauggugcgggucccuuauuggacugacagcuagagccaccugggcgaccaauauccagguggccaucaaccagguccgccggcucauuggcaaugagaacuaccuggacuacaugacaagcaugaagagauuuaaaaaugaaucugaucccgagggggcucugugguga

SEQ ID NO: 19390 - RNA, 9879 nt, Artificial Sequence
  derived and/or modified CDS sequence (opt5) from DENV-1__KP406802__SS-prME
agcgugaccaugcugcucaugcugaugcccacagcccuugcuuuccaccugacgacccggggaggggaaccucauaugaucguguccaagcaggaacggggaaaaucucuccuguuuaagaccagcgccggcauuaacaugugcacccuuaucgcgauggaccugggggaacucugugaagauacacugaccuacaaaugcccccgcauuacagaggcugaacccgacgauguugacuguuggugcaaugccaccgauacgugggugaccuauggaacauguucccaaaccggcgagcaccggcgggacaagcgcucuguggcccuggcuccucauguggggcucggacuggagacaagaaccgaaacguggaugagcuccgagggcgccuggaaacagauccagcggguggaaacaugggcucuuagacaccccggcuucaccguuauugcccuguuucucgcgcaugccaucgggacaucuaucacccagaagggaauuaucuucauucugcuuaugcuggugaccccuagcauggcuaugagaugcgucggcaucgggucccgggauuuuguggagggacucagcggcgccacauggguugacgugguccuggagcacgggucuugugugacgaccauggcuaaggauaaacccacacuggacauugaacuccugaagaccgaggugacaaacccugccguccuucgcaaacugugcaucgaagcgaagauuuccaauaccacgacagauagcagauguccgacccaaggagaggccacccucguugaagaacaggacgcuaacuucgugugccggcgcacauuuguggauagaggcuggggcaauggguguggacuguucggcaaagggucucuuaucacaugcgccaaguuuaagugcgucacaaaacuggagggaaagaucgugcaguacgaaaaccucaaauauuccguuauugugacgguccacaccggcgaccagcaucaaguggggaaugagagcacagaacacggaaccacagcuaccaucacgccccaggccccuaccacagagauucagcugaccgacuacggcgcccugacacucgauuguucuccccggaccggccuggacuucaacgaaaugguucuucugacgaugaaggagaaauccuggcucgugcauaagcagugguuucuggaucuuccucugcccuggacaagcggggcuuccaccucucaagagaucuggaaucgccaggaccuccuggucacauucaaaaccgcgcacgccaagaagcaggaaguggucgugcugggaagccaagagggcgcuaugcacaccgcccucacaggggccacggaaauucagaccuccggaacaaccacaaucuuugcuggccaucugaaaugcagacuuaagauggauaaacugacccucaaggggaugagcuauguuauguguacgggcucuuucaaacuggagaaggaaguggccgagacacagcacggaaccguccuggugcagaucaaguacgagggcaccgacgcgccgugcaaaauuccuuucuccacacaagaugaaaaggggguuacccagaacggacggcuuaucacagcuaaucccauugugacggacaaagagaagccugucaacaucgaagccgagccgcccuuuggcgagagcuauauugugaucggggccggagaaaaagcucucaagcugucuugguucaagaaaggcagcuccaucgggaagauguuugaggccaccgcuagaggcgcccgccggauggcgauucugggagauacagccugggacuucggcucuaucgggggaguguuuaccagcguuggcaaacucguccaucagauuuucgggacagcuuacggagugcuguuuuccggcgugagcuggaccaugaagaucgggauuggcguccuucugacguggcucggacucaauucuagauccaccagccugucuaugacauguaucgccgugggccuuguuacccucuaccugggggugaugguccaggcugauuccggaugcgugauuaacuggaaaggccgcgaacugaagugugggagcggaaucuucguuacaaaugaggugcacaccuggacagaacaauauaaguuucaggccgacuccccuaaacggcucucugcggccaucggcaaggcuugggaggagggggucugcggcauuagaagcgccacccgccuggaaaacaucauguggaaacagauuuccaacgagcuuaaucauauccugcucgaaaacgacaugaaguucacggugguugugggagaugucgcuggcauucuggcccaggggaaaaagaugauccggccgcaacccauggagcacaaauacucuuggaaaagcuggggaaaggccaagaucauuggcgcugacgugcagaauacaaccuuuaucauugaugggccuaacacccccgaauguccugacgaucagagagcguggaauaucugggagguggaggacuauggauucggcauuuuuacaaccaacaucuggcugaaacuucgcgauuccuacacgcaggucugcgaccaccggcucaugagcgccgcuaucaaagauucuaaggccguucaugccgacaugggcuauuggauugaauccgagaaaaaugaaacauggaagcuggcuagagccagcuucaucgaggugaagaccuguauuuggcccaaaucucacacacugugguccaacggggugcucgaaagcgagaugaucauuccgaagaucuacggaggcccuaucucucaacauaauuaucgccccggguacuucacccagacagcgggaccuuggcaccugggcaaacuugagcuggauuuugaccucugcgaagggaccacggucgugguugaugagcacugcggaaaccggggccccagccugagaaccacaaccgugacaggcaagauuauccaugaaugguguugccgguccuguacccugccuccccuucgcuucagaggggaggacggaugcugguacggcauggagauucggccggucaaagaaaaggaggaaaaucucgucaagagcaugguuucugcuggguccggagagguggacagcuuuucccugggccugcucuguaucucuauuaugaucgaagaggucaugagaagccgcuggucccggaaaaugcugaugacggggacacuugccguguucuuucugcucauuaugggacagcugaccuggaacgaucugaucagacuuugcaucaugguuggcgccaaugcuucugaccgcaugggcauggggacaaccuaucuggcccucauggcgaccuucaagaugagaccuauguuugcugugggacugcuguuccggcgccugacaagcagagagguccuucugcucacgauuggccugucccugguggccucuguggaacuucccaacagccuggaggaacucggggauggacuggccaugggcaucaugauucucaaacugcuuaccgacuuucaaucccaccagcugugggcuacacuccugagccugaccuucaucaagacaaccuuuucucuucauuacgccuggaaaacgauggcuaugguccuguccauuguuagccucuucccccugugucucucuacaaccucccagaagaccacauggcugccugugcuucuggggagccugggaugcaagccgcucaccauguuucugaucgccgagaauaaaaucuggggccggaagucuuggccccuuaacgaaggcauuauggcgguggggaucgucuccauucugcucagcucccugcucaaaaacgaugugccucuggccggaccccuuaucgcuggcgggaugcugauugccuguuauguuaucagcggaucuagcgcugaccugucccucgagaaggccgccgaggugucuugggaagaggaagcugagcacagcggcgcgucccauaauauccuggucgaagugcaggaugacgggacaaugaaaauuaaggaugaggagcgcgacgauacgcuuaccauccugcucaaagccacacugcucgcuguuucuggaguguacccucugagcauucccgccacccuuuucgucugguauuucuggcaaaagaagaaacagagauccggcgugcugugggacacaccuucucccccggaagucgagcgggccgugcuggaugacggcaucuaccgcauuaugcagagagggcuccugggacggagccagguuggcgugggggucuuucaagaaaacguguuccacaccauguggcacguuacgcgcggagcugugcuuauguaucagggcaagagacuggagccuuccugggccagcgucaaaaaggaccucaucucuuacgggggaggcuggcggcugcagggcuccuggaauaccggggaggaaguccaggugauugcgguugagcccggcaagaacccuaagaauguccaaacagcucccggcaccuuuaagacaccggaaggggaggugggagccaucgcccucgauuucaaaccuggcaccagcgggucucccaucgugaacagagaaggaaagauugucggccuguacggcaauggggugguuacaacguccggaaccuaugugagcgcuaucgcccaggcgaaggcuucccaggagggcccucuucccgagauugaagacgaggucuuucgcaagcggaaccugacaaucauggaucugcaucccgggucuggaaaaaccagacgcuaccucccugccauugugcgggaagccaucaagagaaagcugcgcacccuuauccuggcuccgacacggguuguggccagcgagauggcugaagcccucaaaggcaugcccauuagauaucaaacgaccgcggucaaguccgagcacacagggaaagagaucguggaccugaugugccaugccaccuucacaaugcgccugcucagcccuguucgggugcccaauuacaacaugauuaucauggaugaagcucacuuuaccgacccuucuuccauugccgcuagaggcuauaucagcacgcgggucggaaugggcgaggccgccgcuaucuucaugacagcgacacccccugggucuguggaagccuuuccgcagagcaaugcugugauucaggaugaggaacgcgacauccccgagagauccuggaacucuggauacgaguggauuaccgauuucccuggcaagacagucugguuuguucccagcaucaaauccgggaaugacauugccaacugucuucggaagaauggaaagcgcgugauccagcugucuagaaaaaccuucgauacagaauaucaaaagaccaaaaacaacgacugggacuacguggucacgacagauauuagcgagaugggcgccaauuuccgggcugacagagugaucgauccucgccggugccugaagcccguuauccucaaagacgggccggaaagagugauucuggccggcccuaugcccgucaccguggcguccgcugcccagcgccggggaagaguuggccgcaaccauaauaaggagggggaucaguacaucuauaugggacagccccuuaacaaugacgaggaucacgcccacuggacagaagcuaagaugcugcucgacaacauuaauaccccugagggcaucauucccgcccuguuugaaccugagcgggaaaagagcgcggccaucgauggggaguacagacugcgcggagaggcuagaaagacguucguggagcucaugcggcgcggcgaccuuccggucuggcugucuuauaaaguggccuccgagggguuucaauacagcgauagacgguggugcuucgacggcgaacgcaacaaucagguccuggaggaaaacauggauguggagaucuggaccaaggagggagaacgcaaaaagcuccggcccagauggcuggacgcucgcacauauuccgacccucuugcccugcgggaguuuaaagaguucgcugccggcagacgcucuguuagcggggaucucauucuggagaucggaaagcugccccagcaucucacccagcgggcgcaaaaugcccuugacaaccuggugaugcugcacaauuccgaacagggcgggagagcuuaccggcaugccauggaggagcucccugauacaauugaaacccugaugcuucuggcucucaucgccgugcugacaggaggcgucacccuguuuuuccucucuggccgcgggcuuggaaagacgagcauuggccugcuguguguuauggccuccagcgugcuccuguggauggcuucuguggagccccacuggaucgcggccuccaucauucuugaauuuuuccugaugguccuccugaucccggagccugacagacagcggacaccccaggauaaccaacuggcuuaugugguuauugggcuccuuuuuaugauccugaccguggccgccaaugagaugggacugcucgaaaccaccaaaaaggaccugggcauugggcacgucgcuguggagaaccaucaccaugccgcgaugcuugaugucgaccugcacccugccagcgcuuggacccucuacgccguggcuacaacgaucauuacccccaugaugcgccauacaaucgaaaacaccacagccaauaucucucugaccgcgauugccaaccaggcugccauccugaugggacucgauaaaggcuggccuauuuccaagauggacaucggcguuccccuucuggcucuggggugcuacagccaggugaauccgcucacgcugaccgccgcuguccuuaugcugguggcccacuaugcgauuaucggaccuggccuccaagccaaagcuacaagagaggcccagaagcggaccgcugccgggaucaugaagaaccccacaguugauggaauuguggccaucgaccuggaucccgucguguacgacgcgaaauucgaaaagcagcugggccagauuaugcuccuuauccuguguaccucucaaauucugcucaugcgcacgacaugggcucugugcgagagcaucacccuugccacagggccucugaccacccucugggagggauccccgggcaaauuuuggaauacaacgaucgcugugucuauggccaacauuuucagaggcagcuaucuggccggggcuggacuggccuucucccucaugaaaagccuuggcgggggacggcgcggcaccggggcgcagggagaaacacugggcgagaaauggaagagacagcugaaucagcucuccaagucugaauuuaacaccuacaaacggagcggcaucauggagguugacagauccgaagccaaggaggggcugaaacgcggagagacaaccaagcacgcugucucucggggcacggccaaacuuagaugguucguggaacgcaaucuggugaagcccgaggggaaggucauugaucucggauguggcagagggggauggagcuauuacugcgcuggccugaaaaagguuacagaagugaaaggcuauaccaaagggggaccuggccaugaggaacccaucccuauggccaccuacggguggaaccuggugaaacuccacuccggaaaggacgucuuuuucauucccccugagaaaugugauacacuucugugcgacaucggcgagucuagcccgaaucccaccauugaagaggggagaacacugcgcgugcucaagaugguugaaccuuggcugcggggaaaccaauuuuguaucaagauccuuaaucccuacaugccuuccguggucgagacgcuggagcagaugcagagaaaacauggcggcaugcucgugcgcaacccccugagcagaaauucuacccacgaaauguauuggguuuccugcgggacaggaaacauugugagcgcggucaauaugaccucuagaaugcugcucaaccgcuucacaauggcccaccggaagccgaccuacgagagagauguggaccugggcgcugggacgcgccauguggccgucgaaccugagguugcuaaccuugauaucauuggacagagaaucgaaaauauuaaacacgagcauaaguccaccuggcacuaugacgaggauaaccccuacaaaacaugggccuaucauggcagcuacgaagugaagcccucuggguccgcuagcuccauggugaauggagucgugaagcugcucaccaaaccuugggacguuauccccauggugacacaaaucgccaugaccgauacaaccccuuuuggccagcagcgggucuucaaggagaaaguggacacgcgcacaccgaaggcgaaaagaggcaccacccaaauuauggaaguuacagcccgguggcuguggggguuucuuagcagaaacaagaagccccggaucuguacgcgcgaggaguucaccagaaaagugcggucuaaugcugccauuggagcugucuuuguggacgagaaccaguggaauagcgccaaggaggccguugaagaugagcgcuucugggaccuggugcacagagaacgggagcuccacaaacagggcaagugcgcgacaugcgucuauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcguggagggggagggacugcacaaacucggcuacauucugagagacaucucuaagaucccugggggaaauauguaugccgaugacaccgcuggcugggauacacggauuaccgaagacgaucuucagaacgaggccaaaaucacagacauuauggaacccgagcaugcgcugcucgccaaggcuaucuuuaaacugaccuaccaaaauaaggucgugcgcguucagagaccugccaagaacgggacggugauggaugucauuagccggcgcgaccagagaggcuccggacaggugggcaccuaugggcugaauacauucaccaacauggaagcucaacucauccggcagauggagucugagggaaucuuuagccccuccgaacuggagacaccgaaccuugccgaaagagugcuggauuggcucgagaaauacggcguugaacgccugaagcggauggcgauuagcggggacgacuguguggucaaaccuaucgaugacagauucgccaccgcucuuacggcccugaaugauaugggaaaggugcgcaaagacauuccccagugggagccuucuaagggcuggaacgauuggcagcaaguucccuuuugcucccaccacuuccaucagcucaucaugaaggacgggcgggagauuguggucccuuguagaaaucaggaugaacuggugggccgcgcucgggucagccagggagccggcuggucucugagagagacagcuugccucgggaaauccuaugcccaaauguggcagcugauguacuuucaccgccgggaccuuagacuggcggccaacgcuaucuguagcgccgugcccguugauugggugccgaccucccgcacaaccuggucuauucaugcccaccaucaguggaugacgaccgaagacaugcucagcgucuggaaucggguguggaucgaggaaaacccuuggauggaggauaagacacacaucuccagcugggaggacguucccuaucugggaaaaagagaagaccaauggugcggcucucuuauugggcugaccgcucgggccacaugggcgaccaauauccagguggcuauuaaccaggucagacgccucaucggaaaugagaacuaccuggauuacaugacauccaugaagcgguucaaaaaugaaagcgaccccgagggcgcccugugguga

SEQ ID NO: 19391 - RNA, 9879 nt, Artificial Sequence
  derived and/or modified CDS sequence (opt5) from DENV-1__KP406803__SS-prME
agcgugaccaugcugcuuaugcugcuucccaccgcccuggcuuuccaccucacgaccagaggcggggaaccucauaugaucguguccaagcaggaacggggaaagucucugcuuuuuaagacaagcgccggcguuaacaugugcacccugauugcgauggaccucggggagcugugugaagauacaaugaccuacaagugcccccgcaucacagagaccgaacccgacgauguggacuguuggugcaaugcuacggagaccugggugacauauggaaccuguucccaaacaggcgagcacagacgggauaagcgcucugucgcccuggccccucauguggggcucggacuggaaaccagaacggagacauggaugagcuccgaaggcgcuuggcggcagauucagaaaguugagaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggacuuuguugagggacucuccggcgcuacguggguggaugucgugcuggaacacgggagcugugugaccacaauggccaaggacaaacccacccuggauaucgagcuccugaagacagaagucaccaauccugcuguucuucgcaaacugugcauugaggccaagaucucuaacacgacaaccgacuccagauguccgacccaaggagaagcgacacucguggaggagcaggauaccaauuucgugugccggcgcacauuugucgacagaggcuggggcaacggguguggacuguucggcaaagggagccuuauuacgugcgccaaguuuaagugcgugaccaaacuggaaggaaagaucguucaguacgagaaucucaaauauucugugaucgucacagugcacaccggcgaucagcaucaaguugggaacgaaacaaccgagcacggaacgaccgcuacaauuacaccccaggccccuacauccgaaauccagcugaccgacuacggcgcucugacgcucgacuguagcccccggacaggccuggauuucaaugagauggugcuucugaccaugaaggagaaaucuuggcucguccauaagcagugguuucuggaccuuccucugcccuggacauccggggccagcaccucccaagaaaccuggaaccgccaggaucuccuggugacauucaaaacggcccacgcuaagaagcaggaggucgugguucugggaucucaagaaggcgcgaugcacaccgcccucacaggggcuaccgagauucagacaagcggaaccacgacaaucuuugccggccaucugaaaugcagacuuaagauggacaaacugacccucaaggggguguccuaugucauguguaccggcagcuucaaacuggaaaaggagguggccgagacacagcacggaaccguucuggugcaggucaaguacgaaggcacagaugcuccgugcaaaauuccuuucucuucccaagacgagaagggggugacgcagaauggacggcuuaucaccgccaaccccaucgugacagauaaagaaaagccuguuaauauugaggcggagccgcccuuuggcgaaagcuaucucgucgugggggcuggagagaaagcccugaagcugucuugguucaagaaaggcagcuccaucgggaagauguuugaagccaccgcuagaggcgcccgccggauggcuauucucggagacacagccugggauuucggcucuaucgggggaguguuuaccagcgucggcaaacugauucaucagaucuucgggacggcguacggagugcucuuuuccggcguuagcuggaccaugaagaucgggauuggcauccugcucacauggcugggacugaacucuagauccaccagccuuucuaugacauguauugccgugggcauggucacccucuaccugggggugaugguucaggcugacuccggaugcgugaucaauuggaaaggccgcgagcugaagugugggagcggaauuuucgucacaaacgaagugcacaccuggacggagcaauauaaguuucaggccgauuccccuaaacggcucucugcugccaucggcaaggcgugggaggaagggguuugcggcauuagaagcgccacacgccuggagaacaucauguggaaacagaucuccaaugaacuuaaccauauucugcucgagaaugacaugaaguucaccguggucgugggagacgugaacggcauccuggcucaggggaaaaagaugauucggccgcaacccauggaacacaaauacucuuggaaaagcuggggaaaggccaaagucaucggcgcugauguucagaauauuaccuuuaucaucgacgggccuaacacacccgaguguccugaugaccagagagccuggaauauuugggagguggaagauuauggauucggcaucuuuaccacgaacauuuggcugaaacuucgcgacuccuacacacaggugugcgaucaccggcucaugagcgccgcuaucaaagacucuaaggcgguccaugccgauaugggcuauuggauugaguccgagaagaaugagaccuggaagcugacaagagcuagcuucaucgaagugaagaccuguguuuggcccaaaucucacacacugugguccaacggggugcucgagagcgagaugaucauuccgaagaucuacggaggcccuauuucucaacauaauuaucgccccggguacuucacccagacggccggaccuuggcaccugggcaaacuugaacuggacuuugggcucugcgagggaaccacagucgugguugaugaacacugcggcaaccggggccccagccugagaaccacaaccgugacggggaagaucauucaugagugguguugccgguccuguacacugccuccccuucgcuucaaaggagaggacggcugcugguacgggauggaaaucagaccggucaaggagaaggaagagaaucucgugaaaagcaugguuucugccggauccggcgaaguggauagcuuuucccuggggcugcucuguaucucuauuaugaucgaggaggucaugcggagcagauggucccgcaagaugcugaugaccggaacacuugcuguguuccugcuccugauuaugggccagcugaccuggaacgaccuuauccggcugugcauuauggugggcgccaaugcgucugacaaaauggggaugggaaccacauaucucgcucugauggccacguuuagaaugcgcccuauguucgccgucggccuccuguuuagacggcuuaccagccgcgaaguucugcuccugacaguggggcugucccuuguggcuucugucgagcugcccaacagccucgaagaacugggagauggccucgccauggggaucaugaugcugaaacuucugaccgacuuccaaucccaccagcucugggcggcucugcugagccuuacauuugugaaaaccacguucucucugcauuacgccuggaagacaauggccaugauucucuccaucguuagccuguuuccccucugucugucuaccaccucccagaagacaaccuggcuuccugugcugcugggaagccucggcugcaaaccgcugacaauguuccuuaucacggaaaacaagauuuggggcagaaaaucuuggccccugaaugaggggaucauggcugucggaauuguguccauccuccugagcucccuccugaagaacgauguuccucuugccggcccccugauugcugggggaaugcugaucgccuguuaugugaucagcggcucuagcgcggaccucucccuggagaaagccgcugaagucucuugggaggaagaggccgaacacagcggggcuucccauaauauucuuguggagguccaggaugacggaaccaugaagaucaaagaugaggaacgggacgauacacugaccauucuccugaaggccacacuccuggccaucucuggcguguacccuaugagcauucccgcuacccuuuuuguuugguauuucuggcaaaagaaaaagcagcgcuccggcgugcugugggacacgccuucucccccggaggucgaaagagcggugcuggaugacgggaucuaccggauccuccagcgcggacugcuuggcaaaagccagguuggggugggagucuuccaagagggcguguuucacaccauguggcacgugacaagaggggccguucugauguaucagggaaagcggcucgagccuuccugggcuagcgucaaaaaggaucugauuucuuacggcggcggguggcgcuuccagggauccuggaacaccggcgaagagguccaggugaucgccgucgaacccgggaagaauccuaaaaacgugcaaacagcccccggaaccuuuaagacaccggagggcgaaguuggggcuauugcccucgacuucaaaccuggaacgagcggcucucccaucgugaauagagagggcaagauugucgggcuguacggaaacggcgugguuaccacauccgggaccuaugugagcgcgaucgcucaggccaaagccucccaggagggaccucuucccgaaauugaggacgaagucuuucggaagagaaaucugaccaucauggaucugcaucccggcucugggaagacacgccgguaccucccugcuaucgugagagaggccauuaaacgcaagcugcggacgcuuguucuggcgccgaccagaguggucgcuagcgaaauggccgaggcccucaaaggcauccccauucgcuaucaaacaaccgcugugaaguccgagcacacaggaaaagaaaucguggaccugaugugccaugccaccuucacgaugcggcugcucagcccugucagaguucccaacuacaauaugauuaucauggaugaggcucacuuuacagacccugccucuaucgcggcccgcggcuauauuuccacccggguggggaugggagaagcugccgcuaucuucaugaccgccacacccccuggcagcauggaggccuuuccgcagucuaacgcugcgauucaggaugaagagagagacauccccgagcggagcuggaacuccggguacgauuggauuaccgacuucccuggaaagacagugugguuuguccccucuaucaagagcggcaacgauaucgccaauugucuucgcaaaaacgggaagagagugguucagcugucccggaaaaccuucgacacggaauaucaaaagaccaagaauaaugauugggacuacguggucaccacagacauuucugagaugggcgcuaacuuccgcgccgauagagugaucgacccucggagaugccugaagcccguuauucucaaggauggaccggaacgcgugauccuggccggcccuaugcccgucaccguggcuagcgccgcgcagcggagagggcgcauuggacggaaucagaacaaagagggcgaccaguacaucuauauggggcaaccccuuaauaacgaugaggaccaugcucacuggacggaagccaagaugcugcucgauaauauuaacaccccugagggaaucauccccgcccuguuugaaccugagagagaaaaauccgcugccauugacggcgaguaccgccugagaggggaagcgcggaagacauucgucgaacucaugcgcagaggcgaucuuccgguguggcugagcuauaaaguugccucugagggauuucaguacuccgaccggcgcuggugcuucgauggcgaaagaaauaaccaggugcuggaggaaaauauggacguggagaucuggaccaaggagggggaacggaaaaagcuccgccccagauggcuggaugcucggacauauagcgacccucuugcccugagagaguuuaaggaguucgcugccggacgccgguccgucucuggcgaccucauucuggagaucgggaaacugccccagcaccucacccaaagagcucagaacgcccuugauaaucugguuaugcugcauaacagcgaacagggaggcaaggcguaccgccacgccauggaggagcucccugacacaauugaaacccugaugcuucuggcucucaucgccgugcugacgggcggggugacacuguuuuuccucuccggacggggccuugggaaaaccucuaucggacugcugugugucauggcuagcuccgcccuccuguggauggccagcguggagccccauuggauugcugcgucuaucauucuugaauuuuuccugaugguucuccugaucccggagccugauagacagcggacaccccaagacaaucagcuggccuauguggucauuggccuccuuuuuaugauccugacaguggcugccaacgagauggggcugcucgaaaccacaaagaaagaucugggaaucggccacgucgccgcugagucccaccaucacgccgcgaugcuugacguggaucugcauccugccagcgcuuggacgcucuacgccguugcuaccacaauuaucacccccaugaugcgccacacaauugaaaacaccacggccaauaucucucugaccgcgauugccaaccaggcugccauccugaugggccucgacaagggguggccuauuuccaagauggauaucggagugccccuucuggcucugggcugcuacagccaagucaauccgcucacacugaccgccgcugugcuuaugcugguugcccauuaugcgaucauugggccuggacuccaggccaaagcuacaagagaggcccagaagcggaccgcugccggcaucaugaaaaaccccacgguggacgggauugucgccaucgaucuggaccccgugguguacgaugcgaaguucgaaaaacagcugggacaaauuaugcuccuuauccuguguacaucucagauccugcucaugcgcaccacaugggcucugugcgagagcauuacccuugccaccggcccucugacaacgcucugggagggcuccccggggaaguuuuggaauaccacaaucgcuguuucuauggccaacauuuucagaggaagcuaucuggccggcgcugggcuggccuucucccucaugaaaagccuuggaggcgggcggcgcggaaccggcgcgcagggcgaaacacugggggagaaauggaagagacagcugaaucaacucuccaaaucugaauuuaacaccuacaagcggagcggaaucauugaggucgaccgcuccgaagccaaagagggccugaagagaggggagacgacaaagcacgcugugucucggggaaccgccaaacuuagaugguucguggaacgcaaucuggucaagcccgagggcaaaguuaucgaccucggguguggacggggcggcuggagcuauuacugcgcugggcugaagaaagugaccgaagugaagggauauacaaaaggcgggccuggacacgaggaacccaucccuauggccaccuacggcuggaaccuggucaagcucuacuccgggaaggauguguuuuucacacccccugagaaaugugacacgcuucugugcgauauuggagagucuagcccgaaucccaccaucgaagagggcagaacacugcgcguucuccggaugguggaaccuuggcugagaggcaaccaguuuuguauuaagguccuuaaucccuauaugccuuccgugguugagacccuggagcagaugcagcgcaaacaugggggaaugcucgugcggaacccccugagcagaaauucuacacacgaaauguacugggucuccugcggcaccgggaacaucgugagcgcggugaauaugacgucucgcaugcugcucaaccgguucaccauggcccauagaaagccgacauaugagcgcgacgucgaucugggagcuggcacccggcacguugccguggaaccugagguggcuaaccuugacauuaucgggcaaagaauugaaaauaucaaaaacgagcacaaguccacauggcauuacgaugaggacaaucccuauaagaccugggccuaccacggaagcuaugaagucaaacccucuggcuccgcuagcuccauggugaacggcguugugcgccugcucacaaagccuugggaugucauccccauggugacccagauugccaugacggacacaaccccuuuugggcagcaaagaguuuucaaagagaagguggauacccggacaccgaaagcgaagcgcggaacggcccagaucauggaagucaccgcuagauggcuguggggcuuucuuagccggaauaagaaacccagaauuuguacacgggaggaguucacccgcaaggugagaucuaacgccgcuaucggggccguuuuuguggacgagaaucaguggaacagcgccaaagaggcggucgaagacgagcgguucugggaucuggugcaucgcgaaagagagcuccacaagcagggaaaaugcgcuacaugcgucuacaauaugaugggcaagcgggaaaagaaacugggggaguuuggcaaggccaaaggaucccgcgccauuugguacauguggcugggcgcuagauuccucgaguucgaagcccugggguuuaugaacgaggaccauugguucucucgggaaaauagccuuuccggaguggagggcgaggggcugcacaagcucggauauauccugcgcgauaucucuaaaauuccuggcgggaacauguacgcugacgauaccgccggcugggacacaagaaucaccgaagaugaccuucaaaaugaggcgaagauuacggauaucauggaacccgagcacgcccugcucgcuaccagcauuuuuaaacugacauaucagaacaagguugugcggguccagcgcccugccaagaauggaaccgugauggacgugaucuccagacgggaucagcgcggcucugggcaaguuggaacauacggccugaacaccuucacgaacauggaagcucagcucaucagacagauggagagcgaggggauuuuucugcccuccgaacuugagacaccgaaucuggccgaacgggugcucgacuggcuggagaaauauggaaucgaaagacuuaagcgcauggcgauuagcggcgaugacugugucgugaaaccuaucgacgaucgguucgccaccgcucugacagcccucaacgacauggggaagguuagaaaagauauuccccagugggagccuucuaagggcuggaaugacuggcaacaggugcccuuuugcucccaucacuuccaucagcugaucaugaaggauggacgcgagaucgucgugccuugucggaaccaggacgaacuggucggcagagcucgcgugagccaaggggccggauggucucuccgggagaccgcuugccugggcaaauccuacgcccagauguggcagcuuauguauuuucacagacgcgaucugcggcucgcggccaaugcuauuuguagcgccguucccguggacugggucccgacguccagaaccacauggucuauccacgcccaucaccaauggaugaccacagaagauaugcugagcguguggaaccgcguuuggauugaggaaaauccuuggauggaggacaagacccauguguccagcugggaggauguccccuaccuugggaaacgggaagaccaguggugcggaucucugaucggccucacagcuagagccaccugggcgacgaacauucagguggcuaucaaucaggugcggagacugauugggaacgagaauuaccuggacuauaugacauccaugaagcgcuucaaaaacgaaagcgaucccgagggcgcccucugguga

SEQ ID NO: 19392 - RNA, 9879 nt, Artificial Sequence
  derived and/or modified CDS sequence (opt5) from DENV-1__KJ438293__SS-prME
agcgugacaaugcugcugaugcugaugcccacagcccuugcuuuccaccugacgaccagaggcggggagccucauaugaucguguccaagcaggaacggggaaaaucucuccuguuuaagacaagcgccggcguuaacaugugcacccuuaucgcgauggaccugggggagcucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaggaacaggacgcuaacuucgugugccggcgcacauuuguggauagaggcuggggcaauggguguggacucuucggcaaagggucucugaugaccugcgccaaguuuaagugcgucacaaaacuugagggaaagaucgugcaguacgaaaaccugaaauauuccguuaucgugacgguccacaccggcgaccagcaucaaguggggaaugagagcacagaacacggaaccacagcuaccauuacgccccaggccccuaccacagagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagauuucuugguucaagaaaggcagcuccaucgggaagauguuugaggccacagcuagaggcgcccgccggauggcgauccucggagauaccgccugggacuucggcucuauugggggaguguuuacaagcguuggcaaacugguccaucagaucuucgggaccgcuuacggagugcuguuuuccggcgugagcuggacgaugaagauugggaucggcguccuccugaccuggcuuggacucaauucuagauccacaagccucucuaugaccuguauugccgugggccugguuacacuguaccuuggggugaugguccaggcugauuccggaugcgugaucaacuggaaaggccgcgaacucaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccuggaaaacauuauguggaaacagaucuccaacgagcucaaucauauucugcuugaaaacgacaugaaguucacagugguugugggagaugucgcuggcauccuggcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcucaagcugcgcgauuccuauacacaggucugcgaccaccggcugaugagcgccgcuaucaaagauucuaaggccguucacgccgacaugggcuacuggaucgaauccgagaaaaaugaaaccuggaaacuugcuagagccagcuucauugaggugaagacauguaucuggcccaaaucucauacccucugguccaacggggugcuggaaagcgagaugauuaucccgaagauuuauggaggcccuaucucucaacacaauuaccgccccggguacuucacacagaccgcgggaccuuggcaucugggcaaacucgagcuggauuuugaccuuugcgaagggacgaccgucgugguugaugagcacugcggaaaccggggccccagccugagaacaaccacagugaccggcaagaucauucacgaaugguguugccgguccuguacgcucccuccccugcgcuucagaggggaggacggaugcugguauggcauggagauccggccggucaaagaaaaggaggaaaaucuggucaagagcaugguuucugcuggguccggagagguggacagcuuuucccuuggccuccuguguauuucuaucaugauugaagaggucaugagaagccgcuggucccggaaaaugcugaugacagggacccucgccguguucuuucugcuuaucaugggacagcugacauggaacgaucucauuagacugugcaucaugguuggcgccaaugcuucugaccgcaugggcauggggaccaccuaccuggcccuuauggcgacauucaagaugagaccuauguuugcugugggacugcuguuccggcgccugacgagcagagagguccuccugcuuaccaucggccugucccucguggccucuguggaacugcccaacagccuggaggaacuuggggauggacuggccaugggcauuaugauccucaaacugcucacaggguuucaaucccaucagcugugggcuacccuucugagccucacauucauuaagaccacguuuucucugcacuaugccuggaaaacaauggcuaugguccuguccaucguuagccuuuucccccugugucucucuaccaccucccagaagacaaccuggcugccugugcuccugggaagccuuggcugcaagccgcugacaauguuucugauuacggagaauaaaaucuggggccggaagucuuggccccucaacgaagggaucauggccgugggaauugucuccauccugcuuagcucccugcucaaaaacgacgugccucuggcgggcccccucauugccgggggaaugcugaucgcuuguuacguuauuagcggcucuagcgccgaucuuucccuggagaaggcugccgaggugucuugggaagaggaagccgagcauagcggggcuucccacaauauccuggucgaagugcaggacgauggaaccaugaaaaucaaggacgaggagcgcgaugacacacucaccauucugcuuaaagcgacacugcucgccguuucuggcguguauccucugagcauccccgcuacccucuucgucugguacuucuggcaaaagaagaaacagagauccggcgugcugugggauacgccuucucccccggaagucgagcgggccgugcuugacgaugggauuuaucgcaucaugcagagaggacugcugggccggagccagguuggggugggagucuuucaagaaaacguguuccauaccauguggcacguuacacgcggcgccgugcucauguaccaggggaagagacuggagccuuccugggcuagcgucaaaaaggaccuuauuucuuacggaggcggcuggcggcugcagggguccuggaauaccggagaggaaguccaggugaucgccguugagcccggcaaaaacccuaagaauguccaaacagcgcccgggaccuuuaagacaccggaaggagaggugggcgcuauugcccucgacuucaaaccugggacgagcggaucucccaucgugaacagagaaggcaagaucgucggccuguaugggaauggagugguuaccacauccggcaccuacgugagcgccauugcucaggccaaagcgucccaggaggggccucuccccgagaucgaagaugaggucuuucgcaagcggaaccugaccauuauggaccuucaccccggaucuggcaaaacaagacgcuaucugccugcuaucgugcgggaagccauuaagagaaagcugcgcacgcucauccuggccccgacccggguuguggcuagcgagauggccgaagcucuuaaagggaugcccaucagauaccaaacaaccgccgucaaguccgagcauacaggcaaagagauuguggaucugaugugccacgcgaccuucacgaugcgccuccugagcccuguucgggugcccaauuauaacaugaucauuauggacgaagcccauuuuacagauccuucuuccaucgcugccagaggauacauuagcacccgggucggcaugggggaggcugccgccaucuucaugaccgcuacacccccuggaucuguggaagcguuuccgcagagcaaugccgugauccaggacgaggaacgcgauauucccgagagauccuggaacucuggcuaugacuggaucaccgauuucccugggaagacagucugguuuguucccagcauuaaauccggaaaugacaucgcuaacugucugcggaagaauggcaagcgcgugauucagcucucuagaaaaaccuucgauacggaguaccaaaagaccaagaacaacgacugggacuacguggucaccacagauaucagcgaaaugggggccaauuuccgggccgacagagugauugauccucgccggugccuuaagcccguuauccugaaagacggcccggagagagugguccuggcuggaccuaugcccgugaccguugccuccgcggcucagcgccggggcagaaucgggcgcaaccacaauaaggaaggagaucaguauauuuacaugggccagccccucaacaaugacgaggaucaugcccacuggacggaggccaagaugcugcuugacaacaucaauaccccugaagggauuauccccgcucuguuugagccugaacgggagaaaagcgccgcgauugauggagaauauagacuccgcggcgaggccagaaagacauucguggagcugaugcggcgcggggaccugccggucuggcucucuuacaaaguggcuuccgaaggcuuucaauauagcgauagacgguggugcuucgacggagagcgcaacaaucagguccuugaagagaacauggauguggaaaucuggaccaaggagggcgagcgcaagaagcugcggcccagauggcuggacgcccgcacauacuccgacccucucgcucugcgggaauuuaaagaguucgccgcugggagacgcucuguuagcggagaucuuauccuggaaauuggcaagcucccccagcaccugacccagcgggcccaaaaugcgcuggacaaccucgugaugcuucauaauuccgagcaagggggacgggccuaucggcacgcuauggaggaacugccugauacaaucgagacccugaugcuccuggcccuuauugcugugcugacgggcggcgucacacucuuuuuccugucugggcgcggacugggcaagaccagcaucgggcuccuuuguguuauggccuccagcgugcugcuguggauugccucuguggaaccccauuggaucgcugcguccaucauucucgaguuuuuccugaugguccuucugaucccggaaccugacagacagcggacaccccaggauaaccaacucgccuacgugguuauuggacugcuguuuaugauccucacaguggcugccaaugagaugggccuucuggagaccaccaaaaaggaccuggggauuggacacgucgccguggaaaaccaccaucacgcugccauccucgaugucgaccugcauccugcgagcgccuggacgcuuuacgcuguggccaccacaauuaucacccccaugaugcgccacacaaucgagaacaccacggcuaauauuucucugaccgccaucgcgaaccaggccgcuauucucaugggccuggauaaaggcuggccuaucuccaagauggacauugggguuccccugcucgcccuuggaugcuauagccaggugaauccgcugacacugaccgcugccguccucaugcugguggcucauuacgccaucaucggcccugggcuucaagcgaaagccacaagagaagcucagaagcggaccgccgcuggaauuaugaagaaccccacgguugauggcaucguggccauugaccuggaucccgucguguaugacgccaaauucgagaagcagcucgggcagaucaugcugcugauucucuguacaucucaaauccuucugaugcgcaccacaugggcgcugugcgaaagcaucacccucgcuaccggaccucugacaacgcuuugggagggcuccccgggcaaauuuuggaauaccacaauugccgugucuauggcuaacaucuucagagggagcuaccuggccggagccggccucgcuuucucccugaugaaaagccucgggggaggccggcgcgggaccggagcccagggcgagacacucggcgaaaaauggaagagacagcuuaaucagcuguccaagucugaguuuaacaccuauaaacggagcgggauuauggaaguugacagauccgaggcgaaggaaggacugaaacgcggcgagacgacaaagcacgccgucucucgggggaccgcuaaacucagaugguucguggagcgcaaucuggugaagcccgaaggaaaggucaucgaucuuggcugugggcggggaggcuggagcuacuauugcgccggccugaaaaagguuaccgaggugaaaggguacacaaagggaggcccugggcacgaggaacccauuccuauggcuaccuacggauggaaccucgugaaacuguauuccggcaaggacgucuuuuucauucccccugaaaaaugugauacacugcucugcgacauuggggagucuagcccgaaucccacgaucgaggaaggaagaacccuucgcgugcugaagaugguugagccuuggcugcggggcaaccaauuuuguaucaagauucucaaucccuacaugccuuccguggucgaaacacuggagcagaugcagagaaaacauggcgggaugcuugugcgcaacccccugagcagaaauucuacccacgagauguauuggaucuccugcggaacaggcaacauuguuagcgccgugaauaugaccucuagaaugcuccugaaccgcuucacgauggcgcaucggaagccgaccuacgaaagagaugucgaccugggggccggaacacgccacguggcuguggagccugaagucgccaaccucgauaucauuggccagagaaucgagaauaucaaacacgaacauaaguccaccuggcacuaugacgaggauaaccccuacaaaacaugggcuuaucaugggagcuacgagguuaagcccucuggauccgccagcuccauggugaauggcguggucaagcugcuuaccaaaccuugggacgugauucccaugguuacacaaaucgcuaugaccgauacgacaccuuuuggccagcagcggguguucaaggaaaaagucgacacccgcaccccgaaggccaaaagagggacagcgcaaauuauggaggugacggcccgguggcuguggggauuucucagcagaaacaagaagccccggaucuguacccgcgaagaguucacaagaaaaguucggucuaaugcugccauuggcgcuguguuugucgacgaaaaccaguggaauagcgccaaggaggccguggaggaugaacgcuucugggaccugguucacagagagcgggaacuucauaaacaggggaagugcgcgaccugcguguacaacaugaugggaaaacgcgagaagaagcugggcgaauuugggaaagcuaagggcuccagagccaucugguauauguggcucggagcccgguuccuggaguucgaggcucugggcuuuaugaaugaagaucacugguucucucgcgagaacagccucuccggggucgaaggagagggccugcacaaacuuggguacauccugagagacauuucuaagaucccuggaggcaauauguaugccgaugacacagcugggugggauacccggauuacagaggacgaucuccagaacgaagccaaaaucaccgacauuauggagcccgaacaugcgcugcuugccaaggcuaucuuuaaacugacguaccaaaauaaggugguccgcgugcagagaccugccaagaacggcaccguuauggaugugaucagccggcgcgaccagagaggauccggccaggucgggacauauggacucaauaccuucacaaacauggaggcucaacugauucggcagauggaaucugagggcaucuuuagccccuccgagcuggaaaccccgaaccucgccgagagagugcuggauuggcuugaaaaauacgggguggagcgccugaagcggauggcgauuagcggagacgacuguguugugaaaccuaucgaugacagauucgccacggcucucacagcccugaaugauaugggcaagguccgcaaagacauuccccagugggaaccuucuaagggguggaacgauuggcagcaagugcccuuuugcucccaccauuuccaccagcuuaucaugaaggacggccgggagauuguugugccuuguagaaaucaggaugagcuggucggacgcgcucgggugagccagggcgccggguggucucucagagaaaccgcuugccugggaaaauccuaugcccaaauguggcagcugauguacuuucaccgccgggaccucagacuggcggccaacgcuaucuguagcgccguccccguggauuggguuccgacaucccgcaccacguggucuauccaugcccaccaucaguggaugaccacagaggacaugcuuagcguguggaaucgggucuggauugaagagaacccuuggauggaagauaagacccacaucuccagcugggaggacgugcccuaccugggcaaaagagaggaccaauggugcgggucucucauuggacugacagcucgggccaccugggcgacaaauauccagguugcuauuaaccaggugagacgccuuaucggcaaugaaaacuaucuggauuacaugaccuccaugaagcgguucaaaaaugagagcgaccccgaaggggcccucugguga

SEQ ID NO: 19393 - RNA, 9879 nt, Artificial Sequence
  derived and/or modified CDS sequence (opt5) from DENV-1__KJ438296__SS-prME
agcgugaccaugcugcucaugcugaugcccacagcucuugcuuuccaccugacgaccagaggaggggaaccucauaugaugguguccaagcaggaacggggaaaaucucuccuguuuaagaccagcgccggcguuaacaugugcacccuuaucgcgauggaccugggggaacucugugaagauacaaugaccuacaaaugccccagaauuacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauccagcggguugaaacaugggcucugcgccaccccggcuucaccgugauugcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugaucacaugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaagaucauuggcgcugacgugcagaauaccaccuuuaucaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcgccgcuaucaaagauucuaaggccgugcacgccgacaugggcuacuggauugaauccgagaaaaaugaaaccuggaagcucgcuagagccagcuucaucgaggugaagacauguaucuggcccaaaucucauacccugugguccaacgggguccuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgugguuguggaugagcacugcggaaaccggggccccagccucagaacaaccacagucaccggcaagauuauccacgaaugguguugccgguccuguacgcugccuccccugcgcuucagaggggaggacggaugcugguauggcauggagauccggccggugaaagaaaaggaggaaaaucuuguuaagagcauggugucugcuggguccggagaggucgacagcuuuucccucggccugcuguguauuucuaucaugauugaagaggugaugagaagccgcuggucccggaaaaugcucaugaucgggacacuggccguuuucuuucuucugauuaugggacagcucaccuggaacgaucugaucagacugugcauuauggugggcgccaaugcuucugaccgcaugggcauggggacaaccuaccuugcccugauggcgaccuucaagaugagaccuauguuugcugucggacuccuguuccggcgccucacaagcagagaggugcugcuucugacgaucggccucucccugguggccucugccgaacugcccaacagccuugaggaacugggggauggacucgcuaugggcaucaugauucugaaacuccugaccgacuuucaaucccaucagcuuugggccacacugcucagccugaccuucaucaagacaaccuuuucucugcacuaugcuuggaaaacgauggccaugguccuuuccauuguuagccugaucccccucugucugucuacaaccucccagaagaccacauggcucccugugcugcuugggagccugggaugcaagccgcugaccauguuccucauugcggagaauaaaaucuggggccggaagucuuggccccugaacgaaggcaucauggccguggggauugucuccauccuucugagcucccuccugaaaaacgaugugccucucgcuggaccccugauugccggcgggaugcuuaucgcuuguuacguuauuagcggaucuagcgccgaccugucccuggagaaggccgcugaggugucuugggaagaggaagcggagcauagcggcgccucccacaauauccucgucgaagugcaggaugacgggacaaugaaaaucaaggaugaggagcgcgacgauacgcugaccauucuucugaaagcuacacuccuggccguuucuggaguguuuccucucagcauccccgccacccuguucgucugguauuucuggcaaaagaagaaacagagauccggcgugcuuugggacacaccuucucccccggaagucgagcgggcugugcuggaugacggcauuuaccgcaucaugcagagagggcugcucggacggagccagguuggcgugggggucuuucaagaaaacguguuccauaccauguggcacguuacgcgcggagccgugcugauguaucagggcaagagacuugagccuuccugggcgagcgucaaaaaggaccugauuucuuacgggggaggcuggcggcuccagggcuccuggaauaccggggaggaaguccaggugaucgcuguugagcccggcaagaacccuaagaauguccaaacagcccccggcaccuuuaagacaccggaaggggaggugggagccauugcucuggauuucaaaccuggcaccagcgggucucccaucgugaacagagaaggaaagaucgucggccucuacggcaauggggugguuacaacguccggaaccuaugugagcgccauugcgcaggcuaaagccucccaggagggcccucugcccgagaucgaagacgaggucuuucgcaagcggaaccuuacaauuauggaucugcaccccgggucuggaaaaaccagacgcuaccugccugccaucgugcgggaagcuauuaagagaaagcuccgcacccugauccuugccccgacacggguuguggcuagcgagauggccgaagcgcugaaaggcaugcccaucagauaucaaacgaccgccgucaaguccgagcauacagggaaagagauuguggaccucaugugccacgcuaccuucacaaugcgccugcugagcccuguucgggugcccaauuacaacaugaucauuauggaugaagcccauuuuaccgacccuucuuccaucgcugccagaggcuauauuagcacgcgggucggaaugggcgaggccgcugcgaucuucaugacagccacacccccugggucuguggaggcuuuuccgcagagcaaugccgugauccaggaugaggaacgcgacauucccgagagauccuggaacucuggauacgaguggaucaccgauuucccuggcaagacagucugguuuguucccagcauuaaauccgggaaugacaucgccaacugucuccggaagaauggaaagcgcgugauucagcuuucuagaaaaaccuucgauacagaauaucaaaagaccaaaaacaacgacugggacuacguggucacgacagauaucagcgagaugggcgcuaauuuccgggccgacagagugauugauccucgccggugccugaagcccguuauccugaaagacgggccggaaagagugauccucgcgggcccuaugcccgucaccguggcuuccgccgcccagcgccggggaagaauuggccgcaaccacaauaaggagggggaucaguacaucuauaugggacagccccugaacaaugacgaggaucaugcucacuggacagaagccaagaugcuucuggacaacauuaauaccccugagggcaucauucccgcgcucuuugaaccugagcgggaaaagagcgccgcuaucgauggggaguacagacugcgcggagaggccagaaagacguucguugagcugaugcggcgcggcgaccucccgguguggcuuucuuauaaagucgcuuccgagggguuucaauacagcgauagacgguggugcuucgacggcgaacgcaacaaucaggugcuggaggaaaacauggaugucgagaucuggaccaaggagggagaacgcaagaagcugcggcccagauggcucgacgcccgcacauauuccgacccucuggcccuucgggaguuuaaagaguucgccgcgggcagacgcucugugagcggggaucugauucucgagaucggaaagcugccccagcaccugacccagcgggcccaaaaugcucucgacaaccuuguuaugcugcauaauuccgaacagggcgggagagccuaccggcacgcuauggaggagcugccugauacaauugaaacccucaugcugcuugcccugaucgccgugcucacaggaggcgugacccuguuuuuccugucuggccgcgggcucggaaagacgagcauuggccuucugugugucauggcuuccagcguucugcucuggauggcgucuguggagccccauuggaucgccgcuuccaucauucuggaauuuuuccuuauggugcugcucaucccggagccugacagacagcggacaccccaggauaaccaacuggccuaugucgugauugggcugcucuuuaugauccuuaccguugccgcuaaugagaugggacugcuggaaaccaccaaaaaggaccucggcauugggcacguggccgucgagaaccaccaucacgcggccaugcuggauguggaccuucauccugcuagcgccuggacccuguacgcugucgccacaacgaucauuacccccaugaugcgccacacaaucgaaaacaccacagcgaauaucucucucaccgccauugcuaaccaggccgcuauccugaugggacuggauaaaggcuggccuauuuccaagauggacaucggcgugccccuccuugcccuggggugcuacagccagguuaauccgcugacgcucaccgcugccgugcugaugcuugucgcgcauuaugccauuaucggaccuggccugcaagcuaaagccacaagagaggcucagaagcggaccgccgccgggaucaugaagaaccccacaguggauggaauuguugcgaucgaccucgaucccguggucuacgacgcuaaauucgaaaagcagcugggccagauuaugcugcucauccuuuguaccucucaaauucugcugaugcgcacgacaugggcccucugcgagagcaucacccuggcuacagggccucuuaccacccugugggagggauccccgggcaaauuuuggaauacaacgaucgccgugucuauggccaacauuuucagaggcagcuaucucgcuggggccggacuggcguucucccugaugaaaagccucggcgggggacggcgcggcaccggggcccagggagaaacacuuggcgagaaauggaagagacggcugaaucagcuguccaagucugaauuuaacaccuacaaaagaagcggcaucauggagguggaccgcuccgaagcuaaggaggggcucaaacggggagagacaaccaagcacgccguuucuagaggcacggcuaaacugcgcugguucgucgaacggaaucuugugaagcccgaggggaaggugauugaucugggauguggcagagggggauggagcuauuacugcgccggccucaaaaaggucacagaaguuaaaggcuauaccaaagggggaccuggccacgaggaacccaucccuauggcgaccuacggguggaaccuggugaaacugcauuccggaaaggacguguuuuucauucccccugagaaaugugauacacuccuuugcgacaucggcgagucuagcccgaaucccaccauugaagaggggcgcacacugcggguccugaagaugguggaaccuuggcucagaggaaaccaguuuuguaucaagauccugaaucccuacaugccuuccguuguggagacgcuugagcaaaugcagcgcaaacacggcggcaugcugguccggaacccccucagcagaaauucuacccaugaaauguauuggguguccugcgggacaggaaacauuguuagcgccgugaauaugaccucucgcaugcugcugaaccgguucacaauggcucacagaaagccgaccuacgagcgcgaugucgaccucggcgccgggacgagacacguggcuguggaaccugaggucgccaaccuggauaucauuggacagcggaucgaaaauauuaaacaugagcacaaguccaccuggcauuaugacgaggauaaccccuacaaaacaugggcuuaucacggcagcuacgaaguuaagcccucuggguccgccagcuccauggugaauggaguggucaaacuucugaccaaaccuugggacgugauccccaugguuacacagaucgcgaugaccgauacaaccccuuuuggccaacagcgcguguucaaggagaaagucgacacgagaacaccgaaggccaaacggggcaccgcucagauuauggaagugaccgccagauggcucuggggguuucugagccggaacaagaagccccgcaucuguacaagagaggaguucacgcggaaaguucgcucuaaugcugccauuggagccguguuuaucgacgagaaccaauggaauagcgcgaaggaggcugucgaagaugagagauucugggaccuugugcaucgggaacgcgagcugcacaaacagggcaagugcgcuaccugcguuuauaacaugauggggaaaagagaaaagaagcucggagaguuuggcaaagccaaggggucccgggcuauuugguacauguggcugggcgcccgcuuccuggaguucgaagcucucggauuuaugaaugaggaucacugguucucuagagaaaacagccuguccggcguggagggggagggacuucauaaacugggcuacauccuccgggacaucucuaagauuccugggggaaauauguaugccgaugacacagcgggcugggauacccgcaucacagaagacgaucugcagaacgaggccaaaauuaccgacaucauggaacccgagcacgcccuucuggccaaggcuauuuuuaaacucacauaccagaauaaggucgugagaguccaacggccugccaagaacgggaccgugauggauguuaucagccgcagagaccagcggggcuccggacaggugggcacguaugggcugaauaccuucacaaacauggaagcgcagcugaucagacaaauggagucugagggaauuuuuagccccuccgaacucgagaccccgaaccuggccgaacgcguccuugauuggcugggcaaauacgggguggagcggcucaagagaauggcuaucagcggagacgacugugugguuaaaccuauugaugaccgcuucgccacagcucugaccgcccuuaaugauaugggcaaggugcggaaagacaucccccagugggaaccuucuaagggguggaacgauuggcagcagguccccuuuugcucccaucacuuccaccaacugauuaugaaggacggcagagagaucgugguuccuugucgcaaucaggaugagcucgugggacgggcuagagucagccagggcgccggguggucucugcgcgaaacggcgugccugggaaaauccuaugcccagauguggcaacucauguacuuucaucggagagaccugcgccuugcugccaacgccauuuguagcgcugugcccgucgauugggugccgacaucccggaccacauggucuauccacgcccaucaccaguggaugaccacggaggacaugcugagcguuuggaauagaguguggaucgaagagaacccuuggauggaagauaagacccauauuuccaauugggaggacguccccuaucucggcaaacgggaggaccaguggugcgggagccugaucggacuuacagcgagagcuaccugggccacaaacauucaaguggccaucaaucagguucgccggcugauuggcaacgaaaauuaccucgauuacaugaccucuaugaagagauucaaaaacgaguccgaccccgaaggggcucugugguga

SEQ ID NO: 19394 - RNA, 9879 nt, Artificial Sequence
  derived and/or modified CDS sequence (opt5) from DENV-1__KC692495__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggauccuguguguguccaucaugauugaggagguuaugcggucuagauggagccgcaagaugcugaugaccggaacacucgcuguguuccugcuucugaucaugggccagcucaccuggaacgaccugauuagacugugcaucauggucggcgccaaugccuccgaccggauggggaugggaaccacauaccuugcucugauggccacguuuaagaugcgcccuauguucgcggugggccuccuguuuagacggcucaccucucgcgaagugcugcuucugacaauugggcucagccuggucgcuuccguugagcugcccaacucucuugaagagcugggagauggccucgccauggggaucaugaugcugaaacuccugaccgaauuccaaccccaccagcuuuggacaacccugcucagccugacguuugugaagacaacccugucccuugacuaugccuggaaaaccacagcuauggugcugagcauugucucucucuucccucugugucucuccaccacaagccagaagacgaccuggcugccggugcuucugggaucuuuuggcugcaaaccccugacaauguuccucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuacgucaucagcggcuccagcgccgaccugucucuggaaaaggcugccgaggugagcugggaacaggaggcugaacauuccggggccucucacaauauucucguugaggugcaagaugacggaacaaugaaaaucaaggaugaggaacgggacgauacccugacgauucuucugaaagccacccuccuggcugucagcggcguguaucccauguccaucccugcgacacucuucgucugguacuuuuggcagaagaaaaagcagcgcucuggcgugcugugggacacccccagcccgccugagguugaaagagccgugcuugaugacgggauuuaucggauccugcagcgcggacugcucggcagaucccaagucggggugggaguuuuccaggauggcguguuucauacaauguggcacgucacccggggggcugugcugauguaccagggaaagagacuugagcccucuugggccagcgugaaaaaggaccugaucuccuauggcggcggguggcgcuuccagggaagcuggaacacaggcgaggaaguucaagucauugccguggagccugggaaaaaucccaagaacgugcagacgaccccgggaacauuuaaaaccccugaaggcgaggucggggcuaucgcccucgacuucaagcccggaaccucuggcuccccuauugugaaucgggaaggcaagaucguugggcuguacggaaacggcguggucacaacgagcgggaccuacgugucugcgauugcucaggccaaagccucccaagagggaccccuccccgagaucgaagaugagguuuuuaagaaaagaaaucugacaauuauggaccuucacccuggcagcgggaagacccgccgguaucugccggcuaucgugagagaagccaucaaacgcaagcugcggacacucauucuggcgcccaccagagucguggcuuccgagauggccgaagcccuuaagggcaugccuauccgcuaccagacgacagcuguuaaaucugagcauaccggacgggagauuguggaucugaugugccacgccaccuucacaaugagacuccugagccccguccgggugccuaacuauaauaugaucauuauggacgaagcucauuuuaccgaucccgccuccaucgcggcccgcggcuacaucagcacaagaguggggaugggagaggcugccgcuauuuucaugaccgccacgccuccgggcucugucgaagccuuuccccaguccaacgcuguuauccaggacgaggaacgggauauuccugagcgcagcuggaauucuggguaugacuggaucacagauuuccccggaaagaccgugugguucgugccuagcauuaaauccggcaacgacaucgcgaauugucugagaaagaacgggaaacgggucauccaacucucuagaaagacauuugauaccgaguaccagaagacgaaaaacaaugacugggacuaugugguuaccacagauauuagcgaaaugggcgccaacuuccgcgcugaccgggugaucgaucccagacgcugccuuaagccggucauucugaaagacggaccugagcgggugauccuggccggccccaugcccguuaccguggccuccgcugcccagagacgcgggcggauuggaagaaaucagaacaaggaaggcgaucaauacgucuacauggggcagccucucaauaacgacgaggaucacgcgcauuggacagaggcuaaaaugcugcuugacaauaucaacacccccgaaggaauuaucccugcccuguuugagccggaacgcgagaagucugccgcuaucgauggcgaauauagacuccggggggaggcccgcaagacauucguggagcugaugagacggggcgaccugcccgucuggcucagcuacaaaguggcguccgaaggauuucaguauagcgaucgcagauggugcuucgacggcgagcggaauaaccagguucuugaagagaauauggauguggaaauuuggaccaaggagggggagagaaaaaagcugcgcccucgguggcuggacgccagaacguacucugacccccucgcucugcgcgaauuuaaagaguucgccgcuggacggagauccgugagcggcgaucuuauccuggaaauugggaagcucccucaacaccugacacugcgggcccagaacgcucucgacaaucuugucaugcugcacaacuccgagcagggaggcaaagccuaucgccaugcgauggaagagcugcccgauaccaucgagacccucaugcugcuugcccugauugcuguucucacaggcggggugacccuguuuuuccugucuggaaagggccucgggaagacaagcaucggacuucugugugugacggccuccucugcucugcucuggauggccagcgucgaaccgcacuggaucgccgcuuccauuauccuggaguuuuuccuuauggugcugcucauuccugaacccgacagacagcggaccccucaagauaaucagcuggcguacguugugaucggccugcucuuuaugauucuuacagucgccgcuaacgagauggggcugcuggagaccacaaaaaaggaccucggaaucggcuauguggccgccgaaaaccaucagcacgcuaccaugcuggaugucgaccuucaccccgccagcgcguggacgcuguacgccguggcuaccacaguuaucaccccuaugaugcgccauacaauugagaauaccacggccaacaucucucucacagcuauugccaaucaagcggccauccugaugggccuggauaaaggguggcccauuuccaagauggacaucggagugccgcuccuugcucugggcugcuacagccaggucaacccucugacccucacagccgcugugcugaugcuuguugcccacuaugcuauuaucgggcccggacugcaggccaaagcgaccagagaagcccagaagcggaccgcugccggcaucaugaagaaucccacaguggaugggauugucgcuaucgaccucgauccugugguguacgacgccaaauucgagaagcaacugggacagauuaugcugcucauccuuuguacgucucagauucugcugaugcgcaccacaugggcccucugcgaauccaucacccuggcgacaggcccgcuuaccacgcugugggagggcagccccgggaaauucuggaacacaaccaucgcuguuucuauggccaauauuuuuagaggaagcuaucucgcuggcgccgggcuggccuucucccugaugaagucucucggaggcgggcggcgcggaaccggcgcucagggcgagacacuuggggaaaaauggaagagacaacugaaccagcugagcaaguccgaguuuaauaccuacaaacggagcggaaucauggaagucgacagauccgaggccaaggaaggccucaaacgcggggagacaacgaagcaugcggugucucggggaaccgccaaacugagaugguucguggagcgcaaccuugucaagccugaaggcaagguuauugaucugggguguggacggggcggcuggagcuauuacugcgcugggcucaaaaaggugacagaggugaaaggauauaccaagggcgggcccggacacgaagagccuauccccauggccacauacggcuggaaucuggucaaacugcauuccgggaaggacguguuuuucaugccuccggaaaaaugugauacccuccuuugcgacauuggagagucuagccccaacccuacgaucgaggaaggcagaacccugcgcguucugaagaugguggagcccuggcuccggggcaaucaguuuuguaucaagauucugaacccuuacaugcccuccgucguggaaacacuugagcagaugcaaagaaaacacgggggaaugcugguucgcaauccgcucucucggaacagcacccacgagauguauuggguguccugcggcacagggaauaucgucagcgcugugaacaugaccucuagaaugcugcugaaccgcuucacaauggcccaucggaagccuaccuacgaaagagauguggaccucggagcgggcacgcgccacgucgccguugagcccgaaguggcuaaucuggauauuaucgggcagagaauugagaacaucaaaaaugaacauaaguccacauggcacuaugacgaggauaaccccuacaaaaccugggccuaucacggaagcuacgaggugaagccuucuggcuccgcuagcucuauggucaauggcgugguucggcuucugaccaagcccugggacgugauuccuauggucacacagaucgccaugacggauaccacaccguuugggcaacagcgcguguucaaagaaaagguugacaccagaacaccccgggcuaaaagaggaaccacacagaucauggaggugaccgccaaguggcucuggggcuuucugucccggaacaaaaagccucgcauuuguacgagagaagaguucacccggaagguccgcagcaaugcggccaucggggcuguguuuguugacgaaaaccaguggaauuccgccaaagaggcuguggaggaugaaagauucugggaccuuguccaucgggagcgcgaacugcacaagcaaggaaaaugcgccacaugcguguauaacaugaugggcaagagagagaaaaagcucggggaauucggcaaggccaaaggaagccgggcgauuugguacauguggcugggcgcucgcuuucuggaguucgaggcccucggguuuaugaaugaagaucauugguucucuagagagaacagccuguccggagucgaaggcgaggggcuucacaagcugggauacauccuccgggacauuucuaaaauccccggcgggaauauguaugccgaugacaccgcuggcugggauacacgcaucaccgaggacgaucugcagaacgaagccaagauuacggacaucauggagccugaacaugcucuucuggccacaagcauuuuuaaacucaccuaccagaauaaggugguuagagugcagcggcccgcgaaaaacggaacagucauggaugugaucucccgcagagaccaacggggcucugggcaggugggaaccuauggccugaacacguucaccaauauggagguucagcugauuagacagauggaaagcgaggggaucuuucucccguccgagcuggaaacaccuaaccuugccgagcgcgcucuggauuggcucgaaaagcacggagccgagcggcugaagagaauggcuaucucuggcgacgacuguguggucaaacccauugaugaccgcuucgccaccgcgcuuacagcccugaaugauauggggaaggugcggaaagacaucccucaaugggaacccagcaagggcuggaacgauuggcagcagguuccuuuuugcucccaccauuuccaccagcucauuaugaaagacggaagagagaucgugguccccugucgcaaucaagaugagcuggugggccgggcuagagucagccagggggccggauggucucugcgcgaaaccgcuugccucggcaaguccuacgcccagauguggcaacugauguauuuucaucggagagaccuucgccuggcugccaacgcgauuuguagcgccgugccgguugauugggugccugcuucucggacaaccugguccauccacgcccaccaucaguggaugacgacagaggacaugcucagcgucuggaauagaguguggaucgaagagaaccccuggauggaagauaagacccacguuuccucuugggaggaggugcccuaccuggggaaacgggaagaccaguggugcggaagccuuauuggccugaccgccagagcuacaugggccaccaauauccaggucgcgauuaaccaagugcgccggcucaucgggaaugagaacuaucuggacuacaugacauccaugaagagauucaaaaaugaaagcgauccugagggcgcucugugguga

SEQ ID NO: 19395 - RNA, 9879 nt, Artificial Sequence
  derived and/or modified CDS sequence (opt5) from DENV-1__KC692496__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuuuggcgggccuaucagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagauuauccaugagugguguugcagaagcuguacacugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugaccggaacacucgcuguguuccugcuucugaucaugggccagcucaccuggaacgaccugauucggcugugcaucauggucggcgccaaugccuccgaccgcauggggaugggaaccacauaccuugcucugauggccacguuuaagaugagaccuauguucgcggugggccuccuguuucggcgccucaccucuagagaagugcugcuucugacaauugggcucagccuggucgcuuccguugagcugcccaacucucuugaagagcugggagauggccucgccauggggaucaugaugcugaagcuccugaccgaauuccaaccccaccagcuuuggacaacccugcucagccugacguuugugaaaacaacccugucccuugacuaugccuggaagaccacagcuauggugcugagcauugucucucucuucccucugugucucuccaccacaagccagaaaacgaccuggcugccggugcuucugggaucuuuuggcugcaagccccugacaauguuccucaucaccgagaacaaaaucuggggccggaaguccuggccucugaaugaggggauuauggccaucggaauuguuagcauccuucugucuucccuccugaagaacgaugugccccucgcuggcccucugcuugccgggggaaugcugauugcguguuacgucaucagcggcuccagcgccgaccugucucucgaaaaagcugccgaggugagcugggaacaggaggcugaacauuccggggccucucacaauauccugguugaggugcaagaugacggaacaaugaagauuaaagaugaggaacgcgacgauacccuuacgauccugcucaaggccacccugcucgcugucagcggcguguaucccauguccauuccugcgacacuguucgucugguacuuuuggcagaaaaagaaacagagaucuggcgugcuuugggacacccccagcccgccugagguugaacgggccgugcuggaugacgggaucuaucgcauucugcagagaggacuccugggccggucccaagucggggugggaguuuuccaggauggcguguuucauacaauguggcacgucaccagaggggcugugcuuauguaccagggaaagcgccuggagcccucuugggccagcgugaagaaagaccucaucuccuauggcggcggguggcgguuccagggaagcuggaacacaggcgaggaaguucaagucaucgccguggagccugggaagaaucccaaaaacgugcagacgaccccgggaacauuuaagaccccugaaggcgaggucggggcuauugcccuggacuucaaacccggaaccucuggcuccccuaucgugaauagagaaggcaagauuguugggcucuacggaaacggcguggucacaacgagcgggaccuacgugucugcgaucgcucaggccaaggccucccaagagggaccccugcccgagauugaagaugagguuuuuaaaaagcgcaaucuuacaaucauggaccugcacccuggcagcgggaaaacccggagauaucugccggcuauugugcgcgaagccaucaagcggaaacucagaacacugauccuugcgcccacccgcgucguggcuuccgagauggccgaagcccugaagggcaugccuauucgguaccagacgacagcuguuaagucugagcauaccggaagagagaucguggaucucaugugccacgccaccuucacaaugcggcugcugagccccguccgcgugccuaacuauaauaugauuaucauggacgaagcucauuuuaccgaucccgccuccauugcggccagaggcuacaucagcacacggguggggaugggagaggcugccgcuaucuucaugaccgccacgccuccgggcucugucgaagccuuuccccaguccaacgcuguuauucaggacgaggaacgcgauaucccugagagaagcuggaauucuggguaugacuggauuacagauuuccccggaaaaaccgugugguucgugccuagcaucaaguccggcaacgacauugcgaauugucuccggaaaaacgggaagagagucauccaacuuucucgcaaaacauuugauaccgaguaccagaagacgaagaacaaugacugggacuaugugguuaccacagauaucagcgaaaugggcgccaacuuccgggcugacagagugauugauccccgccggugccugaaaccggucauccugaaggacggaccugagagagugauucucgccggccccaugcccguuaccguggccuccgcugcccagcgccgggggagaaucggacgcaaucagaacaaagaaggcgaucaauacgucuacauggggcagccucugaauaacgacgaggaucacgcgcauuggacagaggcuaagaugcuucuggacaauauuaacacccccgaaggaaucauuccugcccucuuugagccggaaagagagaaaucugccgcuaucgauggcgaauaucggcugcgcggggaggccagaaagacauucguggagcugaugcggcgcggcgaccuccccgucuggcuuagcuacaagguggcguccgaaggauuucaguauagcgauagacgguggugcuucgacggcgagagaaauaaccagguucuggaagagaauauggauguggaaaucuggaccaaagagggggagcgcaagaaacugcggccuagauggcucgacgcccgcacguacucugacccccuggcucuucgggaauuuaaggaguucgccgcuggaagacgguccgugagcggcgaucugauucucgaaaucgggaaacugccucaacaccugacacuccgcgcccagaacgcucuugacaaucuggucaugcugcacaacuccgagcagggaggcaaggccuauagacaugcgauggaagagcuccccgauaccauugagacccugaugcuucuggcccucaucgcuguucugacaggcggggugacccuguuuuuccucucuggaaaaggccuugggaagacaagcauuggacugcugugugugacggccuccucugcucuccuguggauggccagcgucgaaccgcacuggaucgccgcuuccaucauucuugaguuuuuccugauggugcuccugaucccugaacccgaccggcagcgcaccccucaagauaaucagcuggcguacguugugauuggccuccuuuuuaugauccugacagucgccgcuaacgagauggggcugcucgagaccacaaagaaagaccugggaauuggcuauguggccgccgaaaaccaucagcacgcuaccaugcuugaugucgaccugcaccccgccagcgcguggacgcucuacgccguggcuaccacaguuaucaccccuaugaugagacauacaaucgagaauaccacggccaacauuucucugacagcuaucgccaaucaagcggccauucugaugggccucgauaagggguggcccaucuccaaaauggacauuggagugccgcuucuggcucugggcugcuacagccaggucaacccucucacccugacagccgcugugcuuaugcugguugcccacuaugcuaucauugggcccggacuccaggccaaggcgacccgggaagcccagaaacgcaccgcugccggcaucaugaagaaucccacaguggaugggaucgucgcuauugaccuggauccugugguguacgacgccaaguucgagaaacaacugggacagaucaugcuccuuauucuguguacgucucagauccugcucaugagaaccacaugggcccugugcgaauccauuacccuugcgacaggcccgcugaccacgcucugggagggcagccccgggaaguucuggaacacaaccaucgcuguuucuauggccaauaucuuucggggaagcuaucuggcuggcgccgggcuggccuucucccucaugaaaucucuuggaggcgggcgcagaggaaccggcgcucagggcgagacacugggggaaaaguggaaacggcaacugaaccagcucagcaaguccgaguuuaauaccuacaagagaagcggaauuauggaagucgaccgcuccgaggccaaagaaggccugaagcggggggagacaacgaaacaugcggugucuagaggaaccgccaagcuucgcugguucguggagcggaaccuggucaaaccugaaggcaagguuaucgaucucggguguggaagaggcggcuggagcuauuacugcgcugggcugaagaaagugacagaggugaagggauauaccaaaggcgggcccggacacgaagagccuauucccauggccacauacggcuggaaucuggucaagcuccauuccgggaaagacguguuuuucaugccuccggaaaagugugauacccuucugugcgacaucggagagucuagccccaacccuacgauugaggaaggccgcacccugcggguucucaaaaugguggagcccuggcugagaggcaaucaguuuuguaucaagauccuuaacccuuacaugcccuccgucguggaaacacuggagcagaugcaacgcaagcacgggggaaugcucguucggaauccgcugucuagaaacagcacccacgagauguauuggguguccugcggcacagggaauauugucagcgcugugaacaugaccucucgcaugcugcucaaccgguucacaauggcccauagaaaaccuaccuacgaacgcgauguggaccugggagcgggcacgagacacgucgccguugagcccgaaguggcuaaucuugauaucauugggcagcggaucgagaacauuaagaaugaacauaaauccacauggcacuaugacgaggauaaccccuacaagaccugggccuaucacggaagcuacgaggugaaaccuucuggcuccgcuagcucuauggucaauggcgugguucgccugcucaccaagcccugggacgugaucccuauggucacacagauugccaugacggauaccacaccguuugggcaacagagaguguucaaggaaaaaguugacacccggacacccagagcuaagcggggaaccacacagaucauggaggugaccgccaaauggcuguggggcuuucuuucccgcaacaagaaaccuagaaucuguacgcgggaagaguucacccgcaaggucagaagcaaugcggccauuggggcuguguuuguugacgaaaaccaguggaauuccgccaaggaggcuguggaggaugaacgguucugggaccugguccaucgcgagagagaacuccacaaacaaggaaagugcgccacaugcguguauaacaugaugggcaaacgggagaagaaacugggggaauucggcaaggccaagggaagccgcgcgaucugguacauguggcugggcgcuagauuucucgaguucgaggcccugggguuuaugaaugaagaucauugguucucucgggagaacagccuuuccggagucgaaggcgaggggcugcacaaacucggauacauucugcgcgacaucucuaagauucccggcgggaauauguaugccgaugacaccgcuggcugggauacaagaaucaccgaggacgaucuucagaacgaagccaaaaucacggacauuauggagccugaacaugcucugcucgccacaagcaucuuuaagcugaccuaccagaauaaagugguucgggugcagcgccccgcgaagaacggaacagucauggaugugauuuccagacgggaccaaagaggcucugggcaggugggaaccuauggccugaacacguucaccaauauggagguucagcucauccgccagauggaaagcgaggggauuuuucugccguccgagcuugaaacaccuaaccuggccgagcgggcucucgauuggcuggaaaaacacggagccgagagacuuaagcgcauggcuaucucuggcgacgacuguguggucaagcccaucgaugaccgguucgccaccgcgcugacagcccucaaugauauggggaaagugagaaaggacauuccucaaugggaacccagcaaaggcuggaacgauuggcagcagguuccuuuuugcucccaccauuuccaccagcugaucaugaaggacggacgcgagauugugguccccugucggaaucaagaugagcuggugggcagagcucgcgucagccagggggccggauggucucuccgggaaaccgcuugccugggcaaauccuacgcccagauguggcaacuuauguauuuucauagacgcgaccugcggcucgcugccaacgcgaucuguagcgccgugccgguugauugggugccugcuucuagaacaaccugguccauucacgcccaccaucaguggaugacgacagaggacaugcugagcgucuggaaucggguguggaucgaagagaaccccuggauggaagauaagacccacguuuccucuugggaggaggugcccuaccuugggaagagagaagaccaguggugcggaagccugaucggccucaccgcccgcgcuacaugggccaccaauauucaggucgcgaucaaccaagugcggagacugauugggaaugagaacuaucuggacuacaugacauccaugaaacgcuucaagaaugaaagcgauccugagggcgcucucugguga

SEQ ID NO: 19396 - RNA, 9879 nt, Artificial Sequence
  derived and/or modified CDS sequence (opt5) from DENV-1__KC692497__SS-prME
agcgugaccaugcugcucaugcugcuucccaccgcucuggcuuuccaccucacgacccggggcggggagccucauaugaucgucuccaagcaggaacggggaaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcaccggcgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggacuuuguugagggacucuccggcgccacauggguggaugucgugcuggaacacgggagcugugugacgaccauggcuaagaauaaacccacacuggacaucgagcuccugaagaccgaagucacaaacccugccguucuucgcaaacugugcauugaggcgaagaucucuaauaccacgacagauuccagauguccgacccaaggagaagccacccucguggaggagcaggacgcuaacuucgugugccggcgcacauuugucgauagaggcuggggcaauggguguggacuguucggcaaagggagccuucugaccugcgccaaguuuaagugcgugacaaaacucgaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcugacagauuacggcgcccucacccuggacuguagcccccggacaggccuugacuucaacgagauggugcugcucaccaugaaggagaaaucuuggcugguccauaagcagugguuucuugaucugccucuccccuggacguccggggcuagcacaucccaagaaaccuggaaucgccaggaccugcuggugacauucaaaaccgcgcacgccaagaagcaggaggucgugguucucggaucucaagaaggcgcuaugcacaccgcccugacaggggccacggagauucagaccagcggaacaaccacaaucuuugcuggccaucuuaaaugcagacugaagauggauaaacucacccugaaggggauguccuaugugauguguacgggcagcuucaaacuggaaaaggaggucgccgagacacagcacggaaccgugcuuguucaggugaaguacgaaggcaccgacgcgccgugcaaaauuccuuucucuacacaagaugagaagggggucacccagaacggacggcucaucacagcuaaucccaucgugacggacaaagaaaagccugugaacauugagaccgagccgcccuuuggcgaauccuauaucguugucggggccggagagaaagcccugaagcugagcugguucaagagaggcucuagcauugggaaaauguuugaagcuacagcccgcggcgcucggagaauggccauccucggagauaccgcgugggacuucggcuccauugggggaguguuuacaucugugggcaagcugguccaucagguguucgggaccgccuacggaguucuuuuuagcggcguguccuggacgaugaaaaucgggaucggcauucugcucaccuggcugggacugaauagccgcucuacaucccuuagcaugaccuguaucgcugucggcauggugacacucuaccuggggguuauggugcaggccgauucuggaugcgucauuaacuggaagggccgggagcugaaauguggguccggaaucuucgugaccaacgaaguucacacauggaccgagcaauauaaguuucaggcugacagcccuaagagacucuccgccgcgauuggcaaagccugggaggaaggggugugcggcauccgcucugcuacgcggcuggagaauauuauguggaagcagaucagcaacgaacuuaaucauauccugcucgagaacgauaugaaauucacagucguggugggagacgccaauggcauucuggcucaggggaagaaaaugaucagaccgcaacccauggaacacaaguacuccuggaaaucuuggggaaaggccaagauuaucggcgccgacauucagaacaccaccuuuaucaucgaugggccugacacacccgaguguccugauggacagcgcgcuuggaauauuugggaggucgaagacuauggcuucggcguuuuuaccacgaacaucuggcugaaacuucgggauagcuacacacagaugugcgaccacagacucauguccgcggccauuaaggauagcaaagcugugcaugccgacaugggguauuggaucgagucugaaaagaaugagaccuggaaacuggcccgcgcuuccuucauugaagugaagacauguaccuggcccaagagccacacacuguggucuaacggaguccucgaguccgagaugaucaucccgaaaauuuucggcgggccuaucagccaacauaauuaccggcccggauauuuuacccagacggccggcccuuggcaccuggggaaacuugaacuggauuucgaccucugcgagggaaccacagugguuguggaugaacacugcggcaacagaggccccucucugcggaccacaaccgucacggggaaaauuauccaugagugguguugccgcagcuguacacugccuccccuuagauuucggggagaggacggcugcugguacgggauggaaauuagaccggugaaggagaaagaagagaaucucguucgcuccauggugagcgcgggaucuggcgaagucgauuccuucagccuggggauccuguguguguccaucaugauugaggagguuaugcggucuagauggagccgcaagaugcucaugaccggaacacuggcuguguuucuucugcucaucaugggccagcugaccuggaacgaccugauuagacuuugcaucauggucggcgccaaugccuccgaccggauggggaccggaacaacguaccuggcucucauggccaccuucaagaugcgcccuauguuugcggugggccuccuguucagacggcugacaucucgcgaagugcuucugcucaccauugggcugagccuggucgcuuccguugagcuucccaacucucuggaagaacucggagauggccuggccauggggaucaugaugcucaaacugcuuacagaauuucaaccccaccagcuguggaccacgcuccugagccugacauucgugaagaccacccuuucccuggacuaugccuggaaaacaaccgcuauggugcucagcauugucucucuguuuccucucugucuguccacaacgagccagaagaccacauggcuuccggugcugcugggaucuuucggcugcaaaccccucaccauguuucugaucacagagaacaagaucuggggcagaaaguccuggccucuuaaugaggggauuauggccaucggaauuguuagcauccugcucucuucccugcucaaaaacgaugugccccuggcuggcccucuuauugccgggggaaugcugaucgcguguuacgucaucagcggcuccagcgccgaccugucucucgaaaaggcugccgaggugagcugggaacaggaggcugaacauuccggggccucucacaauauucugguugaggugcaagaugacggaaccaugaaaaucaaggaugaggaacgggacgauacgcuuaccauucugcucaaagccacacugcucgcugucagcggcguguaucccauguccaucccugcgacccuguucgucugguacuucuggcagaagaaaaagcagcgcucuggcgugcuuugggacacacccagcccgccugagguugaaagagccgugcuggaugacgggauuuaucggauccugcagcgcggacuccugggcagaucccaagucggggugggaguuuuucaggauggcguguuccauaccauguggcacgucacaagaggggcugugcuuauguaccagggaaagagacuggagcccucuugggccagcgugaaaaaggaccucaucuccuauggcggcggguggcgcuuucagggaagcuggaacacgggcgaggaaguucaagucauugccguggagccugggaaaaaucccaagaacgugcagaccacaccgggaaccuucaaaaccccugaaggcgaggucggggcuaucgcccuggacuuuaagcccggaacaucuggcuccccuauugugaaucgggaaggcaagaucguugggcucuacggaaacggcguggucacgaccagcgggacauacgugucugcgauugcucaggccaaagccucccaagagggaccccugcccgagaucgaagaugagguuuucaagaaaagaaaucuuaccauuauggaccugcacccuggcagcgggaagacacgccgguaucugccggcuaucgugagagaagccaucaaacgcaagcuccggacccugauucuugcgcccacgagagucguggcuuccgagauggccgaagcccugaagggcaugccuauccgcuaccagacaaccgcuguuaaaucugagcauaccggacgggagauuguggaucucaugugccacgccacauuuaccaugagacugcugagccccguccgggugccuaacuauaauaugaucauuauggacgaagcucauuucacagaucccgccuccaucgcggcccgcggcuacaucagcaccagaguggggaugggagaggcugccgcuauuuuuaugacggccacaccuccgggcucugucgaagccuucccccaguccaacgcuguuauccaggacgaggaacgggauauuccugagcgcagcuggaacucuggguaugacuggaucaccgauuuucccggaaagacagugugguucgugccuagcauuaaauccggcaacgacaucgcgaauugucucagaaagaacgggaaacgggucauccaacuuucuagaaagaccuucgauacggaguaccagaagaccaaaaacaaugacugggacuaugugguuacaaccgauauuagcgaaaugggcgccaacuuucgcgcugaccgggugaucgaucccagacgcugccugaagccggucauucugaaagacggaccugagcgggugauccucgccggccccaugcccguuacaguggccuccgcugcccagagacgcgggcggauuggaagaaaucagaacaaggaaggcgaucaauacgucuacauggggcagccucugaauaacgacgaggaucacgcgcauuggaccgaggcuaaaaugcuucuggacaauaucaacacacccgaaggaauuaucccugcccucuucgagccggaacgcgagaagucugccgcuaucgauggcgaauauagacugagaggggaagcccgcaagaccuuuguggagcugaugagacggggcgaccuccccgucuggcuuagcuacaaaguggcguccgaaggauuccaguauagcgaucgcagauggugcuuugacggcgagcggaauaaccagguucuggaagagaauauggauguggaaauuuggacgaaggagggggagcgcaagaagcugcgcccucgguggcucgacgccagaacauacucugacccccuggcccuucgcgaguucaaagaguuugccgcuggacggagauccgugagcggcgaucugauccucgaaauugggaagcugccucaacaccugacccuccgggcccagaacgcucuugacaaucuggucaugcugcacaacuccgagcagggaggcaaagccuaucgccaugcgauggaggaacuccccgauaccaucgagacacugaugcuucuggcccucauugcuguucugaccggcggggugacacuguucuuucucucuggaaagggccuugggaagacgagcaucggacugcugugugugaccgccuccucugcucuccuguggauggccagcgucgaaccgcacuggaucgccgcuuccauuauccuugaguucuuucugauggugcuccugauuccugaacccgacagacagcggacaccucaagauaaucagcuggcguacguugugaucggccuccuuuucaugauucugaccgucgccgcuaacgagauggggcugcucgagacaaccaaaaaggaccugggaaucggcuauguggccgccgaaaaccaucagcacgcuacgaugcuugaugucgaccugcaccccgccagcgcguggacccucuacgccguggcuacaaccguuaucacaccuaugaugcgccauaccauugagaauacgacagccaacaucucucugaccgcuauugccaaucaagcggccauccugaugggccucgauaaaggguggcccauuuccaagauggacaucggagugccgcuucuggcucugggcugcuacagccaggucaacccucucacacugaccgccgcugugcuuaugcugguugcccacuaugcuauuaucgggcccggacuccaggccaaagcgaccagagaagcccagaagcggacagcugccggcaucaugaagaaucccacgguggaugggauugucgcuaucgaccuggauccugugguguacgacgccaaauuugagaagcaacugggacagauuaugcuccuuauccuguguaccucucagauucugcucaugcgcacaaccugggcccugugcgaauccaucacacuugcgaccggcccgcugacgacacucugggagggcagccccgggaaauucuggaacaccaccaucgcuguuucuauggccaauauuuucagaggaagcuaucuggcuggcgccgggcuggccuuuucccucaugaagucucuuggaggcgggcggcgcggaacaggcgcucagggcgagacccugggggaaaaauggaagagacaacugaaccagcucagcaaguccgaguucaauacauacaaacggagcggaaucauggaagucgacagauccgaggccaaggaaggccugaaacgcggggagacgaccaagcaugcggugucucggggaacagccaaacuuagaugguuuguggagcgcaaccuggucaagccugaaggcaagguuauugaucucggguguggacggggcggcuggagcuauuacugcgcugggcugaaaaaggugaccgaggugaaaggauauacaaagggcgggcccggacacgaggaaccuauccccauggccaccuacggcuggaaucuggucaaacuccauuccgggaaggacguguucuuuaugccuccggaaaaaugugauacgcuucugugcgacauuggagagucuagccccaacccuaccaucgaggaaggcagaacacugcgcguucucaagaugguggagcccuggcugcggggcaaucaguucuguaucaagauucuuaacccuuacaugcccuccgucguggaaacccuggagcagaugcaaagaaaacacgggggaaugcucguucgcaauccgcugucucggaacagcacacacgagauguauuggguguccugcggcaccgggaauaucgucagcgcugugaacaugacaucuagaaugcugcucaaccgcuuuaccauggcccaucggaagccuacguacgaaagagauguggaccugggagcgggcacacgccacgucgccguugagcccgaaguggcuaaucuugaugugauugggcagagaaucgagaacauuaaaaaugaacauaaguccaccuggcacuaugacgaggauaaccccuacaaaaccugggccuaucacggaagcuacgaggucaagccuucuggcuccgcuagcucuauggugaauggcguugugcggcugcucacaaagcccugggacgucaucccuauggugacgcagauugccaugaccgauacaaccccguucgggcaacagcgcguuuuuaaagaaaagguggacacaagaacaccccgggcuaaaagaggaacaacccagaucauggaggucacggccaaguggcuguggggcuuccuuucccggaacaaaaagccucgcaucuguaccagagaagaguuuacacggaaggugcgcagcaaugcggccauuggggcuguuuucguggacgaaaaccaguggaacuccgccaaagaggcugucgaggaugaaagauuuugggaccuggugcaucgggagcgcgaacuccacaagcaaggaaaaugcgcgaccugcgucuauaacaugaugggcaagagagagaaaaagcugggggaguucggcaaggccaaaggaagccgggccaucugguacauguggcugggcgcucgcuuccucgaguuugaggcccugggguucaugaaugaagaucauugguuuucuagagagaacagccuuuccggaguggaaggcgaggggcugcacaagcucggauacauucugcgggacaucucuaaaauucccggcgggaauauguaugccgaugacacagcuggcugggauacccgcaucacggaggacgaucuucagaacgaagccaagaucacagacauuauggagccugaacaugcucugcucgccaccagcaucuucaaacugacauaccagaauaagguugugagaguccagcggcccgcgaaaaacggaaccgugauggaugugauuucccgcagagaccaacggggcucugggcagguuggaacguauggccugaacaccuuuacaaauauggaggugcagcucaucagacagauggaaagcgaggggauuuuccugccguccgagcuugaaaccccuaaccuggccgagcgcgcucucgauuggcuggaaaagcacggagccgagcggcuuaagagaauggcuaucucuggcgacgacugugucgugaaacccaucgaugaccgcuuugccacagcgcugaccgcccucaaugauauggggaagguucggaaagacauuccucaaugggaacccagcaagggcuggaacgauuggcaacaggugccuuucugcucccaccauuuucaccagcugaucaugaaagacggaagagagauugucgugcccugucgcaaucaagaugagcuggucggccgggcuagagugagccagggggccggauggucucuccgcgaaacagcuugccugggcaaguccuacgcccagauguggcaacuuauguauuuccaucggagagaccugcgccucgcugccaacgcgaucuguagcgccguuccgguggauugggucccugcuucucggaccacgugguccauucacgcccaccaucaguggaugacaaccgaggacaugcugagcguguggaauagaguuuggaucgaagagaaccccuggauggaagauaagacccacguguccucuugggaggagguccccuaccuugggaaacgggaagaccaguggugcggaagccugaucggccucacagccagagcuaccugggccacaaauauucagguggcgaucaaccaagugcgccggcugauugggaaugagaacuaucuggacuacaugacguccaugaagagauuuaaaaaugaaagcgauccugagggcgcucucugguga

SEQ ID NO: 19397 - RNA, 9879 nt, Artificial Sequence
  derived and/or modified CDS sequence (opt5) from DENV-1__KC692498__SS-prME
agcgugaccaugcugcucaugcugcuucccacagcucuggcuuuccaccucacgacccggggcggggagccucauaugaucgucuccaagcaggaacggggaaagucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcaccggcgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggacuuuguugagggacucuccggcgccacauggguggaugucgugcuggaacacgggagcugugugacgaccauggcuaagaauaaacccacacuggacaucgagcuccugaagaccgaagucacaaacccugccguucuucgcaaacugugcauugaggcgaagaucucuaauaccacgacagauuccagauguccgacccaaggagaagccacccucguggaggagcaggacgcuaacuucgugugccggcgcacauuugucgauagaggcuggggcaauggguguggacuguucggcaaagggagccuucugaccugcgccaaguuuaagugcgugacaaaacucgaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcugacagauuacggcgcccucacccuggacuguagcccccggacaggccuugacuucaacgagauggugcugcucaccaugaaggagaaaucuuggcugguccauaagcagugguuucuugaucugccucuccccuggacguccggggcuagcacaucccaagaaaccuggaaucgccaggaccugcuggugacauucaaaaccgcgcacgccaagaagcaggaggucgugguucucggaucucaagaaggcgcuaugcacaccgcccugacaggggccacggagauucagaccagcggaacaaccacaaucuuugcuggccaucuuaaaugcagacugaagauggauaaacucacccugaaggggauguccuaugugauguguacgggcagcuucaaacuggaaaaggaggucgccgagacacagcacggaaccgugcuuguucaggugaaguacgaaggcaccgacgcgccgugcaaaauuccuuucucuacacaagaugagaagggggucacccagaacggacggcucaucacagcuaaucccaucgugacggacaaagaaaagccugugaacauugagaccgagccgcccuuuggcgaauccuauaucguugucggggccggagagaaagcccugaagcugagcugguucaagagaggcucuagcauugggaaaauguuugaagcuacagcccgcggcgcucggagaauggccauccucggagauaccgcgugggacuucggcuccauugggggaguguuuacaucugugggcaagcugguccaucagguguucgggaccgccuacggaguucuuuuuagcggcguguccuggacgaugaaaaucgggaucggcauucugcucaccuggcugggacugaauagccgcucuacaucccuuagcaugaccuguaucgcugucggcauggugacacucuaccuggggguuauggugcaggccgauucuggaugcgucauuaacuggaagggccgggagcugaaauguggguccggaaucuucgugaccaacgaaguucacacauggaccgagcaauauaaguuucaggcugacagcccuaagagacucuccgccgcgauuggcaaagccugggaggaaggggugugcggcauccgcucugcuacgcggcuggagaauauuauguggaagcagaucagcaacgaacuuaaucauauccugcucgagaacgauaugaaauucacagucguggugggagacgccaauggcauucuggcucaggggaagaaaaugaucagaccgcaacccauggaacacaaguacuccuggaaaucuuggggaaaggccaagauuaucggcgccgacauucagaacaccaccuuuaucaucgaugggccugacacacccgaguguccugauggacagcgcgcuuggaauauuugggaggucgaagacuauggcuucggcguuuuuaccacgaacaucuggcugaaacuucgggauagcuacacacagaugugcgaccacagacucauguccgcggccauuaaggauagcaaagcugugcaugccgacaugggguauuggaucgagucugaaaagaaugagaccuggaaacuggcccgcgcuuccuucauugaagugaagacauguaccuggcccaagagccacacacuguggucuaacggaguccucgaguccgagaugaucaucccgaaaauuuucggcgggccuaucagccaacauaauuaccggcccggauauuuuacccagacggccggcccuuggcaccuggggaaacuugaacuggauuucgaccucugcgagggaaccacagugguuguggaugaacacugcggcaacagaggccccucucugcggaccacaaccgucacggggaaaauuauccaugagugguguugccgcagcuguacacugccuccccuuagauuucggggagaggacggcugcugguacgggauggaaauuagaccggugaaggagaaagaagagaaucucguucgcuccauggugagcgcgggaucuggcgaagucgauuccuucagccuggggauccuguguguguccaucaugauugaggagguuaugcggucuagauggagccgcaagaugcucaugaccggaacacuggcuguguuucuucugcucaucaugggccagcugaccuggaacgaccugauuagacuuugcaucauggucggcgccaaugccuccgaccggauggggaccggaacaacguaccuggcucucauggccaccuucaagaugcgcccuauguuugcggugggccuccuguucagacggcugacaucucgcgaagugcuucugcucaccauugggcugagccuggucgcuuccguugagcuucccaacucucuggaagaacucggagauggccuggccauggggaucaugaugcucaaacugcuuacagaauuucaaccccaccagcuguggaccacgcuccugagccugacauucgugaagaccacccuuucccuggacuaugccuggaaaacaaccgcuauggugcucagcauugucucucuguuuccucucugucuguccacaacgagccagaagaccacauggcuuccggugcugcugggaucuuucggcugcaaaccccucaccauguuucugaucacagagaacaagaucuggggcagaaaguccuggccucuuaaugaggggauuauggccaucggaauuguuagcauccugcucucuucccugcucaaaaacgaugugccccuggcuggcccucuuauugccgggggaaugcugaucgcguguuacgucaucagcggcuccagcgccgaccugucucucgaaaaggcugccgaggugagcugggaacaggaggcugaacauuccggggccucucacaauauucugguugaggugcaagaugacggaaccaugaaaaucaaggaugaggaacgggacgauacgcuuaccauucugcucaaagccacacugcucgcugucagcggcguguaucccauguccaucccugcgacccuguucgucugguacuucuggcagaagaaaaagcagcgcucuggcgugcuuugggacacacccagcccgccugagguugaaagagccgugcuggaugacgggauuuaucggauccugcagcgcggacuccugggcagaucccaagucggggugggaguuuuucaggauggcguguuccauaccauguggcacgucacaagaggggcugugcuuauguaccagggaaagagacuggagcccucuugggccagcgugaaaaaggaccucaucuccuauggcggcggguggcgcuuucagggaagcuggaacacgggcgaggaaguucaagucauugccguggagccugggaaaaaucccaagaacgugcagaccacaccgggaaccuucaaaaccccugaaggcgaggucggggcuaucgcccuggacuuuaagcccggaacaucuggcuccccuauugugaaucgggaaggcaagaucguugggcucuacggaaacggcguggucacgaccagcgggacauacgugucugcgauugcucaggccaaagccucccaagagggaccccugcccgagaucgaagaugagguuuucaagaaaagaaaucuuaccauuauggaccugcacccuggcagcgggaagacacgccgguaucugccggcuaucgugagagaagccaucaaacgcaagcuccggacccugauucuugcgcccacgagagucguggcuuccgagauggccgaagcccugaagggcaugccuauccgcuaccagacaaccgcuguuaaaucugagcauaccggacgggagauuguggaucucaugugccacgccacauuuaccaugagacugcugagccccguccgggugccuaacuauaauaugaucauuauggacgaagcucauuucacagaucccgccuccaucgcggcccgcggcuacaucagcaccagaguggggaugggagaggcugccgcuauuuuuaugacggccacaccuccgggcucugucgaagccuucccccaguccaacgcuguuauccaggacgaggaacgggauauuccugagcgcagcuggaacucuggguaugacuggaucaccgauuuuagcggaaagacagugugguucgugcccuccauuaaaucuggcaacgacaucgcgaauugucucagaaagaacgggaaacgggucauccaacuuagcagaaagaccuucgauacggaguaccagaagaccaaaaacaaugacugggacuaugugguuacaaccgauauuuccgaaaugggcgccaacuuucgcgcugaccgggugaucgauccuagacgcugccugaagcccgucauucugaaagacggaccggagcgggugauccucgccggcccuaugcccguuacaguggccucugcugcccagagacgcgggcggauuggaagaaaucagaacaaggaaggcgaucaauacgucuacauggggcagccccugaauaacgacgaggaucacgcgcauuggaccgaggcuaaaaugcuucuggacaauaucaacacaccugaaggaauuauccccgcccucuucgagccugaacgcgaaaagagcgccgcuaucgauggcgaauauagacugagaggggaagcccgcaagaccuuuguggagcugaugagacggggcgaccucccggucuggcuuuccuacaaaguggcgagcgaaggauuccaguauucugaucgcagauggugcuuugacggcgagcggaauaaccagguucuggaagagaauauggauguggaaauuuggacgaaggagggggagcgcaagaagcugcgcccccgguggcucgacgccagaacauacuccgacccucuggcccuucgcgaguucaaagaguuugccgcuggacggagaagcguguccggcgaucugauccucgaaauugggaagcugccccaacaccugacccuccgggcccagaacgcucuugacaaucuggucaugcugcacaacucugagcagggaggcaaagccuaucgccaugcgauggaggaacucccugauaccaucgagacacugaugcuucuggcccucauugcuguucugaccggcggggugacacuguucuuucucagcggaaagggccuugggaagacguccaucggacugcugugugugaccgccucuagcgcucuccuguggauggccuccgucgaaccccacuggaucgccgcuagcauuauccuugaguucuuucugauggugcuccugauuccggaaccugacagacagcggacaccccaagauaaucagcuggcguacguugugaucggccuccuuuucaugauucugaccgucgccgcuaacgagauggggcugcucgagacaaccaaaaaggaccugggaaucggcuauguggccgccgaaaaccaucagcacgcuacgaugcuugaugucgaccugcacccugccucugcguggacccucuacgccguggcuacaaccguuaucacacccaugaugcgccauaccauugagaauacgacagccaacaucucccugaccgcuauugccaaucaagcggccauccugaugggccucgauaaaggguggccuauuagcaagauggacaucggagugccccuucuggcucugggcugcuacucucaggucaacccgcucacacugaccgccgcugugcuuaugcugguugcccacuaugcuauuaucgggccuggacuccaggccaaagcgaccagagaagcccagaagcggacagcugccggcaucaugaagaaucccacgguggaugggauugucgcuaucgaccuggaucccgugguguacgacgccaaauuugagaagcaacugggacagauuaugcuccuuauccuguguaccucccagauucugcucaugcgcacaaccugggcccugugcgaaagcaucacacuugcgaccggcccucugacgacacucugggagggcucuccggggaaauucuggaacaccaccaucgcuguuagcauggccaauauuuucagaggauccuaucuggcuggcgccgggcuggccuuuucucucaugaaaagccuuggaggcgggcggcgcggaacaggcgcucagggcgagacccugggggaaaaauggaagagacaacugaaccagcucuccaagagcgaguucaauacauacaaacgguccggaaucauggaagucgacagaucugaggccaaggaaggccugaaacgcggggagacgaccaagcaugcggugagccggggaacagccaaacuuagaugguuuguggagcgcaaccuggucaagcccgaaggcaagguuauugaucucggguguggacggggcggcugguccuauuacugcgcugggcugaaaaaggugaccgaggugaaaggauauacaaagggcgggccuggacacgaggagcccaucccuauggccaccuacggcuggaaucuggucaaacuccauucugggaaggacguguucuuuaugcccccugaaaaaugugauacgcuucugugcgacauuggagagagcuccccgaaccccaccaucgaggaaggcagaacacugcgcguucucaagaugguggagccuuggcugcggggcaaucaguucuguaucaagauucuuaaccccuacaugccuucugucguggaaacccuggagcagaugcaaagaaaacacgggggaaugcucguucgcaauccccugagccggaacuccacacacgagauguauugggugagcugcggcaccgggaauaucgucucugcugugaacaugacauccagaaugcugcucaaccgcuuuaccauggcccaucggaagccgacguacgaaagagauguggaccugggagcgggcacacgccacgucgccguugagccugaaguggcuaaucuugaugugauugggcagagaaucgagaacauuaaaaaugaacauaagagcaccuggcacuaugacgaggauaaccccuacaaaaccugggccuaucacggaucuuacgaggucaagcccuccggcagcgcuucuuccauggugaauggcguugugcggcugcucacaaagccuugggacgucauccccauggugacgcagauugccaugaccgauacaaccccuuucgggcaacagcgcguuuuuaaagaaaagguggacacaagaaccccgcgggcuaaaagaggaacaacccagaucauggaggucacggccaaguggcuguggggcuuccuuagccggaacaaaaagccccgcaucuguaccagagaagaguuuacacggaaggugcgcuccaaugcggccauuggggcuguuuucguggacgaaaaccaguggaauagcgccaaagaggcugucgaggaugaaagauuuugggaccuggugcaucgggagcgcgaacuccacaagcaaggaaaaugcgcgaccugcgucuauaacaugaugggcaagagagagaaaaagcugggggaguucggcaaggccaaaggaucucgggccaucugguacauguggcugggcgcucgcuuccucgaguuugaggcccugggguucaugaaugaagaucauugguuuagcagagagaacucccuuucuggaguggaaggcgaggggcugcacaagcucggauacauucugcgggacaucagcaaaauuccuggcgggaauauguaugccgaugacacagcuggcugggauacccgcaucacggaggacgaucuucagaacgaagccaagaucacagacauuauggagcccgaacaugcucugcucgccaccuccaucuucaaacugacauaccagaauaagguugugagaguccagcggccugcgaaaaacggaaccgugauggaugugauuucucgcagagaccaacggggcagcgggcagguuggaacguauggccugaacaccuuuacaaauauggaggugcagcucaucagacagauggaauccgaggggauuuuccugcccucugagcuugaaaccccgaaccuggccgagcgcgcucucgauuggcuggaaaagcacggagccgagcggcuuaagagaauggcuaucagcggcgacgacugugucgugaaaccuaucgaugaccgcuuugccacagcgcugaccgcccucaaugauauggggaagguucggaaagacauuccccaaugggaaccuuccaagggcuggaacgauuggcaacaggugcccuucugcagccaccauuuucaccagcugaucaugaaagacggaagagagauugucgugccuugucgcaaucaagaugagcuggucggccgggcuagagugucucagggggccggauggucccuccgcgaaacagcuugccugggcaagagcuacgcccagauguggcaacuuauguauuuccaucggagagaccugcgccucgcugccaacgcgaucuguucugccguucccguggauugggucccggcuucccggaccacguggagcauucacgcccaccaucaguggaugacaaccgaggacaugcuguccguguggaauagaguuuggaucgaagagaacccuuggauggaagauaagacccacgugucuagcugggaggagguccccuaccuugggaaacgggaagaccaguggugcggaucccugaucggccucacagccagagcuaccugggccacaaauauucagguggcgaucaaccaagugcgccggcugauugggaaugagaacuaucuggacuacaugacgagcaugaagagauuuaaaaaugaaucugaucccgagggcgcucucugguga

SEQ ID NO: 19398 - RNA, 9879 nt, Artificial Sequence
  derived and/or modified CDS sequence (opt5) from DENV-1__KC692499__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgugaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggccagcacaucccaagaaaccuggaaucgccaggaccuccuggucacauuuaaaaccgcucacgcgaagaagcaggaggugguugugcugggaucucaagaaggcgccaugcacaccgcucucacaggggccacggagauucagaccagcggaacaaccacaaucuucgccggccaucugaaaugcagacuuaagauggauaaacugacccucaaggggauguccuaugucauguguacgggcagcuucaaacuggaaaaggagguggcugagacacagcacggaaccguucuggugcaggucaaguacgaaggcaccgacgccccgugcaaaauuccuuuuucuacacaagaugagaagggggugacccagaacggacggcuuaucacagcgaaucccaucgugacggacaaagaaaagccuguuaacauugagaccgagccccccuucggcgaauccuauaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaucagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaccucggggugaugguccaggcugauucuggaugcgugauuaacuggaagggccgggagcugaaauguggguccggaaucuuuguuaccaacgaagugcacacauggaccgagcaauauaaguuccaggccgacagcccuaagagacuguccgcugccauuggcaaagcgugggaggaaggggucugcggcauccgcucugccacgcggcucgagaauauuauguggaagcagaucagcaacgaacugaaucauauccuucuggagaacgauaugaaauuuacagugguggucggagacgcuaauggcauucucgcccaggggaagaaaaugaucagaccgcaacccauggaauacaaguauuccuggaaaucuuggggaaaggcuaagauuaucggcgccgacauucagaacaccaccuucaucaucgaugggccugacacacccgaguguccugauggacagcgcgccuggaauauuugggagguugaagacuacggcuuuggcguguucaccacgaacaucuggcugaaacugcgggauagcuauacacagaugugcgaccacagacuuauguccgcugcgauuaaggauagcaaagccgugcacgcugacaugggguacuggaucgagucugaaaagaaugagaccuggaaacucgcccgcgccuccuucauugaagucaagacauguaccuggcccaagagccauacacuguggucuaacggagugcuggaguccgagaugaucaucccgaaaauuuuuggcgggccuaucagccaacacaauuaucggcccggauacuucacccagacggcuggcccuuggcaucucgggaagcuggaacuugauuuugaccugugcgagggaaccacaguuguggucgaugaacacugcggcaacagaggccccucucuccggaccacaaccgugacggggaaaauuauccacgagugguguugccgcagcuguacacugccuccccugagauuccggggagaggacggcugcugguacgggauggaaauuagaccgguuaaggagaaagaagagaaucuugugcgcuccauggucagcgccggaucuggcgaaguggauuccuuuagccucgggauccuguguguuuccaucaugauugaggaggugaugcggucuagauggagccgcaagaugcugaugaccggaacacucgcggucuuccugcuucugaucaugggccagcucaccuggaacgaccugauuagacugugcaucauggugggcgcuaaugccuccgaccggauggggaugggaaccacauaucuugcccugauggcuacguuuaagaugcgcccuauguucgccgugggccuccuguuuagacggcucaccucucgcgaaguccugcuucugacaauugggcucagccugguugcguccguggagcugcccaacucucuugaagagcugggagauggccucgcuauggggaucaugaugcugaaacuccugaccgaauuccaaccccaucagcuuuggacaacccugcucagccugacguuugugaagacaacccugucccuugacuacgccuggaaaaccacagccaugguccugagcauugugucucucuucccucugugucucuccaccacaagccagaagacgaccuggcugccgguucuucugggaucuuuuggcugcaaaccccugacaauguuccucaucaccgagaacaagaucuggggcagaaaguccuggccucugaaugaggggauuauggcuaucggaauugugagcauccuucugucuucccuccugaaaaacgaugucccccucgccggcccucugauugcugggggaaugcuuaucgccuguuaugugaucagcggcuccagcgcggaccugucucuggaaaaggccgcugagguuagcugggaacaggaggccgaacacuccggggcuucucauaauauucucguggagguccaagaugacggaacaaugaaaaucaaggaugaggaacgggacgauacccugacgauucuucugaaagccacccuccuggccgugagcggcgucuaccccauguccaucccugcuacacucuucgugugguauuuuuggcagaagaaaaagcagcgcucuggcguucugugggacacccccagcccgccugagguggaaagagcgguccuugaugacgggauuuaccggauccugcagcgcggacugcucggcagaucccaaguggggguuggaguguuccaggauggcgucuuucacacaauguggcaugugacccggggggccgugcugauguaucagggaaagagacuugagcccucuugggcuagcguuaaaaaggaccugaucuccuacggcggcggguggcgcuuccagggaagcuggaacacaggcgaggaaguccaagugauugccguggagccugggaaaaaucccaagaacguccagacgaccccgggaacauuuaaaaccccugaaggcgaggugggggccaucgcucucgacuucaagcccggaaccucuggcuccccuauuguuaaucgggaaggcaagaucguggggcuguacggaaacggcgucgugacaacgagcgggaccuauguuucugccauugcgcaggcuaaagccucccaagagggaccccuccccgagaucgaagaugagguguuuaagaaaagaaaucugacaauuauggaccuucacccuggcagcgggaagacccgccgguaccugccggccaucgucagagaagcuaucaaacgcaagcugcggacacucauucuggcccccaccagagugguugcguccgagauggcugaagcccuuaagggcaugccuauccgcuaucagacgacagccgugaaaucugagcacaccggacgggagauugucgaucugaugugccaugcuaccuucacaaugagacuccugagccccgugcgggugccuaacuacaauaugaucauuauggacgaagcccacuuuaccgaucccgcuuccaucgccgcgcgcggcuauaucagcacaagagucgggaugggagaggccgcugccauuuucaugaccgcuacgccuccgggcucuguugaagccuuuccccaguccaacgccgugauccaggacgaggaacgggauauuccugagcgcagcuggaauucuggguacgacuggaucgcugauuuccccggaaagacagugugguucgucccuagcauuaaauccggcaacgacaucgcgaauugucugagaaagaacgggaaacgggugauccaacucucuagaaagaccuuugauacagaguaucagaagaccaaaaacaaugacugggacuacguugugacgaccgauauuagcgaaaugggcgccaacuuccgcgcugaccgggucaucgaucccagacgcugccuuaagccggugauucugaaagacggaccugagcggguuauccuggccggccccaugcccgugacagucgccuccgcugcccagagacgcgggcggauuggaagaaaucagaacaaggaaggcgaucaauacguguauauggggcagccucucaauaacgacgaggaucaugcgcacuggaccgaggcuaaaaugcugcuugacaauaucaacacacccgaaggaauuaucccugcccuguuugagccggaacgcgagaagucugccgcuaucgauggcgaauacagacuccggggggaggcccgcaagaccuucgucgagcugaugagacggggcgaccugcccguguggcucagcuauaaaguugcguccgaaggauuucaguacagcgaucgcagauggugcuucgacggcgagcggaauaaccaggugcuugaagagaauauggauguggaaauuuggacaaaggagggggagagaaaaaagcugcgcccucgguggcuggacgccagaaccuauucugacccccucgcucugcgcgaauuuaaagaguucgccgcuggacggagauccgucagcggcgaucuuauccuggaaauugggaagcucccucaacaucugacgcugcgggcccagaacgcucucgacaaucuuguuaugcugcacaacuccgagcagggaggcaaagccuaccgccacgcgauggaagagcugcccgauacaaucgagacccucaugcugcuugcccugauugcugugcucaccggcggggugacacuguuuuuccugucuggaaagggccucgggaagaccagcaucggacuucugugugucacagccuccucugcucugcucuggauggccagcguggaaccgcauuggaucgccgcuuccauuauccuggaguuuuuccuuaugguucugcucauuccugaacccgacagacagcggacgccucaagauaaucagcuggcguauguggucaucggccugcucuuuaugauucuuaccguggccgcuaacgagauggggcugcuggagacaaccaaaaaggaccucggaaucggcuacgucgccgccgaaaaccaccagcaugcuacaaugcuggauguggaccuucaccccgccagcgcguggacccuguacgccguugcuacgaccgugaucacaccuaugaugcgccacaccauugagaauacaaccgccaacaucucucucacggcuauugccaaucaagcggccauccugaugggccuggauaaaggguggcccauuuccaagauggacaucggagucccgcuccuugcucugggcugcuauagccaggugaacccucugacacucaccgccgcuguucugaugcuuguggcccauuacgcuauuaucgggcccggacugcaggccaaagcgacaagagaagcccagaagcggaccgcugccggcaucaugaagaaucccaccgucgaugggauuguggcuaucgaccucgauccugugguuuaugacgccaaauucgagaagcaacugggacagauuaugcugcucauccuuuguacaucucagauucugcugaugcgcacgaccugggcccucugcgaauccaucacacuggcgaccggcccgcuuacaacccugugggagggcagccccgggaaauucuggaacacgacaaucgcugucucuauggccaauauuuuuagaggaagcuaccucgcuggcgccgggcuggccuucucccugaugaagucucucggaggcgggcggcgcggaaccggcgcucagggcgagacccuuggggaaaaauggaagagacaacugaaccagcugagcaaguccgaguuuaauacauauaaacggagcggaaucauggaaguggacagauccgaggccaaggaaggccucaaacgcggggagaccacaaagcacgcggugucucggggaacggccaaacugagaugguucgucgagcgcaaccuuguuaagccugaaggcaaggugauugaucugggguguggacggggcggcuggagcuacuauugcgcugggcucaaaaaggugaccgaggucaaaggauacacaaagggcgggcccggacaugaagagccuauccccauggccaccuacggcuggaaucuggugaaacugcacuccgggaaggacguuuuuuucaugccuccggaaaaaugugauacacuccuuugcgacauuggagagucuagccccaacccuaccaucgaggaaggcagaacgcugcgcgugcugaagauggucgagcccuggcuccggggcaaucaguuuuguaucaagauucugaacccuuauaugcccuccgugguugaaacccuugagcagaugcaaagaaaacaugggggaaugcuggugcgcaauccgcucucucggaacagcacacacgagauguacugggucuccugcggcaccgggaauaucgugagcgcugugaacaugacaucuagaaugcugcugaaccgcuucaccauggcccaccggaagccuacauaugaaagagaugucgaccucggagcgggcacccgccauguugccguggagcccgaaguggcuaaucuggauauuaucgggcagagaauugagaacaucaaaaaugaacacaaguccacguggcauuacgacgaggauaaccccuauaaaacaugggccuaccacggaagcuaugaggucaagccuucuggcuccgcuagcucuauggugaauggcguugugcggcuucugaccaagcccugggacgucauuccuauggugacccagaucgccaugacagauacgaccccguuugggcaacagcgcguuuucaaagaaaagguggacacaagaaccccccgggcuaaaagaggaacaacccagaucauggaggucacagccaaguggcucuggggcuuucugucccggaacaaaaagccucgcauuuguaccagagaagaguucacgcggaaggugcgcagcaaugcggccaucggggcuguuuuuguggacgaaaaccaguggaauuccgccaaagaggcugucgaggaugaaagauucugggaccuugugcaccgggagcgcgaacugcauaagcaaggaaaaugcgccaccugcgucuacaacaugaugggcaagagagagaaaaagcucggggaauucggcaaggccaaaggaagccgggcgauuugguacauguggcugggcgcucgcuuucuggaguucgaggcccucggguuuaugaaugaagaucacugguucucuagagagaacagccuguccggaguggaaggcgaggggcuucauaagcugggauauauccuccgggacauuucuaaaauccccggcgggaauauguacgccgaugacacagcuggcugggauacccgcaucacagaggacgaucugcagaacgaagccaagauuaccgacaucauggagccugaacacgcucuucuggccacgagcauuuuuaaacucacauaucagaauaagguugugagaguccagcggcccgcgaaaaacggaaccgugauggaugugaucucccgcagagaccaacggggcucugggcagguuggaacauacggccugaacaccuucacgaauauggaggugcagcugauuagacagauggaaagcgaggggaucuuucucccguccgagcuggaaaccccuaaccuugccgagcgcgcucuggauuggcucgaaaagcauggagccgagcggcugaagagaauggcuaucucuggcgacgacugugucgugaaacccauugaugaccgcuucgccacagcgcuuaccgcccugaaugauauggggaagguucggaaagacaucccucaaugggaacccagcaagggcuggaacgauuggcagcaggugccuuuuugcucccaccacuuccaucagcucauuaugaaagacggaagagagaucgucgugcccugucgcaaucaagaugagcuggucggccgggcuagagugagccagggggccggauggucucugcgcgaaacagcuugccucggcaaguccuaugcccagauguggcaacugauguacuuucaccggagagaccuucgccuggcugccaacgcgauuuguagcgccguuccgguggauugggucccugcuucucggaccacaugguccauccaugcccaccaccaguggaugaccacggaggacaugcucagcguguggaauagaguuuggaucgaagagaaccccuggauggaagauaagacacauguguccucuugggaggagguccccuaucuggggaaacgggaagaccaguggugcggaagccuuauuggccugaccgccagagcuaccugggccacaaauauccagguggcgauuaaccaagugcgccggcucaucgggaaugagaacuaccuggacuacaugaccuccaugaagagauucaaaaaugaaagcgauccugagggcgcucugugguga

SEQ ID NO: 19399 - RNA, 9879 nt, Artificial Sequence
  derived and/or modified CDS sequence (opt5) from DENV-1__KC692500__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggggaaaucuuggcucguccauaagcagugguuccuggaucuuccucugcccuggacguccggagcuagcacaucccaagagaccuggaaucgccaggaccuccuggugacauuuaaaaccgcgcacgccaagaagcaggaagucgugguucugggcucucaagagggggcuaugcacaccgcccucacaggagccacggaaauucagaccagcggcacaaccacaaucuucgcugggcaucugaaaugcagacuuaagauggauaaacugacccucaagggcauguccuaugugauguguacgggaagcuucaaacuggagaaggaagucgccgagacacagcacggcaccgugcugguucaggugaaguacgaggggaccgacgcgccgugcaaaauuccuuuuucuacacaagaugaaaagggagucacccagaacggccggcuuaucacagcuaaucccaucgugacggacaaagagaagccugugaacauugaaaccgagccccccuucggggaguccuauaucguugucggagccggcgaaaaagcccucaagcugagcugguuuaagagagggucuagcauuggcaaaauguucgaggcuacagcccgcggagcucggagaauggccauccugggcgauaccgcgugggacuuuggguccauuggaggcguguucacaucuguggggaagcucguccaucagguguuuggaaccgccuacggcguucuguucagcgggguguccuggacgaugaaaaucggcaucggaauucuucugaccuggcucggccugaauagccgcucuacaucccugagcaugaccuguaucgcugucgggauggugacacuuuaccucggaguuauggugcaggccgauucuggcugcgucauuaacuggaaggggcgggaacugaaauguggauccggcaucuuugugaccaacgagguucacacauggaccgaacaauauaaguuccaggcugacagcccuaagagacuguccgccgcgauugggaaagccugggaggagggcgugugcggaauccgcucugcuacgcggcucgaaaauauuauguggaagcagaucagcaacgagcugaaucauauccuucuggaaaacgauaugaaauuuacagucguggugggcgacgccaaugggauucucgcucagggaaagaaaaugaucagaccgcaacccauggagcacaaguacuccuggaaaucuuggggcaaggccaagauuaucggggccgacauucagaacaccaccuucaucaucgauggaccugacacacccgaauguccugauggccagcgcgcuuggaauauuugggaggucgaggacuauggcuuugggguuuucaccacgaacaucuggcugaaacugcgggauagcuacacacagaugugcgaccacagacuuauguccgcggccauuaaggauagcaaagcugugcaugccgacaugggauauuggaucgaaucugagaagaaugaaaccuggaaacucgcccgcgcuuccuucauugaggugaagacauguaccuggcccaagagccacacacuguggucuaacggcguccuggaauccgagaugaucaucccgaaaauuuuugggggaccuaucagccaacauaauuaccggcccggcuauuucacccagacggccgggccuuggcaccucggaaagcuggagcuugauuuugaccugugcgaaggcaccacagugguuguggaugagcacugcggcaacagagggcccucucuccggaccacaaccgucacgggaaaaauuauccaugaaugguguugccgcagcuguacacugccuccccugagauuccggggcgaggacgggugcugguacggaauggagauuagaccggugaaggaaaaagaggaaaaucuuguucgcuccauggugagcgcgggcucuggggaggucgauuccuuuagccucggaauccuguguguguccaucaugauugaagagguuaugcggucuagauggagccgcaagaugcugaugaccggcacacucgcuguguuccugcuucugaucaugggccagcucaccuggaacgaccugauuagacugugcaucauggucggggccaaugccuccgaccggaugggaaugggcaccacauaccuugcucugauggccacguuuaagaugcgcccuauguucgcgguggggcuccuguuuagacggcucaccucucgcgaggugcugcuucugacaauuggacucagccuggucgcuuccguugaacugcccaacucucuugaggaacugggcgaugggcucgccaugggaaucaugaugcugaaacuccugaccgaguuccaaccccaccagcuuuggacaacccugcucagccugacguuugugaagacaacccugucccuugacuaugccuggaaaaccacagcuauggugcugagcauugucucucucuucccucugugucucuccaccacaagccagaagacgaccuggcugccggugcuucugggcucuuuuggcugcaaaccccugacaauguuccucaucaccgaaaacaagaucugggggagaaaguccuggccucugaaugagggaauuauggccaucggcauuguuagcauccuucugucuucccuccugaaaaacgaugugccccucgcugggccucugauugccggaggcaugcuuaucgcguguuacgucaucagcggguccagcgccgaccugucucuggagaaggcugccgaagugagcugggagcaggaagcugagcauuccggagccucucacaauauucucguugaagugcaagaugacggcacaaugaaaaucaaggaugaggagcgggacgauacccugacgauucuucugaaagccacccuccuggcugucagcggcguguaucccauguccaucccugcgacacucuucgucugguacuuuuggcagaagaaaaagcagcgcucuggggugcugugggacacccccagcccgccugaaguugagagagccgugcuugaugacggaauuuaucggauccugcagcgcggccugcucgggagaucccaagucggagugggcguuuuccaggaugggguguuucauacaauguggcacgucacccggggagcugugcugauguaccagggcaagagacuugaacccucuugggccagcgugaaaaaggaccugaucuccuauggcgggggauggcgcuucaaaggcagcuggaacacaggggaggagguucaggucauugccguggaaccuggaaagaaucccaaaaacgugcaaacgaccccgggcacauuuaagaccccugagggggaagucggagcuaucgcccucgacuucaagcccggcaccucuggcuccccuauugugaaucgggaggggaaaaucguuggacuguacggcaacgggguggucacaacgagcggaaccuacgugucugcgauugcucaggccaaggccucccaggaaggcccccuccccgagaucgaggaugaaguuuuuaaaaagagaaaucugacaauuauggaccuucacccugggagcggcaaaacccgccgguaucugccggcuaucgugagagaggccaucaagcgcaagcugcggacacucauucuggcgcccaccagagucguggcuuccgaaauggccgaggcccuuaaaggaaugccuauccgcuaccaaacgacagcuguuaagucugaacauaccggccgggagauuguggaucugaugugccacgccaccuucacaaugagacuccugagccccguccgggugccuaacuauaauaugaucauuauggacgaggcucauuuuaccgaucccgccuccaucgcggcccgcggguacaucagcacaagagugggaaugggcgaagcugccgcuauuuucaugaccgccacgccuccggggucugucgaggccuuuccccaguccaacgcuguuauccaggacgaagagcgggauauuccugaacgcagcuggaauucuggauaugacuggaucacagauuuccccggcaaaaccgugugguucgugccuagcauuaaguccgggaacgacaucgcgaauugucugagaaaaaacggcaagcgggucauccagcucucuagaaagacauuugauaccgaguaccaaaaaacgaagaacaaugacugggacuaugugguuaccacagauauuagcgagaugggagccaacuuccgcgcugaccgggugaucgaucccagacgcugccuuaaaccggucauucugaaggacggcccugaacgggugauccuggccgggcccaugcccguuaccguggccuccgcugcccagagacgcggacggauuggcagaaaucagaacaaagagggggaucaguacgucuacaugggacaaccucucaauaacgacgaagaucacgcgcauuggacagaggcuaagaugcugcuugacaauaucaacacccccgagggcauuaucccugcccuguuugaaccggagcgcgaaaagucugccgcuaucgauggggaguauagacuccggggcgaagcccgcaaaacauucguggagcugaugagacggggagaccugcccgucuggcucagcuacaagguggcguccgagggcuuucaguauagcgaucgcagauggugcuucgacggggaacggaauaaccagguucuugaggaaaauauggauguggagauuuggaccaaagaaggagagagaaagaaacugcgcccucgguggcuggacgccagaacguacucugacccccucgcucugcgcgaguuuaaggaauucgccgcuggccggagauccgugagcggggaucuuauccuggagauuggaaaacucccucagcaccugacacugcgggcccaaaacgcucucgacaaucuugucaugcugcacaacuccgaacagggcggcaaggccuaucgccaugcgauggaggaacugcccgauaccaucgagacccucaugcugcuugcccugauugcuguucucacagggggagugacccuguuuuuccugucuggcaaggggcucggaaaaacaagcaucggccuucugugugugacggccuccucugcucugcucuggauggccagcgucgagccgcacuggaucgccgcuuccauuauccuggaauuuuuccuuauggugcugcucauuccugagcccgacagacagcggaccccucaggauaaucaacuggcguacguugugaucgggcugcucuuuaugauucuuacagucgccgcuaacgaaaugggacugcuggagaccacaaagaaagaccucggcaucggcuauguggccgccgagaaccaucagcacgcuaccaugcuggaugucgaccuucaccccgccagcgcguggacgcuguacgccguggcuaccacaguuaucaccccuaugaugcgccauacaauugaaaauaccacggccaacaucucucucacagcuauugccaaucaggcggccauccugauggggcuggauaagggauggcccauuuccaaaauggacaucggcgugccgcuccuugcucuggggugcuacagccaagucaacccucugacccucacagccgcugugcugaugcuuguugcccacuaugcuauuaucggacccggccugcaggccaaggcgaccagagaggcccagaagcggaccgcugccgggaucaugaaaaaucccacaguggauggaauugucgcuaucgaccucgauccugugguguacgacgccaaguucgaaaaacagcugggccaaauuaugcugcucauccuuuguacgucucagauucugcugaugcgcaccacaugggcccucugcgaguccaucacccuggcgacaggcccgcuuaccacgcugugggaagggagccccggaaaguucuggaacacaaccaucgcuguuucuauggccaauauuuuuagaggcagcuaucucgcuggggccggacuggccuucucccugaugaaaucucucggcgggggacggcgcggcaccggcgcucagggggagacacuuggagagaaguggaagagacagcugaaccaacugagcaaauccgaauuuaauaccuacaagcggagcggcaucauggaggucgacagauccgaagccaaagaggggcucaagcgcggagaaacaacgaaacaugcggugucucggggcaccgccaagcugagaugguucguggagcgcaaccuugucaagccugaggggaaaguuauugaucugggauguggccggggcggguggagcuauuacugcgcuggacucaagaaagugacagaagugaagggcuauaccaaagggggacccggccacgaggaaccuauccccauggccacauacggguggaaucuggucaagcugcauuccggaaaagacguguuuuucaugccuccggagaagugugauacccuccuuugcgacauuggcgaaucuagccccaacccuacgaucgaggagggcagaacccugcgcguucugaagaugguggaacccuggcuccgggggaaucaguuuuguaucaaaauucugaacccuuacaugcccuccgucguggagacacuugaacagaugcagagaaagcacggaggcaugcugguucgcaauccgcucucucggaacagcacccacgagauguauuggguguccugcgggacaggaaauaucgucagcgcugugaacaugaccucuagaaugcugcugaaccgcuucacaauggcccaucggaaaccuaccuacgagagagauguggaccucggcgcggggacgcgccacgucgccguugaacccgagguggcuaaucuggauauuaucggacaaagaauugaaaacaucaagaaugagcauaaauccacauggcacuaugacgaagauaaccccuacaagaccugggccuaucacggcagcuacgaggugaagccuucuggcuccgcuagcucuauggucaauggggugguucggcuucugaccaaacccugggacgugauuccuauggucacacagaucgccaugacggauaccacaccguuuggacagcaacgcguguucaaggagaaaguugacaccagaacaccccgggcuaagagaggcaccacacagaucauggaagugaccgccaaauggcucuggggguuucugucccggaacaagaagccucgcauuuguacgagagaggaauucacccggaaaguccgcagcaaugcggccaucggagcuguguuuguugacgagaaccaguggaauuccgccaaggaagcuguggaggaugagagauucugggaccuuguccaucgggaacgcgagcugcacaaacagggcaagugcgccacaugcguguauaacaugauggggaaaagagaaaagaagcucggcgaguucggaaaagccaagggcagccgggcgauuugguacauguggcugggggcucgcuuucuggaauucgaggcccucggauuuaugaaugaggaucauugguucucuagagaaaacagccuguccggcgucgagggggaaggacuucacaaacugggcuacauccuccgggacauuucuaagauccccgggggcaauauguaugccgaugacaccgcuggaugggauacacgcaucaccgaggacgaucugcaaaacgaggccaaaauuacggacaucauggaaccugagcaugcucuucuggccacaagcauuuuuaagcucaccuaccagaauaaagugguuagagugcagcggcccgcgaagaacggcacagucauggaugugaucucccgcagagaccagcgggggucuggacaagugggcaccuaugggcugaacacguucaccaauauggaaguucagcugauuagacagauggagagcgaaggaaucuuucucccguccgagcuggagacaccuaaccuugccgaacgcgcucuggauuggcucgagaagcacggcgccgaacggcugaaaagaauggcuaucucuggggacgacuguguggucaagcccauugaugaccgcuucgccaccgcgcuuacagcccugaaugauaugggcaaagugcggaaggacaucccucagugggagcccagcaaaggauggaacgauuggcaacagguuccuuuuugcucccaccauuuccaccagcucauuaugaaggacggcagagaaaucgugguccccugucgcaaucaggaugagcugguggggcgggcuagagucagccaaggagccggcuggucucugcgcgagaccgcuugccucgggaaguccuacgcccagauguggcagcugauguauuuucaucggagagaccuucgccuggcugccaacgcgauuuguagcgccgugccgguugauugggugccugcuucucggacaaccugguccauccacgcccaccaucaauggaugacgacagaagacaugcucagcgucuggaauagaguguggaucgaggaaaaccccuggauggaggauaaaacccacguuuccucuugggaagaggugcccuaccugggaaagcgggaggaccaguggugcggcagccuuauugggcugaccgccagagcuacaugggccaccaauauccaggucgcgauuaaccaggugcgccggcucaucggcaaugaaaacuaucuggacuacaugacauccaugaaaagauucaagaaugagagcgauccugaaggagcucugugguga

SEQ ID NO: 19400 - RNA, 9879 nt, Artificial Sequence
  derived and/or modified CDS sequence (opt5) from DENV-1__KC692501__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggauccuguguguguccaucaugauugaggagguuaugcggucuagauggagccgcaagaugcugaugaccggaacacucgcuguguuccugcuucugaucaugggccagcucaccuggaacgaccugauuagacugugcaucauggucggcgccaaugccuccgaccggauggggaugggaaccacauaccuugcucugauggccacguuuaagaugcgcccuauguucgcggugggccuccuguuuagacggcucaccucucgcgaagugcugcuucugacaauugggcucagccuggucgcuuccguugagcugcccaacucucuugaagagcugggagauggccucgccauggggaucaugaugcugaaacuccugaccgaauuccaaccccaccagcuuuggacaacccugcucagccugacguuugugaagacaacccugucccuugacuaugccuggaaaaccacagcuauggugcugagcauugucucucucuucccucugugucucuccaccacaagccagaagacgaccuggcugccggugcuucugggaucuuuuggcugcaaaccccugacaauguuccucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuacgucaucagcggcuccagcgccgaccugucucuggaaaaggcugccgaggugagcugggaacaggaggcugaacauuccggggccucucacaauauucucguugaggugcaagaugacggaacaaugaaaaucaaggaugaggaacgggacgauacccugacgauucuucugaaagccacccuccuggcugucagcggcguguaucccauguccaucccugcgacacucuucgucugguacuuuuggcagaagaaaaagcagcgcucuggcgugcugugggacacccccagcccgccugagguugaaagagccgugcuugaugacgggauuuaucggauccugcagcgcggacugcucggcagaucccaagucggggugggaguuuuccaggauggcguguuucauacaauguggcacgucacccggggggcugugcugauguaccagggaaagagacuugagcccucuugggccagcgugaaaaaggaccugaucuccuauggcggcggguggcgcuuccagggaagcuggaacacaggcgaggaaguucaagucauugccguggagccugggaaaaaucccaagaacgugcagacgaccccgggaacauuuaaaaccccugaaggcgaggucggggcuaucgcccucgacuucaagcccggaaccucuggcuccccuauugugaaucgggaagagaagaucguuggccuguacgggaacggaguggucacaacgagcggcaccuacgugucugcgauugcucaggccaaagccucccaagaggggccccuccccgaaaucgaggaugaaguuuuuaagaaaagaaaucugacaauuauggaccuucacccuggaagcggcaagacccgccgguaucugccggcuaucgugagagaggccaucaaacgcaagcugcggacacucauucuggcgcccaccagagucguggcuuccgaaauggccgaggcccuuaaggggaugccuauccgcuaccagacgacagcuguuaaaucugagcauaccggccgggaaauuguggaucugaugugccacgccaccuucacaaugagacuccugagccccguccgggugccuaacuauaauaugaucauuauggacgaggcucauuuuaccgaucccgccuccaucgcggcccgcggauacaucagcacaagagugggcaugggggaagcugccgcuauuuucaugaccgccacgccuccgggaucugucgaggccuuuccccaguccaacgcuguuauccaggacgaagagcgggauauuccugagcgcagcuggaauucuggcuaugacuggaucacagauuuccccgggaagaccgugugguucgugccuagcauuaaauccggaaacgacaucgcgaauugucugagaaagaacggcaaacgggucauccaacucucuagaaagacauuugauaccgaauaccagaagacgaaaaacaaugacugggacuaugugguuaccacagauauuagcgagaugggggccaacuuccgcgcugaccgggugaucgaucccagacgcugccuuaagccggucauucugaaagacggcccugaacgggugauccuggccggacccaugcccguuaccguggccuccgcugcccagagacgcggccggauugggagaaaucagaacaaggagggagaucaauacgucuacaugggccagccucucaauaacgacgaggaucacgcgcauuggacagaagcuaaaaugcugcuugacaauaucaacacccccgaggggauuaucccugcccuguuugaaccggagcgcgaaaagucugccgcuaucgauggagaguauagacuccggggcgaggcccgcaagacauucguggaacugaugagacggggggaccugcccgucuggcucagcuacaaaguggcguccgagggcuuucaguauagcgaucgcagauggugcuucgacggagaacggaauaaccagguucuugaggaaaauauggauguggagauuuggaccaaggagggcgaaagaaaaaagcugcgcccucgguggcuggacgccagaacguacucugacccccucgcucugcgcgaguuuaaagaauucgccgcugggcggagauccgugagcggagaucuuauccuggagauuggcaagcucccucaacaccugacacugcgggcccagaacgcucucgacaaucuugucaugcugcacaacuccgaacaggggggaaaagccuaucgccaugcgauggaggagcugcccgauaccaucgaaacccucaugcugcuugcccugauugcuguucucacaggcggcgugacccuguuuuuccugucugggaagggacucggcaagacaagcaucgggcuucugugugugacggccuccucugcucugcucuggauggccagcgucgagccgcacuggaucgccgcuuccauuauccuggaauuuuuccuuauggugcugcucauuccugagcccgacagacagcggaccccucaagauaaucagcuggcguacguugugaucggacugcucuuuaugauucuuacagucgccgcuaacgagaugggccugcuggaaaccacaaaaaaggaccucgggaucggauauguggccgccgagaaccaucagcacgcuaccaugcuggaugucgaccuucaccccgccagcgcguggacgcuguacgccguggcuaccacaguuaucaccccuaugaugcgccauacaauugaaaauaccacggccaacaucucucucacagcuauugccaaucaagcggccauccugaugggccuggauaaaggcuggcccauuuccaagauggacaucggggugccgcuccuugcucugggaugcuacagccaggucaacccucugacccucacagccgcugugcugaugcuuguugcccacuaugcuauuaucggccccgggcugcaggccaaagcgaccagagaggcccagaagcggaccgcugccggaaucaugaagaaucccacaguggauggcauugucgcuaucgaccucgauccugugguguacgacgccaaauucgaaaagcaacuggggcagauuaugcugcucauccuuuguacgucucagauucugcugaugcgcaccacaugggcccucugcgaguccaucacccuggcgacaggaccgcuuaccacgcugugggagggcagccccggcaaauucuggaacacaaccaucgcuguuucuauggccaauauuuuuagagggagcuaucucgcuggagccggccuggccuucucccugaugaagucucucgggggaggccggcgcgggaccggagcucagggcgaaacacuuggcgagaaauggaagagacaacugaaccagcugagcaaguccgaauuuaauaccuacaaacggagcgggaucauggaggucgacagauccgaagccaaggagggacucaaacgcggcgagacaacgaagcaugcggugucucgggggaccgccaaacugagaugguucguggaacgcaaccuugucaagccugagggaaagguuauugaucugggcugugggcggggaggcuggagcuauuacugcgcuggccucaaaaaggugacagaagugaaaggguauaccaagggaggccccgggcacgaggaaccuauccccauggccacauacggauggaaucuggucaaacugcauuccggcaaggacguguuuuucaugccuccggagaaaugugauacccuccuuugcgacauuggggagucuagccccaacccuacgaucgaagagggaagaacccugcgcguucugaagaugguggaacccuggcuccggggcaaucaguuuuguaucaagauucugaacccuuacaugcccuccgucguggagacacuugagcagaugcaaagaaaacacggcgggaugcugguucgcaauccgcucucucggaacagcacccacgaaauguauuggguguccugcggaacaggcaauaucgucagcgcugugaacaugaccucuagaaugcugcugaaccgcuucacaauggcccaucggaagccuaccuacgagagagauguggaccucggggcgggaacgcgccacgucgccguugaacccgagguggcuaaucuggauauuaucggccagagaauugaaaacaucaaaaaugagcauaaguccacauggcacuaugacgaggauaaccccuacaaaaccugggccuaucacgggagcuacgaagugaagccuucuggauccgcuagcucuauggucaauggcgugguucggcuucugaccaagcccugggacgugauuccuauggucacacagaucgccaugacggauaccacaccguuuggccaacagcgcguguucaaagagaagguugacaccagaacaccccgggcuaaaagagggaccacacagaucauggaagugaccgccaaguggcucuggggauuucugucccggaacaaaaagccucgcauuuguacgagagaggaauucacccggaagguccgcagcaaugcggccaucggcgcuguguuuguugacgagaaccaguggaauuccgccaaagaggcuguggaagaugagagauucugggaccuuguccaucgggaacgcgagcugcacaagcaagggaaaugcgccacaugcguguauaacaugaugggaaagagagaaaaaaagcucggcgaguucgggaaggccaaaggcagccgggcgauuugguacauguggcugggagcucgcuuucuggaguucgaagcccucggcuuuaugaaugaggaucauugguucucuagagaaaacagccuguccggggucgagggagagggccuucacaagcugggguacauccuccgggacauuucuaaaauccccggaggcaauauguaugccgaugacaccgcugggugggauacacgcaucaccgaagacgaucugcagaacgaggccaagauuacggacaucauggaaccugagcaugcucuucuggccacaagcauuuuuaaacucaccuaccagaauaaggugguuagagugcagcggcccgcgaaaaacggcacagucauggaugugaucucccgcagagaccaacggggaucuggccagguggggaccuauggacugaacacguucaccaauauggaaguucagcugauuagacagauggagagcgagggcaucuuucucccguccgaacuggagacaccuaaccuugccgaacgcgcucuggauuggcucgagaagcacggggccgaacggcugaagagaauggcuaucucuggagacgacuguguggucaaacccauugaugaccgcuucgccaccgcgcuuacagcccugaaugauaugggcaaggugcggaaagacaucccucaaugggagcccagcaagggguggaacgauuggcagcagguuccuuuuugcucccaccauuuccaccagcucauuaugaaagacggcagagagaucgugguccccugucgcaaucaagaugaacuggugggacgggcuagagucagccagggcgccggguggucucugcgcgagaccgcuugccucggaaaguccuacgcccagauguggcaacugauguauuuucaucggagagaccuucgccuggcugccaacgcgauuuguagcgccgugccgguugauugggugccugcuucucggacaaccugguccauccacgcccaccaucaguggaugacgacagaagacaugcucagcgucuggaauagaguguggaucgaggaaaaccccuggauggaggauaagacccacguuuccucuugggaggaagugcccuaccugggcaaacgggaggaccaguggugcgggagccuuauuggacugaccgccagagcuacaugggccaccaauauccaggucgcgauuaaccaagugcgccggcucaucggcaaugaaaacuaucuggacuacaugacauccaugaagagauucaaaaaugagagcgauccugagggggcucugugguga

SEQ ID NO: 19401 - RNA, 9879 nt, Artificial Sequence
  derived and/or modified CDS sequence (opt5) from DENV-1__KC692502__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggguguccuaugucauguguacgggcagcuucaaacuggaaaaggagguggccgagacacagcacggaaccguucuggugcaggucaaguacgaaggcaccgacgcgccgugcaaaauuccuuuuucuacacaagaugagaagggggugacccagaacggacggcuuaucacagcuaaucccaucgugacggacaaagaaaagccuguuaacauugagaccgagccccccuucggcgaauccuauaucgucgugggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugucggcaagcucgugcaucagguuuuugggaccgccuacggagugcuguucagcggcgucuccuggacgaugaaaaucgggaucggcauucuucugaccuggcucggacugaauagccgcucuacaucccugagcaugaccuguaucgcugugggcaugguuacacuuuaccucggggugaugguccaggccgauucuggaugcgugauuaacuggaagggccgggagcugaaauguggguccggaaucuuuguuaccaacgaagugcacacauggaccgagcaauauaaguuccaggcugacagcccuaagagacuguccgccgcgauuggcaaagccugggaggaaggggucugcggcauccgcucugcuacgcggcucgagaauauuauguggaagcagaucagcaacgaacugaaucauauccuucuggagaacgauaugaaauuuacagugguggucggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggagguugaagacuauggcuuuggcguguucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagucaagacauguaccuggcccaagagccacacacuguggucuaacggagugcuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacaguuguggucgaugaacacugcggcaacagaggccccucucuccggaccacaaccgugacggggaaaauuauccaugagugguguugccgcagcuguacacugccuccccugagauuccggggagaggacggcugcugguacgggauggaaauuagaccgguuaaggagaaagaagagaaucuugugcgcuccauggucagcgcgggaucuggcgaaguggauuccuuuagccucgggauccuguguguuuccaucaugauugaggaggugaugcggucuagauggagccgcaagaugcugaugaccggaacacucgcugucuuccugcuucugaucaugggccagcucaccuggaacgaccugauuagacugugcaucauggugggcgccaaugccuccgaccggauggggaugggaaccacauaccuugcucugauggccacguuuaagaugcgcccuauguucgcggugggccuccuguuuagacggcucaccucucgcgaaguccugcuucugacaauugggcucagccugguugcuuccguggagcugcccaacucucuugaagagcugggagauggccucgccauggggaucaugaugcugaaacuccugaccgaauuccaaccccaccagcuuuggacaacccugcucagccugacguuugugagaacaacccugucccuugacuaugccuggaagaccacagcuaugguccugagcauugugucucucuucccucugugucucuccaccacaagccagaaaacgaccuggcugccgguucuucugggaucuuuuggcugcaagccccugacaauguuccucaucaccgagaacaaaaucuggggccggaaguccuggccucugaaugaggggauuauggccaucggaauugugagcauccuucugucuucccuccugaagaacgaugucccccucgcuggcccucugauugccgggggaaugcuuaucgcguguuacgugaucagcggcuccagcgccgaccugucucuggaaaaagcugccgagguuagcugggaacaggaggcugaacauuccggggccucucacaauauucucguggagguccaagaugacggaacaaugaagaucaaagaugaggaacgcgacgauacccugacgauucuucugaaggccacccuccuggcugugagcggcgucuaucccauguccaucccugcgacacucuucgugugguacuuuuggcagaaaaagaaacagagaucuggcguucugugggacacccccagcccgccugagauggaacgggccgugcuugaugacgggauuuaucgcauccugcagagaggacugcucggccggucccaagucggggugggaguuuuccaggauggcguguuucauacaauguggcacgucaccagaggggcugugcugauguaccagggaaagcgccuugagcccucuugggccagcgugaagaaagaccugaucuccuauggcggcggguggcgguuccagggaagcuggaacacaggcgaggaaguucaagucauugccguggagccugggaagaaucccaaaaacgugcagacgaccccgggaacauuuaagaccccugaaggcgaggucggggcuaucgcccucgacuucaaacccggaaccucuggcuccccuauugugaauagagaaggcaagaucguugggcuguacggaaacggcguggucacaacgagcgggaccuacgugucugcgauugcucaggccaaggccucccaagagggaccccuccccgagaucgaagaugagguuuuuaaaaagcgcaaucugacaauuauggaccuucacccuggcagcgggaaaacccggagauaucugccggcuaucgugcgcgaagccaucaagcggaaacugagaacacucauucuggcgcccacccgcgucguggcuuccgagauggccgaagcccuuaagggcaugccuauccgguaccagacgacagcuguuaagucugagcauaccggaagagagauuguggaucugaugugccacgccaccuucacaaugcggcuccugagccccguccgcgugccuaacuauaauaugaucauuauggacgaagcucauuuuaccgaucccgccuccaucgcggccagaggcuacaucagcacacggguggggaugggagaggcugccgcuauuuucaugaccgccacgccuccgggcucugucgaagccuuuccccaguccaacgcuguuauccaggacgaggaacgcgauauuccugagagaagcuggaauucuggguaugacuggaucacagauuuccccggaaaaaccgugugguucgugccuagcauuaaguccggcaacgacaucgcgaauugucugcggaaaaacgggaagagagucauccaacucucucgcaaaacauuugauaccgaguaccagaagacgaagaacaaugacugggacuaugugguuaccacagauauuagcgaaaugggcgccaacuuccgggcugacagagugaucgauccccgccggugccuuaaaccggucauucugaaggacggaccugagagagugauccuggccggccccaugcccguuaccguggccuccgcugcccagcgccgggggagaauuggacgcaaucagaacaaagaaggcgaucaauacgucuacauggggcagccucucaauaacgacgaggaucacgcgcauuggacagaggcuaagaugcugcuugacaauaucaacacccccgaaggaauuaucccugcccuguuugagccggaaagagagaaaucugccgcuaucgauggcgaauaucggcuccgcggggaggccagaaagacauucguggagcugaugcggcgcggcgaccugcccgucuggcucagcuacaagguggcguccgaaggauuucaguauagcgauagacgguggugcuucgacggcgagagaaauaaccagguucuugaagagaauauggauguggaaauuuggaccaaagagggggagcgcaagaaacugcggccuagauggcuggacgcccgcacguacucugacccccucgcucugcgggaauuuaaggaguucgccgcuggaagacgguccgugagcggcgaucuuauccuggaaauugggaaacucccucaacaccugacacugcgcgcccagaacgcucucgacaaucuugucaugcugcacaacuccgagcagggaggcaaggccuauagacaugcgauggaagagcugcccgauaccaucgagacccucaugcugcuugcccugauugcuguucucacaggcggggugacccuguuuuuccugucuggaaaaggccucgggaagacaagcaucggacuucugugugugacggccuccucugcucugcucuggauggccagcgucgaaccgcacuggaucgccgcuuccauuauccuggaguuuuuccuuauggugcugcucauuccugaacccgaccggcagcgcaccccucaagauaaucagcuggcguacguugugaucggccugcucuuuaugauucuuacagucgccgcuaacgagauggggcugcuggagaccacaaagaaagaccucggaaucggcuauguggccgccgaaaaccaucagcacgcuaccaugcuggaugucgaccuucaccccgccagcgcguggacgcuguacgccguggcuaccacaguuaucaccccuaugaugagacauacaauugagaauaccacggccaacaucucucucacagcuauugccaaucaagcggccauccugaugggccuggauaagggguggcccauuuccaaaauggacaucggagugccgcuccuugcucugggcugcuacagccaggucaacccucugacccucacagccgcugugcugaugcuuguugcccacuaugcuauuaucgggcccggacugcaggccaaggcgacccgggaagcccagaaacgcaccgcugccggcaucaugaagaaucccacaguggaugggauugucgcuaucgaccucgauccugugguguacgacgccaaguucgagaaacaacugggacagauuaugcugcucauccuuuguacgucucagauucugcugaugagaaccacaugggcccucugcgaauccaucacccuggcgacaggcccgcuuaccacgcugugggagggcagccccgggaaguucuggaacacaaccaucgcuguuucuauggccaauauuuuucggggaagcuaucucgcuggcgccgggcuggccuucucccugaugaaaucucucggaggcgggcgcagaggaaccggcgcucagggcgagacacuuggggaaaaguggaaacggcaacugaaccagcugagcaaguccgaguuuaauaccuacaagagaagcggaaucauggaagucgaccgcuccgaggccaaagaaggccucaagcggggggagacaacgaaacaugcggugucuagaggaaccgccaagcugcgcugguucguggagcggaaccuugucaaaccugaaggcaagguuauugaucugggguguggaagaggcggcuggagcuauuacugcgcugggcucaagaaagugacagaggugaagggauauaccaaaggcgggcccggacacgaagagccuauccccauggccacauacggcuggaaucuggucaagcugcauuccgggaaagacguguuuuucaugccuccggaaaagugugauacccuccuuugcgacauuggagagucuagccccaacccuacgaucgaggaaggccgcacccugcggguucugaaaaugguggagcccuggcucagaggcaaucaguuuuguaucaagauucugaacccuuacaugcccuccgucguggaaacacuugagcagaugcaacgcaagcacgggggaaugcugguucggaauccgcucucuagaaacagcacccacgagauguauuggguguccugcggcacagggaauaucgucagcgcugugaacaugaccucucgcaugcugcugaaccgguucacaauggcccauagaaaaccuaccuacgaacgcgauguggaccucggagcgggcacgagacacgucgccguugagcccgaaguggcuaaucuggauauuaucgggcagcggauugagaacaucaagaaugaacauaaauccacauggcacuaugacgaggauaaccccuacaagaccugggccuaucacggaagcuacgaggugaaaccuucuggcuccgcuagcucuauggucaauggcgugguucgccuucugaccaagcccugggacgugauuccuauggucacacagaucgccaugacggauaccacaccguuugggcaacagagaguguucaaggaaaaaguugacacccggacacccagagcuaagcggggaaccacacagaucauggaggugaccgccaaauggcucuggggcuuucugucccgcaacaagaaaccuagaauuuguacgcgggaagaguucacccgcaaggucagaagcaaugcggccaucggggcuguguuuguugacgaaaaccaguggaauuccgccaaggaggcuguggaggaugaacgguucugggaccuuguccaucgcgagagagaacugcacaaacaaggaaagugcgccacaugcguguauaacaugaugggcaaacgggagaagaaacucggggaauucggcaaggccaagggaagccgcgcgauuugguacauguggcugggcgcuagauuucuggaguucgaggcccucggguuuaugaaugaagaucauugguucucucgggagaacagccuguccggagucgaaggcgaggggcuucacaaacugggauacauccuccgcgacauuucuaagauccccggcgggaauauguaugccgaugacaccgcuggcugggauacaagaaucaccgaggacgaucugcagaacgaagccaaaauuacggacaucauggagccugaacaugcucuucuggccaugagcauuuuuaagcucacauaccagaauaaagugguucgggugcagcgccccgcgaagaacggaaccgucauggaugugaucuccagacgggaccaaagaggcucugggcaggugggaacauauggccugaacaccuucacgaauauggagguucagcugauucgccagauggaaagcgaggggaucuuucucccguccgagcuggaaaccccuaaccuugccgagcgggcucuggauuggcucgaaaaacacggagccgagagacugaagcgcauggcuaucucuggcgacgacuguguggucaagcccauugaugaccgguucgccacagcgcuuaccgcccugaaugauauggggaaagugagaaaggacaucccucaaugggaacccagcaaaggcuggaacgauuggcagcagguuccuuuuugcucccaccauuuccaccagcucauuaugaaggacggacgcgagaucgugguccccugucggaaucaagaugagcuggugggcagagcucgcgucagccagggggccggauggucucugcgggaaacagcuugccucggcaaauccuacgcccagauguggcaacugauguauuuucauagacgcgaccuucggcuggcugccaacgcgauuuguagcgccgugccgguugauugggugccugcuucuagaaccacaugguccauccacgcccaccaucaguggaugaccacggaggacaugcucagcgucuggaaucggguguggaucgaagagaaccccuggauggaagauaagacacacguuuccucuugggaggaggugcccuaccuggggaagagagaagaccaguggugcggaagccuuauuggccugaccgcccgcgcuaccugggccacaaauauccaggucgcgauuucccaagugcggagacucaucgggaacgagaauuaucuggacuacaugaccagcaugaaacgcuucaagaacgaaucugauccugagggcgcucugugguga

SEQ ID NO: 19402 - RNA, 9879 nt, Artificial Sequence
  derived and/or modified CDS sequence (opt5) from DENV-1__KC692503__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggaucggcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagauuugcgaccaccgccuuauguccgcggccaucaaagauagcaaggcugugcaugccgacaugggguauuggauugagucugaaaaaaaugagaccuggaagcucgcccgggcuuccuucaucgaagugaaaacauguaccuggcccaagagccacacacuguggucuaacggaguccuggaguccgagaugaucauuccgaagaucuuuggcgggccuauuagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagaucauucaugagugguguugcagaagcuguacacugccuccccugcgguucagaggagaggacggcugcugguacgggauggaaauccgcccggugaaagagaaggaagagaaucuuguucgguccauggugagcgcgggaucuggcgaagucgauuccuuuagccucgggauccuguguguguccauuaugaucgaggagguuaugagaucucgcuggagcagaaaaaugcugaugauuggaacccucgcuguguuccugcuucugaucaugggccagcucacauggaacgaccugauucggcugugcaucauggucggcgccaaugccuccgaccgcauggggaugggaaccaccuaccuugcucugauggccacauuuaagaugagaccuauguucgcggugggccuccuguuucggcgccucacgucuagagaagugcugcuucugaccauugggcucagccuggucgcuuccguugagcugcccaacucucuugaagagcugggagauggccucgccauggggaucaugaugcugaagcuccugacagaauuccaaccccaccagcuuuggaccacacugcucagccugaccuuugugaaaacgacacugucccuugacuaugccuggaagaccaccgcuauggugcugagcaucgucucucucuucccucugugucucuccacaaccagccagaaaacaacguggcugccggugcuucugggaucuuuuggcugcaagccccugaccauguuccucauuacagagaacaaaaucuggggccggaaguccuggccucugaaugaggggauuauggccaucggaauuguuagcauccuucugucuucccuccugaagaacgaugugccccucgcuggcccucugaucgccgggggaaugcuuauugcguguuacgucaucagcggcuccagcgccgaccugucucuggaaaaagcugccgaggugagcugggaacaggaggcugaacauuccggggccucucacaauauucucguugaggugcaagaugacggaaccaugaagaucaaagaugaggaacgcgacgauacacugaccauucuucugaaggccacgcuccuggcugucagcggcguguaucccauguccaucccugcgacccucuucgucugguacuuuuggcagaaaaagaaacagagaucuggcgugcugugggacacacccagcccgccugagguugaacgggccgugcuugaugacgggaucuaucgcauucugcagagaggacugcucggccggucccaagucggggugggaguuuuccaggauggcguguuucauaccauguggcacgucacaagaggggcugugcugauguaccagggaaagcgccuugagcccucuugggccagcgugaagaaagaccugaucuccuauggcggcggguggcgguuccagggaagcuggaacaccggcgaggaaguucaagucauugccguggagccugggaagaaucccaaaaacgugcagacaacgccgggaaccuuuaagacaccugaaggcgaggucggggcuaucgcccucgacuucaaacccggaaccucuggcuccccuauugugaauagagaagagaagaucguuggccuguacgggaacggaguggucaccacaagcggcacguacgugucugcgauugcucaggccaaggccucccaagaggggccccuccccgaaaucgaggaugaaguuuuuaaaaagcgcaaucugaccaucauggaccuucacccuggaagcggcaaaacacggagauaucugccggcuauugugcgcgaggccaucaagcggaaacugagaacccucauucuggcgcccacacgcgucguggcuuccgaaauggccgaggcccuuaaggggaugccuauccgguaccagaccacggcuguuaagucugagcauacaggcagagaaauuguggaucugaugugccacgccaccuucaccaugcggcuccugagccccguccgcgugccuaacuauaauaugaucaucauggacgaggcucauuuuacagaucccgccuccauugcggccagaggauacaucagcacccgggugggcaugggggaagcugccgcuauuuucaugacagccaccccuccgggaucugucgaggccuuuccccaguccaacgcuguuauccaggacgaagagcgcgauauuccugagagaagcuggaauucuggcuaugacuggaucacggauuuccccgggaaaacagugugguucgugccuagcaucaaguccggaaacgacauugcgaauugucugcggaaaaacggcaagagagucauccaacucucucgcaaaaccuuugauacagaauaccagaagaccaagaacaaugacugggacuaugugguuacgaccgauauuagcgagaugggggccaacuuccgggcugacagagugaucgauccccgccggugccuuaaaccggucauucugaaggacggcccugaaagagugauccuggccggacccaugcccguuacaguggccuccgcugcccagcgccggggcagaauugggcgcaaucagaacaaagagggagaucaauacgucuacaugggccagccucucaauaacgacgaggaucacgcgcauuggaccgaagcuaagaugcugcuugacaauaucaacacacccgaggggaucauuccugcccuguuugaaccggagagagaaaaaucugccgcuaucgauggagaguaucggcuccgcggcgaggccagaaagaccuucguggaacugaugcggcgcggggaccugcccgucuggcucagcuacaagguggcguccgagggcuuucaguauagcgauagacgguggugcuucgacggagaaagaaauaaccagguucuugaggaaaauauggauguggagauuuggacaaaagagggcgaacgcaagaaacugcggccuagauggcuggacgcccgcaccuacucugacccccucgcucugcgggaguuuaaggaauucgccgcugggagacgguccgugagcggagaucuuauccuggagauuggcaaacucccucaacaccugacgcugcgcgcccagaacgcucucgacaaucuugucaugcugcacaacuccgaacaggggggaaaggccuauagacaugcgauggaggagcugcccgauacaaucgaaacccucaugcugcuugcccugaucgcuguucucaccggcggcgugacacuguuuuuccugucugggaaaggacucggcaagaccagcauugggcuucugugugugacagccuccucugcucugcucuggauggccagcgucgagccgcacuggaucgccgcuuccauuauccuggaauuuuuccuuauggugcugcucauuccugagcccgaccggcagcgcacgccucaagauaaucagcuggcguacguugugaucggacugcucuuuaugauccuuaccgucgccgcuaacgagaugggccugcuggaaacaaccaagaaagaccucgggauuggauauguggccgccgagaaccaucagcacgcuacaaugcuggaugucgaccuucaccccgccagcgcguggacccuguacgccguggcuacgaccguuaucacaccuaugaugagacauaccauugaaaauacaaccgccaacaucucucucacggcuauugccaaucaagcggccauccugaugggccuggauaagggcuggcccauuuccaaaauggacaucggggugccgcuccuugcucugggaugcuacagccaggucaacccucugacacucaccgccgcugugcugaugcuuguugcccacuaugcuaucauuggccccgggcugcaggccaaggcgacacgggaggcccagaaacgcaccgcugccggaaucaugaagaaucccaccguggauggcauugucgcuaucgaccucgauccugugguguacgacgccaaguucgaaaaacaacuggggcagauuaugcugcucauccuuuguacaucucagauccugcugaugagaacgaccugggcccucugcgaguccauuacacuggcgaccggaccgcuuacaacccugugggagggcagccccggcaaguucuggaacacgacaaucgcuguuucuauggccaauauuuuucgggggagcuaucucgcuggagccggccuggccuucucccugaugaaaucucucgggggaggccgcagagggaccggagcucagggcgaaacccuuggcgagaaguggaaacggcaacugaaccagcugagcaaguccgaauuuaauacauacaagagaagcgggaucauggaggucgaccgcuccgaagccaaagagggacucaagcggggcgagaccacaaaacaugcggugucuagagggacggccaagcugcgcugguucguggaacggaaccuugucaaaccugagggaaagguuauugaucugggcugugggagaggaggcuggagcuauuacugcgcuggccucaagaaagugaccgaagugaagggguauacaaaaggaggccccgggcacgaggaaccuauccccauggccaccuacggauggaaucuggucaagcugcauuccggcaaagacguguuuuucaugccuccggagaagugugauacacuccuuugcgacaucggggagucuagccccaacccuaccauugaagagggacgcacgcugcggguucugaaaaugguggaacccuggcucagaggcaaucaguuuuguaucaagauucugaacccuuacaugcccuccgucguggagacccuugagcagaugcaacgcaagcacggcgggaugcugguucggaauccgcucucuagaaacagcacacacgaaauguauuggguguccugcggaaccggcaauaucgucagcgcugugaacaugacaucucgcaugcugcugaaccgguucaccauggcccauagaaaaccuacauacgagcgcgauguggaccucggggcgggaaccagacacgucgccguugaacccgagguggcuaaucuggauauuaucggccagcggauugaaaacaucaagaaugagcauaaauccacguggcacuaugacgaggauaaccccuacaagacaugggccuaucacgggagcuacgaagugaaaccuucuggauccgcuagcucuauggucaauggcgugguucgccuucugaccaagcccugggacgugaucccuauggucacccagauugccaugacagauacgaccccguuuggccaacagagaguguucaaggagaaaguugacacacggacccccagagcuaagcgggggacaacccagaucauggaagugacagccaaauggcucuggggauuucugucccgcaacaagaaaccuagaauuuguacccgggaggaauucacgcgcaaggucagaagcaaugcggccaucggcgcuguguuuguugacgagaaccaguggaauuccgccaaggaggcuguggaagaugagcgguucugggaccuuguccaucgcgaaagagagcugcacaaacaagggaagugcgccaccugcguguauaacaugaugggaaaacgggaaaagaaacucggcgaguucgggaaggccaagggcagccgcgcgauuugguacauguggcugggagcuagauuucuggaguucgaagcccucggcuuuaugaaugaggaucauugguucucucgggaaaacagccuguccggggucgagggagagggccuucacaaacugggguacauccuccgcgacaucucuaagauucccggaggcaauauguaugccgaugacacagcugggugggauaccagaaucacagaagacgaucugcagaacgaggccaaaauuaccgacaucauggaaccugagcaugcucuucuggccacgagcauuuuuaagcucacauaccagaauaaagugguucgggugcagcgccccgcgaagaacggcaccgucauggaugugaucuccagacgggaccaaagaggaucuggccagguggggacauauggacugaacaccuucacgaauauggaaguucagcugauccgccagauggagagcgagggcauuuuucucccguccgaacuggagaccccuaaccuugccgaacgggcucuggauuggcucgagaaacacggggccgaaagacugaagcgcauggcuaucucuggagacgacuguguggucaagcccauugaugaccgguucgccacagcgcuuaccgcccugaaugauaugggcaaagugagaaaggacaucccucaaugggagcccagcaaaggguggaacgauuggcagcagguuccuuuuugcucccaccauuuccaccagcucauuaugaaggacggccgcgagaucgugguccccugucggaaucaagaugaacuggugggaagagcucgcgucagccagggcgccggguggucucugcgggagacagcuugccucggaaaauccuacgcccagauguggcaacugauguauuuucauagacgcgaccuucggcuggcugccaacgcgaucuguagcgccgugccgguugauugggugccugcuucuagaaccacaugguccauucacgcccaccaucaguggaugaccacggaagacaugcucagcgucuggaaucggguguggaucgaggaaaaccccuggauggaggauaagacacacguuuccucuugggaggaagugcccuaccugggcaagagagaggaccaguggugcgggagccuuauuggacugaccgcccgcgcuaccugggccacaaauauccaggucgcgauuaaccaagugcggagacucaucggcaaugaaaacuaucuggacuacaugaccuccaugaaacgcuucaagaaugagagcgauccugagggggcucugugguga

SEQ ID NO: 19403 - RNA, 9879 nt, Artificial Sequence
  derived and/or modified CDS sequence (opt5) from DENV-1__KC692504__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucaugaacccugccguucugagaaagcuuugcauugaggcgaaaaucucuaauacaaccacggauucccgguguccgacacaaggagaagccacccugguggaggagcaggacgcuaacuuugugugccgcagaaccuucgucgaucggggcuggggcaauggguguggacucuuuggcaaggggagccugcuuacaugcgccaaauucaagugcgugaccaagcuggaaggaaaaauuguucaguacgagaaccucaaguauucugugaucgucacagugcacacgggcgaccagcaucaaguugggaaugaaaccacagagcacggaaccaucgcuacaauuaccccccaggccccuacguccgaaauccagcugaccgauuacggcgcccugacacucgacuguagcccccgcaccggccuggacuuuaacgagauggugcuucugacaaugaaagagaagucuuggcucguccauaaacagugguuccuggaucuuccucugcccuggaccuccggggcuagcacgucccaagaaacauggaauagacaggaccuccuggugaccuuuaagacagcgcacgccaaaaagcaggaggucgugguucugggaucucaagaaggcgcuaugcacaccgcccucaccggggccacagagauucagacgagcggaaccacaaccaucuucgcuggccaucugaagugccggcuuaaaauggauaagcugacacucaaagggauguccuaugugauguguaccggcagcuucaagcuggaaaaagaggucgccgagacgcagcacggaacagugcugguucaggugaaguacgaaggcaccgacgcgccgugcaagauuccuuuuucuacccaagaugagaaaggggucacacagaacggaagacuuaucaccgcuaaucccaucgugacagacaaggaaaaaccugugaacauugagacggagccccccuucggcgaauccuauaucguugucggggccggagagaaggcccucaaacugagcugguuuaagcgcggcucuagcauugggaagauguucgaagcuaccgcccggggcgcuagacgcauggccauccugggagauacagcgugggacuuuggcuccauugggggaguguucaccucugugggcaaacucguccaucagguguuugggacagccuacggaguucuguucagcggcguguccuggaccaugaagaucgggaucggcauucuucugacguggcucggacugaauagccggucuaccucccugagcaugacauguaucgcugucggcauggugacccuuuaccucgggguuauggugcaggccgauucuggaugcgucauuaacuggaaaggcagagagcugaaguguggguccggaaucuuugugacaaacgaaguucacaccuggacagagcaauauaaauuccaggcugacagcccuaagcgccuguccgccgcgauuggcaaggccugggaggaaggggugugcggcauccggucugcuaccagacucgagaauauuauguggaaacagaucagcaacgaacugaaucauauccuucuggagaacgauaugaaguuuacggucguggugggagacgccaauggcauucucgcucaggggaaaaagaugauccgcccgcaacccauggaacacaaauacuccuggaagucuuggggaaaagccaagauuaucggcgccgacauucagaacacaaccuucaucaucgaugggccugacacccccgaguguccugauggacagcgggcuuggaauauuugggaggucgaagacuauggcuuuggcguuuucacaaccaacaucuggcugaagcugagagauagcuacacgcagaugugcgaccaccgccuuauguccgcggccauuaaagauagcaaggcugugcaugccgacaugggguauuggaucgagucugaaaaaaaugagacauggaagcucgcccgggcuuccuucauugaagugaaaaccuguacauggcccaagagccacacccuguggucuaacggaguccuggaguccgagaugaucaucccgaagauuuuuggcgggccuaucagccaacauaauuacagacccggauauuucacacagaccgccggcccuuggcaccucgggaaacuggaacuugauuuugaccugugcgagggaacgaccgugguuguggaugaacacugcggcaaccggggccccucucuccgcacaaccacagucaccgggaagauuauccaugagugguguugcagaagcuguacgcugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugacaggaacccucgcuguguuccugcuucugaucaugggccagcucacauggaacgaccugauucggcugugcaucauggucggcgccaaugccuccgaccgcauggggaugggaaccaccuaccuugcucugauggccacauuuaagaugagaccuauguucgcggugggccuccuguuucggcgccucacgucuagagaagugcugcuucugaccauugggcucagccuggucgcuuccguugagcugcccaacucucuugaagagcugggagauggccucgccauggggaucaugaugcugaagcuccugacagaauuccaaccccaccagcuuuggaccacacugcucagccugaccuuugugaaaacgacacugucccuugacuaugccuggaagaccaccgcuauggugcugagcauugucucucucuucccucugugucucuccacaaccagccagaaaacaacguggcugccggugcuucugggaucuuuuggcugcaagccccugaccauguuccucaucacagagaacaaaaucuggggccggaaguccuggccucugaaugaggggauuauggccaucggaauuguuagcauccuucugucuucccuccugaagaacgaugugccccucgcuggcccucugauugccgggggaaugcuuaucgcguguuacgucaucagcggcuccagcgccgaccugucucuggaaaaagcugccgaggugagcugggaacaggaggcugaacauuccggggccucucacaauauucucguugaggugcaagaugacggaaccaugaagaucaaagaugaggaacgcgacgauacacugaccauucuucugaaggccacgcuccuggcugucagcggcguguaucccauguccaucccugcgacccucuucgucugguacuuuuggcagaaaaagaaacagagaucuggcgugcugugggacacacccagcccgccugagguugaacgggccgugcuugaugacgggauuuaucgcauccugcagagaggacugcucggccggucccaagucggggugggaguuuuccaggauggcguguuucauaccauguggcacgucacaagaggggcugugcugauguaccagggaaagcgccuugagcccucuugggccagcgugaagaaagaccugaucuccuauggcggcggguggcgguuccagggaagcuggaacaccggcgaggaaguucaagucauugccguggagccugggaagaaucccaaaaacgugcagacaacgccgggaaccuuuaagacaccugaaggcgaggucggggcuaucgcccucgacuucaaacccggaaccucuggcuccccuauugugaauagagaaggcaagaucguugggcuguacggaaacggcguggucaccacaagcgggacguacgugucugcgauugcucaggccaaggccucccaagagggaccccuccccgagaucgaagaugagguuuuuaaaaagcgcaaucugaccauuauggaccuucacccuggcagcgggaaaacacggagauaucugccggcuaucgugcgcgaagccaucaagcggaaacugagaacccucauucuggcgcccacacgcgucguggcuuccgagauggccgaagcccuuaagggcaugccuauccgguaccagaccacggcuguuaagucugagcauacaggaagagagauuguggaucugaugugccacgccaccuucaccaugcggcuccugagccccguccgcgugccuaacuauaauaugaucauuauggacgaagcucauuuuacagaucccgccuccaucgcggccagaggcuacaucagcacccggguggggaugggagaggcugccgcuauuuucaugacagccaccccuccgggcucugucgaagccuuuccccaguccaacgcuguuauccaggacgaggaacgcgauauuccugagagaagcuggaauucuggguaugacuggaucacggauuuccccggaaaaacagugugguucgugccuagcauuaaguccggcaacgacaucgcgaauugucugcggaaaaacgggaagagagucauccaacucucucgcaaaaccuuugauacagaguaccagaagaccaagaacaaugacugggacuaugugguuacgaccgauauuagcgaaaugggcgccaacuuccgggcugacagagugaucgauccccgccggugccuuaaaccggucauucugaaggacggaccugagagagugauccuggccggccccaugcccguuacaguggccuccgcugcccagcgccgggggagaauuggacgcaaucagaacaaagaaggcgaucaauacgucuacauggggcagccucucaauaacgacgaggaucacgcgcauuggaccgaggcuaagaugcugcuugacaauaucaacacacccgaaggaauuaucccugcccuguuugagccggaaagagagaaaucugccgcuaucgauggcgaauaucggcuccgcggggaggccagaaagaccuucguggagcugaugcggcgcggcgaccugcccgucuggcucagcuacaagguggcguccgaaggauuucaguauagcgauagacgguggugcuucgacggcgagagaaauaaccagguucuugaagagaauauggauguggaaauuuggacaaaagagggggagcgcaagaaacugcggccuagauggcuggacgcccgcaccuacucugacccccucgcucugcgggaauuuaaggaguucgccgcuggaagacgguccgugagcggcgaucuuauccuggaaauugggaaacucccucaacaccugacgcugcgcgcccagaacgcucucgacaaucuugucaugcugcacaacuccgagcagggaggcaaggccuauagacaugcgauggaagagcugcccgauacaaucgagacccucaugcugcuugcccugauugcuguucucaccggcggggugacacuguuuuuccugucuggaaaaggccucgggaagaccagcaucggacuucugugugugacagccuccucugcucugcucuggauggccagcgucgaaccgcacuggaucgccgcuuccauuauccuggaguuuuuccuuauggugcugcucauuccugaacccgaccggcagcgcacgccucaagauaaucagcuggcguacguugugaucggccugcucuuuaugauucuuaccgucgccgcuaacgagauggggcugcuggagacaaccaagaaagaccucggaaucggcuauguggccgccgaaaaccaucagcacgcuacaaugcuggaugucgaccuucaccccgccagcgcguggacccuguacgccguggcuacgaccguuaucacaccuaugaugagacauaccauugagaauacaaccgccaacaucucucucacggcuauugccaaucaagcggccauccugaugggccuggauaagggguggcccauuuccaaaauggacaucggagugccgcuccuugcucugggcugcuacagccaggucaacccucugacacucaccgccgcugugcugaugcuuguugcccacuaugcuauuaucgggcccggacugcaggccaaggcgacacgggaagcccagaaacgcaccgcugccggcaucaugaagaaucccaccguggaugggauugucgcuaucgaccucgauccugugguguacgacgccaaguucgagaaacaacugggacagauuaugcugcucauccuuuguacaucucagauucugcugaugagaacgaccugggcccucugcgaauccaucacacuggcgaccggcccgcuuacaacccugugggagggcagccccgggaaguucuggaacacgacaaucgcuguuucuauggccaaugucuuucggggaagcuaucucgcuggcgccgggcuggccuucucccugaugaaaucucucggaggcgggcgcagaggaaccggcgcucagggcgagacccuuggggaaaaguggaaacggcaacugaaccagcugagcaaguccgaguuuaauacauacaagagaagcggaauuauggaaguggaccgcuccgaggccaaagaaggccucaagcggggggagaccacaaaacaugcggugucuagaggaacggccaagcugcgcugguucgucgagcggaaccuuguuaaaccugaaggcaaggugaucgaucugggguguggaagaggcggcuggagcuauuacugcgcugggcucaagaaagugaccgaggucaagggauauacaaaaggcgggcccggacacgaagagccuauucccauggccaccuacggcuggaaucuggugaagcugcauuccgggaaagacguuuuuuucaugccuccggaaaagugugauacacuccuuugcgacaucggagagucuagccccaacccuaccauugaggaaggccgcacgcugcgggugcugaaaauggucgagcccuggcucagaggcaaucaguuuuguaucaagauccugaacccuuacaugcccuccgugguugaaacccuugagcagaugcaacgcaagcacgggggaaugcuggugcggaauccgcucucuagaaacagcacacacgagauguauugggucuccugcggcaccgggaauauugugagcgcugugaacaugacaucucgcaugcugcugaaccgguucaccauggcccauagaaaaccuacauacgaacgcgaugucgaccucggagcgggcaccagacacguugccguggagcccgaaguggcuaaucuggauaucauugggcagcggaucgagaacauuaagaaugaacauaaauccacguggcacuaugacgaggauaaccccuacaagacaugggccuaucacggaagcuacgaggucaaaccuucuggcuccgcuagcucuauggugaauggcguugugcgccuucugaccaagcccugggacgucaucccuauggugacccagauugccaugacagauacgaccccguuugggcaacagagaguuuucaaggaaaaaguggacacacggacccccagagcuaagcggggaacaacccagaucauggaggucacagccaaauggcucuggggcuuucugucccgcaacaagaaaccuagaaucuguacccgggaagaguucacgcgcaaggugagaagcaaugcggccauuggggcuguuuuuguggacgaaaaccaguggaauuccgccaaggaggcugucgaggaugaacgguucugggaccuugugcaucgcgagagagaacugcacaaacaaggaaagugcgccaccugcgucuauaacaugaugggcaaacgggagaagaaacucggggaauucggcaaggccaagggaagccgcgcgaucugguacauguggcugggcgcuagauuucuggaguucgaggcccucggguuuaugaaugaagaucauugguucucucgggagaacagccuguccggaguggaaggcgaggggcuucacaaacugggauacauucuccgcgacaucucuaagauucccggcgggaauauguaugccgaugacacagcuggcugggauaccagaaucacagaggacgaucugcagaacgaagccaaaaucaccgacauuauggagccugaacaugcucuucuggccacgagcaucuuuaagcucacauaccagaauaaaguugugcggguccagcgccccgcgaagaacggaaccgugauggaugugauuuccagacgggaccaaagaggcucugggcagguuggaacauauggccugaacaccuucacgaauauggaggugcagcugauccgccagauggaaagcgaggggauuuuucucccguccgagcuggaaaccccuaaccuugccgagcgggcucuggauuggcucgaaaaacacggagccgagagacugaagcgcauggcuaucucuggcgacgacugugucgugaagcccaucgaugaccgguucgccacagcgcuuaccgcccugaaugauauggggaaaguuagaaaggacauuccucaaugggaacccagcaaaggcuggaacgauuggcagcaggugccuuuuugcucccaccauuuccaccagcucaucaugaaggacggacgcgagauugucgugcccugucggaaucaagaugagcuggucggcagagcucgcgugagccagggggccggauggucucugcgggaaacagcuugccucggcaaauccuacgcccagauguggcaacugauguauuuucauagacgcgaccuucggcuggcugccaacgcgaucuguagcgccguuccgguggauugggucccugcuucuagaaccacaugguccauucacgcccaccaucaguggaugaccacggaggacaugcucagcguguggaaucggguuuggaucgaagagaaccccuggauggaagauaagacacacguguccucuugggaggagguccccuaccuggggaagagagaagaccaguggugcggaagccuuaucggccugaccgcccgcgcuaccugggccacaaauauucagguggcgaucaaccaagugcggagacucauugggaaugagaacuaucuggacuacaugaccuccaugaaacgcuucaagaaugaaagcgauccugagggcgcucugugguga

SEQ ID NO: 19404 - RNA, 9879 nt, Artificial Sequence
  derived and/or modified CDS sequence (opt5) from DENV-1__KC692508__SS-prME
agcgugacaaugcugcucaugcugcuucccacagcucuggcuuuccaccucacgacccggggcggggaaccucauaugaucgucuccaagcaggaacggggaaaaucucugcuuuuuaagacaagcgccggcguuaauaugugcacccugauugcgauggaccucggggaacugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggauccuguguguguccaucaugauugaggagguuaugcggucuagauggagccgcaagaugcugaugaccggaacacucgcuguguuccugcuucugaucaugggccagcucaccuggaacgaccugauuagacugugcaucauggucggcgccaaugccuccgaccggauggggaugggaaccacauaccuugcucugauggccacguuuaagaugcgcccuauguucgcggugggccuccuguuuagacggcucaccucucgcgaagugcugcuucugacaauugggcucagccuggucgcuuccguugagcugcccaacucucuugaagaacugggagauggccucgccauggggaucaugaugcugaaacuccugaccgaguuccaaccccaccagcuuuggacaacccugcucagccugacguuugugaagacaacccugucccuugacuaugccuggaaaaccacagcuauggugcugagcauugucucucucuucccucugugucucuccaccacaagccagaagacgaccuggcugccggugcuucugggaucuuuuggcugcaaaccccugacaauguuccucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuacgucaucagcggcuccagcgccgaccugucucuggaaaaggcugccgaggugagcugggaacaggaggcugaacauuccggggccucucacaauauucucguugaggugcaagaugacggaacaaugaaaaucaaggaugaggaacgggacgauacccugacgauucuucugaaagccacccuccuggcugucagcggcguguaucccauguccaucccugcgacacucuucgucugguacuuuuggcagaagaaaaagcagcgcucuggcgugcugugggacacccccagcccgccugagguugaaagagccgugcuugaugacgggauuuaucggauccugcagcgcggacugcucggcagaucccaagucggggugggaguuuuccaggauggcguguuucauacaauguggcacgucaccagaggggcugugcugauguaccagggaaagagacuugagcccucuugggccagcgugaaaaaggaccugaucuccuauggcggcggguggcgcuuccagggaagcuggaacacaggcgaggaaguucaagucauugccguggagccugggaaaaaucccaagaacgugcagacgaccccgggaacauuuaaaaccccugaaggcgaggucggggcuaucgcccucgacuucaagcccggaaccucuggcuccccuauugugaaucgggaaggcaagaucguugggcuguacggaaacggcguggucacaacgagcgggaccuacgugucugcgauugcucaggccaaagccucccaagagggaccccuccccgagaucgaagaugagguuuuuaagaaaagaaaucugacaauuauggaccuucacccuggcagcgggaagacccgccgguaucugccggcuaucgugagagaagccaucaaacgcaagcugcggacacucauucuggcgcccaccagagucguggcuuccgagauggccgaagcccuuaagggcaugccuauccgcuaccagacgacagcuguuaaaucugagcauaccggacgggagauuguggaucugaugugccacgccaccuucacaaugagacuccugagccccguccgggugccuaacuauaauaugaucauuauggacgaagcucauuuuaccgaucccgccuccaucgcggcccgcggcuacaucagcacaagaguggggaugggagaggcugccgcuauuuucaugaccgccacgccuccgggcucugucgaagccuuuccccaguccaacgcuguuauccaggacgaggaacgggauauuccugagcgcagcuggaacucuggguaugacuggaucacagauuuccccggaaagaccgugugguucgugccuagcauuaaauccggcaacgacaucgcgaauugucugagaaagaacgggaaacgggucauccaacucucuagaaagacauuugauaccgaguaccagaagacgaaaaacaaugacugggacuaugugguuaccacagauauuagcgaaaugggcgccaacuuccgcgcugaccgggugaucgaucccagacgcugccuuaagccggucauucugaaagacggaccugagcgggugauccuggccggccccaugcccguuaccguggccuccgcugcccagagacgcgggcggauuggaagaaaucagaacaaggaaggcgaucaauacgucuacauggggcagccucucaauaacgacgaggagcacgcgcauuggacagaagcuaaaaugcugcuugauaauaucaacacccccgagggaauuaucccugcccuguuugaaccggagcgcgaaaagucugccgcuaucgacggcgaguauagacuccgcggggaagcccggaagacauucguggaacugaugagacggggcgaucugcccgucuggcucagcuacaaaguggcguccgagggauuucaguauagcgaccgcagauggugcuucgauggcgaacggaauaaccagguucuugaggaaaauauggacguggagauuuggaccaaggagggggaacgcaaaaagcugcgcccucgguggcuggaugccagaacguacucugacccccucgcucugcgcgaguuuaaagaguucgccgcuggacggagauccgugagcggcgaccuuauccuggagauugggaagcucccucaacaccugacacugcgggcccagaacgcucucgauaaucuugucaugcugcacaacuccgaacagggaggcaaagccuaucgccaugcgauggaggagcugcccgacaccaucgaaacccucaugcugcuugcccugauugcuguucucacaggcggggugacccuguuuuuccugucuggaaagggccucgggaagacaagcaucggacuucugugugugacggccuccucugcucugcucuggauggccagcgucgagccgcacuggaucgccgcuuccauuauccuggaauuuuuccuuauggugcugcucauuccugagcccgauagacagcggaccccucaagacaaucagcuggcguacguugugaucggccugcucuuuaugauucuuacagucgccgcuaacgagauggggcugcuggaaaccaccaaaaaggaucucggaaucggcuauguggccgccgagaaccaucagcacgcuaccaugcuggacgucgaucuucaccccgccagcgcguggacgcuguacgccguggcuaccacaguuaucaccccuaugaugcgccauacaauugaaaauaccacggccaacaucucucucacagcuauugccaaucaagcggccauccugaugggccuggacaaaggguggcccauuuccaagauggauaucggagugccgcuccuugcucugggcugcuacagccaggucaacccucugacccucacagccgcugugcugaugcuuguugcccacuaugcuauuaucgggcccggacugcaggccaaagcgaccagagaggcccagaagcggaccgcugccggcaucaugaagaaucccacaguggacgggauugucgcuaucgaucucgacccugugguguacgaugccaaauucgaaaagcaacugggacagauuaugcugcucauccuuuguacgucucagauucugcugaugcgcaccacaugggcccucugcgaguccaucacccuggcgacaggcccgcuuaccacgcugugggagggcagccccgggaaauucuggaacacaaccaucgcuguuucuauggccaauauuuuuagaggaagcuaucucgcuggcgccgggcuggccuucucccugaugaagucucucggaggcgggcggcgcggaaccggcgcucagggcgaaacacuuggggagaaauggaagagacaacugaaccagcugagcaaguccgaauuuaauaccuacaaacggagcggaaucauggaggucgacagauccgaagccaaggagggccucaaacgcggggagacaacgaagcaugcggugucucggggaaccgccaaacugagaugguucguggaacgcaaccuugucaagccugagggcaagguuauugaccugggguguggacggggcggcuggagcuauuacugcgcugggcucaaaaaggugacagaagugaaaggauauaccaagggcgggcccggacacgaggaaccuauccccauggccacauacggcuggaaucuggucaaacugcauuccgggaaggauguguuuuucaugccuccggagaaaugugacacccuccuuugcgauauuggagagucuagccccaacccuacgaucgaagagggcagaacccugcgcguucugaagaugguggaacccuggcuccggggcaaucaguuuuguaucaagauucugaacccuuacaugcccuccgucguggagacacuugagcagaugcaaagaaaacacgggggaaugcugguucgcaauccgcucucucggaacagcacccacgaaauguauuggguguccugcggcacagggaauaucgucagcgcugugaacaugaccucuagaaugcugcugaaccgcuucacaauggcccaucggaagccuaccuacgagagagacguggaucucggagcgggcacgcgccacgucgccguugaacccgagguggcuaaucuggacauuaucgggcagagaauugaaaacaucaaaaaugagcauaaguccacauggcacuaugaugaggacaaccccuacaaaaccugggccuaucacggaagcuacgaagugaagccuucuggcuccgcuagcucuauggucaauggcgugguucggcuucugaccaagcccugggaugugauuccuauggucacacagaucgccaugacggacaccacaccguuugggcaacagcgcguguucaaagagaagguugauaccagaacaccccgggcuaaaagaggaaccacacagaucauggaagugaccgccaaguggcucugguccuuucugagccggaacaaaaagccucgcauuuguacgagagaggaguucacccggaagguccgcuccaaugcggccaucggcgcuguguuuguugacgagaaccaguggaauagcgccaaagaggcuguggaagacgagagauucugggaucuuguccaucgggaacgcgagcugcacaagcaagggaaaugcgccacaugcguguauaacaugaugggaaagagagagaaaaagcucggcgaguucgggaaggccaaaggcucucgggcgauuugguacauguggcugggagcucgcuuucuggaguucgaagcccucggcuuuaugaaugaggaccauugguucagcagagaaaacucccugucuggggucgagggagagggccuucacaagcugggguacauccuccgggauauuagcaaaauccccggaggcaauauguaugccgacgauaccgcugggugggacacacgcaucaccgaagaugaccugcagaacgaggccaagauuacggauaucauggaaccugagcaugcccuucuggccacauccauuuuuaaacucaccuaccagaauaaggugguuagagugcagcggcccgcgaaaaacggcacagucauggacgugaucucucgcagagaucaacggggaagcggccagguggggaccuauggacugaacacguucaccaauauggaaguucagcugauuagacagauggaguccgagggcaucuuucucccgucugaacuggagacaccuaaccuugccgaacgcgcucuggacuggcucgagaagcacggggccgaacggcugaagagaauggcuaucagcggagaugacuguguggucaaacccauugacgaucgcuucgccaccgcgcuuacagcccugaaugacaugggcaaggugcggaaagauaucccucaaugggagcccuccaagggguggaacgacuggcagcagguuccuuuuugcagccaccauuuccaccagcucauuaugaaagauggcagagagaucgugguccccugucgcaaucaagacgaacuggugggacgggcuagagucucucagggcgccggguggucccugcgcgagaccgcuugccucggaaagagcuacgcccagauguggcaacugauguauuuucaucggagagaucuucgccuggcugccaacgcgauuuguucugccgugccgguugacugggugccugcuucccggacaaccuggagcauccacgcccaccaucaguggaugacgacagaagauaugcucuccgucuggaauagaguguggaucgaggaaaaccccuggauggaggacaagacccacguuucuagcugggaggaagugcccuaccugggcaaacgggaggaucaguggugcgggucccuuauuggacugaccgccagagcuacaugggccaccaauauccaggucgcgauuaaccaagugcgccggcucaucggcaaugaaaacuaucuggacuacaugacaagcaugaagagauucaaaaaugagucugacccugagggggcucugugguga

SEQ ID NO: 19405 - RNA, 9879 nt, Artificial Sequence
  derived and/or modified CDS sequence (opt5) from DENV-1__KC692509__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggguguccuaugucauguguacgggcagcuucaaacuggaaaaggagguggccgagacacagcacggaaccguucuggugcaggucaaguacgaaggcaccgacgcgccgugcaaaauuccuuuuucuacacaagaugagaagggggugacccagaacggacggcuuaucacagcuaaucccaucgugacggacaaagaaaagccuguuaacauugagaccgagccccccuucggcgaauccuauaucgucgugggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugucggcaagcucgugcaucagguuuuugggaccgccuacggagugcuguucagcggcgucuccuggacgaugaaaaucgggaucggcauucuucugaccuggcucggacugaauagccgcucuacaucccugagcaugaccuguaucgcugugggcaugguuacacuuuaccucggggugaugguccaggccgauucuggaugcgugauuaacuggaagggccgggagcugaaauguggguccggaaucuuuguuaccaacgaagugcacacauggaccgagcaauauaaguuccaggcugacagcccuaagagacuguccgccgcgauuggcaaagccugggaggaaggggucugcggcauccgcucugcuacgcggcucgagaauauuauguggaagcagaucagcaacgaacugaaucauauccuucuggagaacgauaugaaauuuacagugguggucggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggagguugaagacuauggcuuuggcguguucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagucaagacauguaccuggcccaagagccacacacuguggucuaacggagugcuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacaguuguggucgaugaacacugcggcaacagaggccccucucuccggaccacaaccgugacggggaaaauuauccaugagugguguugccgcagcuguacacugccuccccugagauuccggggagaggacggcugcugguacgggauggaaauuagaccgguuaaggagaaagaagagaaucuugugcgcuccauggucagcgcgggaucuggcgaaguggauuccuuuagccucgggauccuguguguuuccaucaugauugaggaggugaugcggucuagauggagccgcaagaugcugaugaccggaacacucgcugucuuccugcuucugaucaugggccagcucaccuggaacgaccugauuagacugugcaucauggugggcgccaaugccuccgaccggauggggaugggaaccacauaccuugcucugauggccacguuuaagaugcgcccuauguucgcggugggccuccuguuuagacggcucaccucucgcgaaguccugcuucugacaauugggcucagccugguugcuuccguggagcugcccaacucucuugaagagcugggagauggccucgccauggggaucaugaugcugaaacuccugaccgaauuccaaccccaccagcuuuggacaacccugcucagccugacguuugugagaacaacccugucccuugacuaugccuggaagaccacagcuaugguccugagcauugugucucucuucccucugugucucuccaccacaagccagaaaacgaccuggcugccgguucuucugggaucuuuuggcugcaagccccugacaauguuccucaucaccgagaacaaaaucuggggccggaaguccuggccucugaaugaggggauuauggccaucggaauugugagcauccuucugucuucccuccugaagaacgaugucccccucgcuggcccucugauugccgggggaaugcuuaucgcguguuacgugaucagcggcuccagcgccgaccugucucuggaaaaagcugccgagguuagcugggaacaggaggcugaacauuccggggccucucacaauauucucguggagguccaagaugacggaacaaugaagaucaaagaugaggaacgcgacgauacccugacgauucuucugaaggccacccuccuggcugugagcggcgucuaucccauguccaucccugcgacacucuucgugugguacuuuuggcagaaaaagaaacagagaucuggcguucugugggacacccccagcccgccugagauggaacgggccgugcuugaugacgggauuuaucgcauccugcagagaggacugcucggccggucccaagucggggugggaguuuuccaggauggcguguuucauacaauguggcacgucaccagaggggcugugcugauguaccagggaaagcgccuugagcccucuugggccagcgugaagaaagaccugaucuccuauggcggcggguggcgguuccagggaagcuggaacacaggcgaggaaguucaagucauugccguggagccugggaagaaucccaaaaacgugcagacgaccccgggaacauuuaagaccccugaaggcgaggucggggcuaucgcccucgacuucaaacccggaaccucuggcuccccuauugugaauagagaaggcaagaucguugggcuguacggaaacggcguggucacaacgagcgggaccuacgugucugcgauugcucaggccaaggccucccaagagggaccccuccccgagaucgaagaugagguuuuuaaaaagcgcaaucugacaauuauggaccuucacccuggcagcgggaaaacccggagauaucugccggcuaucgugcgcgaagccaucaagcggaaacugagaacacucauucuggcgcccacccgcgucguggcuuccgagauggccgaagcccuuaagggcaugccuauccgguaccagacgacagcuguuaagucugagcauaccggaagagagauuguggaucugaugugccacgccaccuucacaaugcggcuccugagccccguccgcgugccuaacuauaauaugaucauuauggacgaagcucauuuuaccgaucccgccuccaucgcggccagaggcuacaucagcacacggguggggaugggagaggcugccgcuauuuucaugaccgccacgccuccgggcucugucgaagccuuuccccaguccaacgcuguuauccaggacgaggaacgcgauauuccugagagaagcuggaauucuggguaugacuggaucacagauuuccccggaaaaaccgugugguucgugccuagcauuaaguccggcaacgacaucgcgaauugucugcggaaaaacgggaagagagucauccaacucucucgcaaaacauuugauaccgaguaccagaagacgaagaacaaugacugggacuaugugguuaccacagauauuagcgaaaugggcgccaacuuccgggcugacagagugaucgauccccgccggugccuuaaaccggucauucugaaggacggaccugagagagugauccuggccggccccaugcccguuaccguggccuccgcugcccagcgccgggggagaauuggacgcaaucagaacaaagaaggcgaucaauacgucuacauggggcagccucucaauaacgacgaggaucacgcgcauuggacagaggcuaagaugcugcuugacaauaucaacacccccgaaggaauuaucccugcccuguuugagccggaaagagagaaaucugccgcuaucgauggcgaauaucggcuccgcggggaggccagaaagacauucguggagcugaugcggcgcggcgaccugcccgucuggcucagcuacaagguggcguccgaaggauuucaguauagcgauagacgguggugcuucgacggcgagagaaauaaccagguucuugaagagaauauggauguggaaauuuggaccaaagagggggagcgcaagaaacugcggccuagauggcuggacgcccgcacguacucugacccccucgcucugcgggaauuuaaggaguucgccgcuggaagacgguccgugagcggcgaucuuauccuggaaauugggaaacucccucaacaccugacacugcgcgcccagaacgcucucgacaaucuugucaugcugcacaacuccgagcagggaggcaaggccuauagacaugcgauggaagagcugcccgauaccaucgagacccucaugcugcuugcccugauugcuguucucacaggcggggugacccuguuuuuccugucuggaaaaggccucgggaagacaagcaucggacuucugugugugacggccuccucugcucugcucuggauggccagcgucgaaccgcacuggaucgccgcuuccauuauccuggaguuuuuccuuauggugcugcucauuccugaacccgaccggcagcgcaccccucaagauaaucagcuggcguacguugugaucggccugcucuuuaugauucuuacagucgccgcuaacgagauggggcugcuggagaccacaaagaaagaccucggaaucggcuauguggccgccgaaaaccaucagcacgcuaccaugcuggaugucgaccuucaccccgccagcgcguggacgcuguacgccguggcuaccacaguuaucaccccuaugaugagacauacaauugagaauaccacggccaacaucucucucacagcuauugccaaucaagcggccauccugaugggccuggauaagggguggcccauuuccaaaauggacaucggagugccgcuccuugcucugggcugcuacagccaggucaacccucugacccucacagccgcugugcugaugcuuguugcccacuaugcuauuaucgggcccggacugcaggccaaggcgacccgggaagcccagaaacgcaccgcugccggcaucaugaagaaucccacaguggaugggauugucgcuaucgaccucgauccugugguguacgacgccaaguucgagaaacaacugggacagauuaugcugcucauccuuuguacgucucagauucugcugaugagaaccacaugggcccucugcgaauccaucacccuggcgacaggcccgcuuaccacgcugugggagggcagccccgggaaguucuggaacacaaccaucgcuguuucuauggccaauauuuuucggggaagcuaucucgcuggcgccgggcuggccuucucccugaugaaaucucucggaggcgggcgcagaggaaccggcgcucagggcgagacacuuggggaaaaguggaaacggcaacugaaccagcugagcaaguccgaguuuaauaccuacaagagaagcggaaucauggaagucgaccgcuccgaggccaaagaaggccucaagcggggggagacaacgaaacaugcggugucuagaggaaccgccaagcugcgcugguucguggagcggaaccuugucaaaccugaaggcaagguuauugaucugggguguggaagaggcggcuggagcuauuacugcgcugggcucaagaaagugacagaggugaagggauauaccaaaggcgggcccggacacgaagagccuauccccauggccacauacggcuggaaucuggucaagcugcauuccgggaaagacguguuuuucaugccuccggaaaagugugauacccuccuuugcgacauuggagagucuagccccaacccuacgaucgaggaaggccgcacccugcggguucugaaaaugguggagcccuggcucagaggcaaucaguuuuguaucaagauucugaacccuuacaugcccuccgucguggaaacacuugagcagaugcaacgcaagcacgggggaaugcugguucggaauccgcucucuagaaacagcacccacgagauguauuggguguccugcggcacagggaauaucgucagcgcugugaacaugaccucucgcaugcugcugaaccgguucacaauggcccauagaaaaccuaccuacgaacgcgauguggaccucggagcgggcacgagacacgucgccguugagcccgaaguggcuaaucuggauauuaucgggcagcggauugagaacaucaagaaugaacauaaauccacauggcacuaugacgaggauaaccccuacaagaccugggccuaucacggaagcuacgaggugaaaccuucuggcuccgcuagcucuauggucaauggcgugguucgccuucugaccaagcccugggacgugauuccuauggucacacagaucgccaugacggauaccacaccguuugggcaacagagaguguucaaggaaaaaguugacacccggacacccagagcuaagcggggaaccacacagaucauggaggugaccgccaaauggcucuggggcuuucugucccgcaacaagaaaccuagaauuuguacgcgggaagaguucacccgcaaggucagaagcaaugcggccaucggggcuguguuuguugacgaaaaccaguggaauuccgccaaggaggcuguggaggaugaacgguucugggaccuuguccaucgcgagagagaacugcacaaacaaggaaagugcgccacaugcguguauaacaugaugggcaaacgggagaagaaacucggggaauucggcaaggccaagggaagccgcgcgauuugguacauguggcugggcgcuagauuucuggaguucgaggcccucggguuuaugaaugaagaucauugguucucucgggagaacagccuguccggagucgaaggcgaggggcuucacaaacugggauacauccuccgcgacauuucuaagauccccggcgggaauauguaugccgaugacaccgcuggcugggauacaagaaucaccgaggacgaucugcagaacgaagccaaaauuacggacaucauggagccugaacaugcucuucuggccacaagcauuuuuaagcucaccuaccagaauaaagugguucgggugcagcgccccgcgaagaacggaacagucauggaugugaucuccagacgggaccaaagaggcucugggcaggugggaaccuauggccugaacacguucaccaauauggagguucagcugauucgccagauggaaagcgaggggaucuuucucccguccgagcuggaaacaccuaaccuugccgagcgggcucuggauuggcucgaaaaacacggagccgagagacugaagcgcauggcuaucucuggcgacgacuguguggucaagcccauugaugaccgguucgccaccgcgcuuacagcccugaaugauauggggaaagugagaaaggacaucccucaaugggaacccagcaaaggcuggaacgauuggcagcagguuccuuuuugcucccaccauuuccaccagcucauuaugaaggacggacgcgagaucgugguccccugucggaaucaagaugagcuggugggcagagcucgcgucagccagggggccggauggucucugcgggaaaccgcuugccucggcaaauccuacgcccagauguggcaacugauguauuuucauagacgcgaccuucggcuggcugccaacgcgauuuguagcgccgugccgguugauugggugccugcuucuagaacaaccugguccauccacgcccaccaucaguggaugacgacagaggacaugcucagcgucuggaaucggguguggaucgaagagaaccccuggauggaagauaagacccacguuuccucuugggaggaggugcccuaccuggggaagagagaagaccaguggugcggaagccuuauuggccugaccgcccgcgcuacaugggccaccaauauccaggucgcgauuucccaagugcggagacucaucgggaacgagaauuaucuggacuacaugacaagcaugaaacgcuucaagaacgaaucugauccugagggcgcucugugguga

SEQ ID NO: 19406 - RNA, 9879 nt, Artificial Sequence
  derived and/or modified CDS sequence (opt5) from DENV-1__KC692510__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuuuggcgggccuaucagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagauuauccaugagugguguugcagaagcuguacacugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugaccggaacacucgcuguguuccugcuucugaucaugggccagcucaccuggaacgaccugauucggcugugcaucauggucggcgccaaugccuccgaccgcauggggaugggaaccacauaccuugcucugauggccacguuuaagaugagaccuauguucgcggugggccuccuguuucggcgccucaccucuagagaagugcugcuucugacaauugggcucagccuggucgcuuccguugagcugcccaacucucuugaagagcugggagauggccucgccauggggaucaugaugcugaagcuccugaccgaauuccaaccccaccagcuuuggacaacccugcucagccugacguuugugaaaacaacccugucccuugacuaugccuggaagaccacagcuauggugcugagcauugucucucucuucccucugugucucuccaccacaagccagaaaacgaccuggcugccggugcuucugggaucuuuuggcugcaagccccugacaauguuccucaucaccgagaacaaaaucuggggccggaaguccuggccucugaaugaggggauuauggccaucggaauuguuagcauccuucugucuucccuccugaagaacgaugugccccucgcuggcccucugauugccgggggaaugcuuaucgcguguuacgucaucagcggcuccagcgccgaccugucucuggaaaaagcugccgaggugagcugggaacaggaggcugaacauuccggggccucucacaauauucucguugaggugcaagaugacggaacaaugaagaucaaagaugaggaacgcgacgauacccugacgauucuucugaaggccacccuccuggcugucagcggcguguaucccauguccaucccugcgacacucuucgucugguacuuuuggcagaaaaagaaacagagaucuggcgugcugugggacacccccagcccgccugagguugaacgggccgugcuugaugacgggauuuaucgcauccugcagagaggacugcucggccggucccaagucggggugggaguuuuccaggauggcguguuucauacaauguggcacgucaccagaggggcugugcugauguaccagggaaagcgccuugagcccucuugggccagcgugaagaaagaccugaucuccuauggcggcggguggcgguuccagggaagcuggaacacaggcgaggaaguucaagucauugccguggagccugggaagaaucccaaaaacgugcagacgaccccgggaacauuuaagaccccugaaggcgaggucggggcuaucgcccucgacuucaaacccggaaccucuggcuccccuauugugaauagagaaggcaagaucguugggcuguacggaaacggcguggucacaacgagcgggaccuacgugucugcgauugcucaggccaaggccucccaagagggaccccuccccgagaucgaagaugagguuuuuaaaaagcgcaaucugacaauuauggaccuucacccuggcagcgggaaaacccggagauaucugccggcuaucgugcgcgaagccaucaagcggaaacugagaacacucauucuggcgcccacccgcgucguggcuuccgagauggccgaagcccuuaagggcaugccuauccgguaccagacgacagcuguuaagucugagcauaccggaagagagauuguggaucugaugugccacgccaccuucacaaugcggcuccugagccccguccgcgugccuaacuauaauaugaucauuauggacgaagcucauuuuaccgaucccgccuccaucgcggccagaggcuacaucagcacacggguggggaugggagaggcugccgcuauuuucaugaccgccacgccuccgggcucugucgaagccuuuccccaguccaacgcuguuauccaggacgaggaacgcgauauuccugagagaagcuggaauucuggguaugacuggaucacagauuuccccggaaaaaccgugugguucgugccuagcauuaaguccggcaacgacaucgcgaauugucugcggaaaaacgggaagagagucauccaacucucucgcaaaacauuugauaccgaguaccagaagacgaagaacaaugacugggacuaugugguuaccacagauauuagcgaaaugggcgccaacuuccgggcugacagagugaucgauccccgccggugccuuaaaccggucauucugaaggacggaccugagagagugauccuggccggccccaugcccguuaccguggccuccgcugcccagcgccgggggagaauuggacgcaaucagaacaaagaaggcgaucaauacgucuacauggggcagccucucaauaacgacgaggaucacgcgcauuggacagaggcuaagaugcugcuugacaauaucaacacccccgaaggaauuaucccugcccuguuugagccggaaagagagaaaucugccgcuaucgauggcgaauaucggcuccgcggggaggccagaaagacauucguggagcugaugcggcgcggcgaccugcccgucuggcucagcuacaagguggcguccgaaggauuucaguauagcgauagacgguggugcuucgacggcgagagaaauaaccagguucuugaagagaauauggauguggaaauuuggaccaaagagggggagcgcaagaaacugcggccuagauggcuggacgcccgcacguacucugacccccucgcucugcgggaauuuaaggaguucgccgcuggaagacgguccgugagcggcgaucuuauccuggaaauugggaaacucccucaacaccugacacugcgcgcccagaacgcucucgacaaucuugucaugcugcacaacuccgagcagggaggcaaggccuauagacaugcgauggaagagcugcccgauaccaucgagacccucaugcugcuugcccugauugcuguucucacaggcggggugacccuguuuuuccugucuggaaaaggccucgggaagacaagcaucggacuucugugugugacggccuccucugcucugcucuggauggccagcgucgaaccgcacuggaucgccgcuuccauuauccuggaguuuuuccuuauggugcugcucauuccugaacccgaccggcagcgcaccccucaagauaaucagcuggcguacguugugaucggccugcucuuuaugauucuuacagucgccgcuaacgagauggggcugcuggagaccacaaagaaagaccucggaaucggcuauguggccgccgaaaaccaucagcacgcuaccaugcuggaugucgaccuucaccccgccagcgcguggacgcuguacgccguggcuaccacaguuaucaccccuaugaugagacauacaauugagaauaccacggccaacaucucucucacagcuauugccaaucaagcggccauccugaugggccuggauaagggguggcccauuuccaaaauggacaucggagugccgcuccuugcucugggcugcuacagccaggucaacccucugacccucacagccgcugugcugaugcuuguugcccacuaugcuauuaucgggcccggacugcaggccaaggcgacccgggaagcccagaaacgcaccgcugccggcaucaugaagaaucccacaguggaugggauugucgcuaucgaccucgauccugugguguacgacgccaaguucgagaaacaacugggacagauuaugcugcucauccuuuguacgucucagauucugcugaugagaaccacaugggcccucugcgaauccaucacccuggcgacaggcccgcuuaccacgcugugggagggcagccccgggaaguucuggaacacaaccaucgcuguuucuauggccaauauuuuucggggaagcuaucucgcuggcgccgggcuggccuucucccugaugaaaucucucggaggcgggcgcagaggaaccggcgcucagggcgagacacuuggggaaaaguggaaacggcaacugaaccagcugagcaaguccgaguuuaauaccuacaagagaagcggaaucauggaagucgaccgcuccgaggccaaagaaggccucaagcggggggagacaacgaaacaugcggugucuagaggaaccgccaagcugcgcugguucguggagcggaaccuugucaaaccugaaggcaagguuauugaucugggguguggaagaggcggcuggagcuauuacugcgcugggcucaagaaagugacagaggugaagggauauaccaaaggcgggcccggacacgaagagccuauccccauggccacauacggcuggaaucuggucaagcugcauuccgggaaagacguguuuuucaugccuccggaaaagugugauacccuccuuugcgacauuggagagucuagccccaacccuacgaucgaggaaggccgcacccugcggguucugaaaaugguggagcccuggcucagaggcaaucaguuuuguaucaagauucugaacccuuacaugcccuccgucguggaaacacuugagcagaugcaacgcaagcacgggggaaugcugguucggaauccgcucucuagaaacagcacccacgagauguauuggguguccugcggcacagggaauaucgucagcgcugugaacaugaccucucgcaugcugcugaaccgguucacaauggcccauagaaaaccuaccuacgaacgcgauguggaccucggagcgggcacgagacacgucgccguugagcccgaaguggcuaaucuggauauuaucgggcagcggauugagaacaucaagaaugaacauaaauccacauggcacuaugacgaggauaaccccuacaagaccugggccuaucacggaagcuacgaggugaaaccuucuggcuccgcuagcucuauggucaauggcgugguucgccuucugaccaagcccugggacgugauuccuauggucacacagaucgccaugacggauaccacaccguuugggcaacagagaguguucaaggaaaaaguugacacccggacacccagagcuaagcggggaaccacacagaucauggaggugaccgccaaauggcucuggggcuuucugucccgcaacaagaaaccuagaauuuguacgcgggaagaguucacccgcaaggucagaagcaaugcggccaucggggcuguguuuguugacgaaaaccaguggaauuccgccaaggaggcuguggaggaugaacgguucugggaccuuguccaucgcgagagagaacugcacaaacaaggaaagugcgccacaugcguguauaacaugaugggcaaacgggagaagaaacucggggaauucggcaaggccaagggaagccgcgcgauuugguacauguggcugggcgcuagauuucuggaguucgaggcccucggguuuaugaaugaagaucauugguucucucgggagaacagccuguccggagucgaaggcgaggggcuucacaaacugggauacauccuccgcgacauuucuaagauccccggcgggaauauguaugccgaugacaccgcuggcugggauacaagaaucaccgaggacgaucugcagaacgaagccaaaauuacggacaucauggagccugaacaugcucuucuggccacaagcauuuuuaagcucaccuaccagaauaaagugguucgggugcagcgccccgcgaagaacggaacagucauggaugugaucuccagacgggaccaaagaggcucugggcaggugggaaccuauggccugaacacguucaccaauauggagguucagcugauucgccagauggaaagcgaggggaucuuucucccguccgagcuggaaacaccuaaccuugccgagcgggcucuggauuggcucgaaaaacacggagccgagagacugaagcgcauggcuaucucuggcgacgacuguguggucaagcccauugaugaccgguucgccaccgcgcuuacagcccugaaugauauggggaaagugagaaaggacaucccucaaugggaacccagcaaaggcuggaacgauuggcagcagguuccuuuuugcucccaccauuuccaccagcucauuaugaaggacggacgcgagaucgugguccccugucggaaucaagaugagcuggugggcagagcucgcgucagccagggggccggauggucucugcgggaaaccgcuugccucggcaaauccuacgcccagauguggcaacugauguauuuucauagacgcgaccuucggcuggcugccaacgcgauuuguagcgccgugccgguugauugggugccugcuucuagaacaaccugguccauccacgcccaccaucaguggaugacgacagaggacaugcucagcgucuggaaucggguguggaucgaagagaaccccuggauggaagauaagacccacguuuccucuugggaggaggugcccuaccuggggaagagagaagaccaguggugcggaagccuuauuggccugaccgcccgcgcuacaugggccaccaauauccaggucgcgauuaaccaagugcggagacucaucgggaaugagaacuaucuggacuacaugacauccaugaaacgcuucaagaaugaaagcgauccugagggcgcucugugguga

SEQ ID NO: 19407 - RNA, 9879 nt, Artificial Sequence
  derived and/or modified CDS sequence (opt5) from DENV-1__KC692511__SS-prME
agcgugaccaugcugcugaugcugcuucccacagcucuggcuuuccaccucacgaccagaggaggggagccucauaugaucguguccaagcaggaacggggaaaaucucugcuuuuuaagacaagcguuggcgugaacaugugcacccugauugccauggaccuuggggagcugugugaagauacaaugaccuacaaaugccccagaaucacagaggcggaacccgacgauguggacuguuggugcaaugcuaccgauacgugggucaccuauggaacauguucccagaccggcgagcacagacgggacaagcgcucuguggcccuggccccucauguugggcucggacuggagacaagaaccgaaacguggaugagcuccgagggcgcuuggaaacagauucagaagguggaaaacugggcccuucggcaccccggcuucacagucaucgcucuguuucucgcccaugcgauugggaccucuaucacacagaagggaaucauuuucauccugcuuaugcuggugaccccuagcauggccaugcgcugcguuggcauugggaauagagauuuuguggagggacucuccggcgcuaccugggucgacguggugcuggagcacgggagcugugucacaacgauggccaaaaacaagcccacccuggauaucgaacuccugaaaacagagguuaccaauccugcugugcuucggaagcugugcauugaagccaaaaucucuaacacaaccacggacucccgcuguccgacacaaggagaggcgacccucguggaggaacaagaugccaauuucgucugcagacggaccuuuguggaccgcggcuggggcaacggguguggacuguucggcaaggggagccuucugacaugcgcuaaguuuaaaugcguuaccaagcucgagggaaaaauugugcaguacgaaaaucugaaguauucugucaucgugacaguucacacgggcgaucagcaucaaguggggaacgagaccacagaacacggaaccaucgccacaauuacgccccaagcuccuaccuccgagauccagcugaccgacuacggcgcccucacacuggacuguagccccagaaccggccuugauuucaaugaaaugguccugcucacaaugaaagagaagucuuggcuggugcauaaacagugguuucuugaccugccucuccccuggaccuccggggccagcacgucccaagagacauggaaccggcaggaucugcuggucaccuucaagacagcucacgcgaagaaacaggaagugguugugcucggaucucaagagggcgccaugcacaccgcucugaccggggccacagaaauucagacgagcggaaccacaaccaucuuugccggccaucuuaagugccgccugaaaauggacaagcucacacugaaagggauguccuaugucauguguaccggcagcuucaagcuggagaaggaaguggcugagacgcagcacggaacaguucuugugcaggucaaauacgagggcaccgaugccccgugcaagauuccuuuccucacccaagacgaaaaaggggugacacagaauggaagacugaucaccgcgaaccccaucgugacagauaaggagaaaccuguuaauauugaaacggagccgcccuuuggcgagucuuauaucgucgugggggcuggagaaaaggcccugaagcucuccugguucaaaaagggcagcucuauugggaaaauguuugaggccaccgcucggggcgccagacgcauggcuauccugggagacacagccugggauuucggcagcauugggggacuuuuuaccuccgugggcaagcugauccaucagaucuucgggacagcguacggaguccucuuuucuggcgugagcuggaccaugaaaauugggaucggcauucugcugacguggcuuggacucaacucccggagcaccucucuguccaugacauguaucgccguuggcauggugacccuguaccucggggucauggugcaggcugacagcggaugcguuauuaacuggaagggcagagaacugaagugugggucuggaaucuucgugacaaaugagguccacaccuggacagaacaauauaaauuucaggccgauuccccuaagcgccuuagcgcugccauuggcaaagcgugggaggagggggugugcggcauccgguccgccaccagacuggaaaacaucauguggaagcagauuucuaaugagcucaacuacauccugcuggaaaaugacaugaaauucacgguuguggucggagacauuaacggcauccuugcucaggggaagaaaaugauucgcccgcaacccauggagcauaaguauagcuggaaguccuggggaaaagccaagaucaucggcgcugauauucagaauacaaccuuuaucauugacgggccugauacccccgaauguccuaacgaccagcgggccuggaauaucugggagguggaggauuacggauucggcauuuuuacaaccaacaucuggcucaaacugagagacucucacacgcagaugugcgaucaccgccugaugagcgccgcuaucaaggacuccaaagcggugcaugccgauaugggcuauuggauugaaagcgagaagaaugaaacauggaagcucgcucgggccucuuucaucgaggucaaaaccuguauuuggcccaagucccacacacuguggagcaacgggguucuugaaucugagauggugaucccgaaaauuuacggaggcccuaucucccaacauaauuauagacccggguacuucacccagacagccggaccuuggcaccugggcaagcucgagcuggacuuugaucugugcgaagggaccacgguggucguggacgagcacugcggauaccgcggccccagccuucggaccacaaccguuacaggcaaaaucauucaugaaugguguugcagaucuuguacccucccuccccugcgguuccgcggggaggauggaugcugguauggcauggagaucagaccggugaaggaaaaggaggaaaaccugguccggagcaugguguccgcugggagcggagagguugacucuuuuucccucggcauucugugugugagcauccuuauugaagaggucaugagaucccgcuggucucggaaaaugcugaugacggggacacucgccguguuccugcugcuuaucaugggacagcugaccuggaaugaccucauuagacugugcaucaugguuggcgcgaacgcuagcgaucgcaugggcauggggacaaccuaccucgcccugauggccaccuuuaagaugagaccuauguucgcugugggacuucuguuucggcgccucacauccagagagguccugcugcuuacggugggccugucucucguggccagcgucgaacugcccaacucccucgaggaacugggggacggacuugcgaugggcaucaugaugcugaaacuccugaccgauuuccaaccccaccagcuguggacaacccuucugucucucacauuuauucggaccagccugucccucgacuaugcuuggaagacgauggccauggcccugagcaucguuucucuuuucccucugugucuguccacaaccagccagaaaaccacauggcucccggugcugcuugggucuuuuggaugcaagccccugaccauguuccucauuacagagaauaagaucuggggccgcaaauccuggccuauuaacgaaggcaucauggcuguggggaucgucagcauucugcucucuucccugcuuaagaaugaugugccccuggccggaccucugaucgcuggcgggaugcucauugccuguuacguuaucagcggauccagcgcggaccugucucuugagaaagccgcugaggugagcugggaagaggaagccgagcauuccggcacgucucacaacauucuggucgaagugcaggaugacgggaccaugaagaucaaagaugaggagagagacgauacacucaccauccugcucaaggcuacacugcuugccguuagcggaguguaucccauguccauuccugccacccuguuugucugguacuucuggcagaagaagaagcagcggucuggcgugcugugggacacgcccagcccgccugaagucgagcgcgcugugcucgaugacggcaucuaucgcauucugcagcgggggcuucugggacgcucccagguuggcgugggggucuuccaagacggaguguuucauaccauguggcacguuacaagaggcgcggugcucauguaccaggggaaacggcuggaacccucuugggccagcgucaagaaagaucucaucuccuacggaggcggcuggagauuccaggggagcuggaauaccggagaggagguccaggugauugcuguugaaccuggcaagaaccccaaaaauguccaaacaaccccggggacauuuaagacgccugagggagaagugggcgccaucgcccuggacuucaagcccgggaccucuggauccccuauugugaaccgcgagggcaaaaucgucggccuuuaugggaauggagugguuacaaccagcggcaccuacgugucugcuaucgcccaggcgaaggcuacacaggaagggccccugcccgagauugaggaugaagucuuuaaaaagcggaaccugacgaucauggaccuccacccuggauccggcaaaaccagacgcuaucugccggccauugugcgggaggccaucaagagaaaacuucgcacacugauucucgcucccacccggguuguggccagcgaaauggcggaggcucugaaagggaugccuaucagauaccaaacaaccgccgucaaguccgaacauacgggccgcgagaucguggaucugaugugccacgccacauucaccaugcggcuccuuucucccguuagagugccuaauuauaacaugauuaucauggacgaggcucauuuuaccgaucccgccagcauugcugcccggggauacaucuccacacgcgucggcaugggggaagcggccgcuauuuucaugaccgccacaccuccgggaagcguggaggcuuuuccccagucuaaugccgugauccaggacgaagagagagauaucccugaacgguccuggaacagcggcuaugacuggauuaccgauuuccccgggaaaacggucugguuuguuccuucuaucaagagcggaaaugacauugccaacugucugcgcaaaaacggcaagagagugauccagcugucccggaagacauucgacaccgaguaccagaagacaaagaauaacgauugggacuacguggucaccacggauauuucugagaugggggcuaauuucagagcggaccgcgugaucgauccccggagaugccucaaaccgguuauucugaaggaaggcccugagcgcgugauccuugccggacccaugcccgucaccguggcuagcgccgcccagcggagaggccgcaucgggcggaaccagaauaaagaaggagaccaguauauuuacaugggccaaccucugaacaaugaugaggaccacgcucauuggacagaggccaagaugcuccuggauaacaucaauacccccgaagggauuaucccugcgcuguuugagccggaaagagagaaguccgcugccauugacggagaauaucgccucagaggcgaggcccggaaaacauucguugagcuuaugcgcagaggggaucugcccguguggcugucuuacaaggucgcuagcgaaggcuuucaguauuccgaccggcgcuggugcuucgauggagagagaaacaaucaggugcucgaagagaacauggacgucgaaaucuggaccaaagagggcgagcggaagaaacugagaccucgcuggcuugacgcccggacauacagcgauccccuggcgcucagagaauuuaaggaguucgccgcugggcgccggucuguguccggagaccugauccuggaaauuggcaaacucccucagcaccuuacccugagagcccaaaaugcucuggauaaccucguuaugcugcacaauagcgagcaagggggaaaggccuaucggcaugcuauggaggaacuucccgacacgaucgagacacugaugcuccuggcccugauugcggugcucaccggcggcgugacccucuuuuuccuguccgggaagggacugggcaaaacaucuaucgggcuccugugugucauggccagcuccgcccuucuguggauggccucuguugaaccgcacuggauugcugccagcaucauccucgaguuuuuccugauggugcugcucauuccugaacccgaucgccagagaaccccucaggacaaccaacuugccuacguggucaucggacugcuguuuaugauucucacaguggcugcgaacgagaugggccugcuugagacgaccaagaaagaucuggggaucggacauguugccguggaaaaucaccaccaugcuacaaugcucgacgucgaucugcggcccgccuccgccuggacccuguacgcuguggccacaaccgucauuacgccuaugaugcgccacaccaucgagaacacaaccgcgaauauuagccucacagccaucgcuaaccaggccgcuauccuuaugggccuggacaagggcuggcccauuucuaaaauggauaucggggugccgcugcucgcccugggaugcuauucccagguuaauccucuuacccugacggcggccgugcucaugcuggucgcucauuacgccauuaucggccccgggcugcaagcuaaggccacaagagaagcucagaagcggaccgccgcgggaauuaugaaaaaccccacaguggacggcaucguuaccaucgaucucgacccuguggucuaugacgccaaguucgagaaacagcuugggcagauuaugcugcugauccucuguaccagccaaauucugcuuaugcgcacaacgugggcucugugcgaaucuaucacccucgccacaggaccgcugaccacacugugggagggcucccccggcaaguuuuggaauaccacgauugcugugagcauggccaacaucuucagagggucuuaccucgccggagcgggccuugcuuucagccugaugaaaucccucgggggaggccggcgcgggacaggagcccagggcgagacccucggcgaaaaguggaagagacagcugaaucagcuuucuaaaagcgaguuuaacaccuauaagaaauccgggaucauggaaguggaucggagcgaggcuaaggaaggacugaaaagaggcgagacaaccaagcacgccguuucccgcgggacagccaagcuccggugguucgucgagagaaaucuggugaaaccugaaggaaaggugauugaccugggcugugggcgcggaggcuggucuuacuauugcgcuggccucaaaaaggucacggagguuaaaggguacaccaagggaggccccgggcaugaggagccuauccccauggccacauacggauggaaccuugugaaacugcacagcggcaaggauguguuuuucaccccuccggaaaagugugacacacugcucugcgauauuggggaguccucucccaauccuaccaucgaggaaggacggacgcugagaguccuuaaaaugguggagcccuggcugcgcggcaaccaauuuuguauuaagauccucaauccuuauaugcccagcguuguggaaacccuggagcagaugcagcggaaacacggcgggaugcuggucagaaacccgcucucccgcaauucuacacaugagauguacugggugagcugcggaaccggcaacauuguuuccgcggugaacaugacaagccggaugcugcuuaauagauucaccauggcccaccgcaagccuacauaugaacgggacgucgaucugggggcuggaaccagacauguggccguggagcccgaagucgcuaaccucgacaucaucggccagcgcauugagaauaucaaaaacgaacacaagucuacguggcacuacgaugaggacaaucccuauaagacaugggccuaccauggguccuaugagguuaaaccuagcggaucugcguccagcauggugaacggcguggucagacugcuuaccaagcccugggaugugauuccuaugguuacccaaaucgccaugacagacacgaccccguuuggccagcagcggguguucaaagaaaaggucgacacacgcacccccagagcuaaacgggggacagcccaaauuauggaggugaccgcuaaguggcuguggggauuucucucuagaaauaagaaaccucggaucuguacacgcgaagaguucaccagaaagguucgguccaacgccgcuaucggcgccguguuugucgaugaaaaucaguggaacagcgcgaaagaggccguggaggacgaacgcuucugggaucugguucacagagagcgggaacugcauaagcaggggaaaugcgcuacgugcguguacaauaugaugggaaagcgcgagaagaaacucggcgaauuugggaaggccaaaggcuccagagcuauuugguacauguggcugggagcccgguuccuugaguucgaggcccugggcuuuaugaacgaagaccacugguucagccgcgaaaauucucucagcggggucgaaggagagggccugcauaaacuuggguauauccugagagauauuuccaaaauccccggaggcaacauguacgcggacgauaccgcugggugggacacacggauuaccgaggaugaccuccagaaugaagccaagaucacagauaucauggagccugaacacgcccugcuggcuaccucuauuuuuaaacucacguaucaaaacaaggugguccgcgugcagagacccgccaagagcggcacaguuauggacgugaucucccggcgcgaucagagaggaucuggccaggucgggaccuacggacugaacacauucaccaauauggaggugcaacuuauucggcagauggaaagcgagggcaucuuuuccccgucugagcuggaaacgccuaaccucgcuaaaaaggugcuggacuggcuugagaaacacggggccgaaagacugaagcgcauggcgauuagcggagacgauuguguugugaaacccaucgacgaucgguucgccaccgcucucacagcccugaaugacaugggcaaggucagaaaggauaucccucagugggagcccuccaaaggguggaacgacuggcagcaagugccuuuuugcagccaucacuuccaucagcugauuaugaaggauggccgcgaaaucguugugcccugucggaaucaggacgagcucgucggcagagcucgcgugucucagggcgccggguggucccugcgggagaccgcgugccuuggaaaaagcuaugcccaaauguggcagcugauguacuuucacagacgcgaucuccggcuggcugccaacgcuauuuguucugccgucccgguggacuggguuccuacauccagaaccacauggagcauccacgcucaucaccaguggaugaccacggaagauaugcuuuccguguggaaucgcgucuggauugaggaaaaccccuggauggaggacaagacacaugugucuagcugggaagagguucccuaucugggcaaacgggaggaccaauggugcgggucccucaucggacugaccgccagagcgaccugggccacaaauauucagguggcuaucaaccagguccggagacugaucggcaaugaaaacuaccucgauuacaugaccagcaugaagcgcuucaagaaugagucugacccugaaggggcccugugguga

SEQ ID NO: 19408 - RNA, 9879 nt, Artificial Sequence
  derived and/or modified CDS sequence (opt5) from DENV-1__KC692512__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggacuuuguugagggacucuccggcgccacauggguggaugucgugcuggaacacgggagcugugugacgaccauggcuaagaauaaacccacacuggacaucgagcuccugaagaccgaagucacaaacccugccguucuucgcaaacugugcauugaggcgaagaucucuaauaccacgacagauuccagauguccgacccaaggagaagccacccucguggaggagcaggacgcuaacuucgugugccggcgcacauuugucgauagaggcuggggcaauggguguggacuguucggcaaagggagccuucugaccugcgccaaguuuaagugcgugacaaaacucgaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcugacagauuacggcgcccucacccuggacuguagcccccggacaggccuugacuucaacgagauggugcugcucaccaugaaggagaaaucuuggcugguccauaagcagugguuucuugaucugccucuccccuggacguccggggcuagcacaucccaagaaaccuggaaucgccaggaccugcuggugacauucaaaaccgcgcacgccaagaagcaggaggucgugguucucggaucucaagaaggcgcuaugcacaccgcccugacaggggccacggagauucagaccagcggaacaaccacaaucuuugcuggccaucuuaaaugcagacugaagauggauaaacucacccugaaggggauguccuaugugauguguacgggcagcuucaaacuggaaaaggaggucgccgagacacagcacggaaccgugcuuguucaggugaaguacgaaggcaccgacgcgccgugcaaaauuccuuucucuacacaagaugagaagggggucacccagaacggacggcucaucacagcuaaucccaucgugacggacaaagaaaagccugugaacauugagaccgagccccccuuuggcgaauccuauaucguugucggggccggagagaaagcccugaagcugagcugguucaagagaggcucuagcauugggaaaauguuugaagcuacagcccgcggcgcucggagaauggccauccucggagauaccgcgugggacuucggcuccauugggggaguguuuacaucugugggcaagcugguccaucagguguucgggaccgccuacggaguucuuuuuagcggcguguccuggacgaugaaaaucgggaucggcauucugcucaccuggcugggacugaauagccgcucuacaucccuuagcaugaccuguaucgcugucggcauggugacacucuaccuggggguuauggugcaggccgauucuggaugcgucauuaacuggaagggccgggagcugaaauguggguccggaaucuucgugaccaacgaaguucacacauggaccgagcaauauaaguuucaggcugacagcccuaagagacucuccgccgcgauuggcaaagccugggaggaaggggugugcggcauccgcucugcuacgcggcuggagaauauuauguggaagcagaucagcaacgaacuuaaucauauccugcucgagaacgauaugaaauucacagucguggugggagacgccaauggcauucuggcucaggggaagaaaaugaucagaccgcaacccauggaacacaaguacuccuggaaaucuuggggaaaggccaagauuaucggcgccgacauucagaacaccaccuuuaucaucgaugggccugacacacccgaguguccugauggacagcgcgcuuggaauauuugggaggucgaagacuauggcuucggcguuuuuaccacgaacaucuggcugaaacuucgggauagcuacacacagaugugcgaccacagacucauguccgcggccauuaaggauagcaaagcugugcaugccgacaugggguauuggaucgagucugaaaagaaugagaccuggaaacuggcccgcgcuuccuucauugaagugaagacauguaccuggcccaagagccacacacuguggucuaacggaguccucgaguccgagaugaucaucccgaaaauuuucggcgggccuaucagccaacauaauuaccggcccggauauuuuacccagacggccggcccuuggcaccuggggaagcuugaacuggauuucgaccucugcgagggaaccacagugguuguggaugaacacugcggcaacagaggccccucucugcggaccacaaccgucacggggaaaauuauccaugagugguguugccgcagcuguacacugccuccccuuagauuucggggagaggacggcugcugguacgggauggaaauuagaccggugaaggagaaagaagagaaucucguucgcuccauggugagcgcgggaucuggcgaagucgauuccuucagccuggggauccuguguguguccaucaugauugaggagguuaugcggucuagauggagccgcaagaugcucaugaccggaacacuggcuguguuucuucugcucaucaugggccagcugaccuggaacgaccugauuagacuuugcaucauggucggcgccaaugccuccgaccggauggggaugggaaccacauaccuggcucucauggccacguucaagaugcgcccuauguuugcggugggccugcucuucagacggcugaccucucgcgaagugcuucugcucacaauugggcugagccuggucgcuuccguugagcuucccaacucucuggaagagcucggagauggccuggccauggggaucaugaugcucaaacugcuuaccgaauuucaaccccaccagcuguggacaacccuccugagccugacguucgugaagacaacccuuucccuggacuaugccuggaaaaccacagcuauggugcucagcauugucucucuguuuccucucugucuguccaccacaagccagaagacgaccuggcuuccggugcugcugggaucuuucggcugcaaaccccucacaauguuucugaucaccgagaacaagaucuggggcagaaaguccuggccucuuaaugaggggauuauggccaucggaauuguuagcauccugcucucuucccugcucaaaaacgaugugccccuggcuggcccucuuauugccgggggaaugcugaucgcguguuacgucaucagcggcuccagcgccgaccugucucucgaaaaggcugccgaggugagcugggaacaggaggcugaacauuccggggccucucacaauauucugguugaggugcaagaugacggaacaaugaaaaucaaggaugaggaacgggacgauacccuuacgauucugcucaaagccacccugcucgcugucagcggcguguaucccauguccaucccugcgacacuguucgucugguacuucuggcagaagaaaaagcagcgcucuggcgugcuuugggacacccccagcccgccugagguugaaagagccgugcuggaugacgggauuuaucggauccugcagcgcggacuccugggcagaucccaagucggggugggaguuuuucaggauggcguguuccauacaauguggcacgucacccggggggcugugcuuauguaccagggaaagagacuggagcccucuugggccagcgugaaaaaggaccucaucuccuauggcggcggguggcgcuuucagggaagcuggaacacaggcgaggaaguucaagucauugccguggagccugggaaaaaucccaagaacgugcagacgaccccgggaacauucaaaaccccugaaggcgaggucggggcuaucgcccuggacuuuaagcccggaaccucuggcuccccuauugugaaucgggaagagaagaucguuggccucuacgggaacggaguggucacaacgagcggcaccuacgugucugcgauugcucaggccaaagccucccaagaggggccccugcccgaaaucgaggaugaaguuuucaagaaaagaaaucuuacaauuauggaccugcacccuggaagcggcaagacccgccgguaucugccggcuaucgugagagaggccaucaaacgcaagcuccggacacugauucuugcgcccaccagagucguggcuuccgaaauggccgaggcccugaaggggaugccuauccgcuaccagacgacagcuguuaaaucugagcauaccggccgggaaauuguggaucucaugugccacgccaccuuuacaaugagacugcugagccccguccgggugccuaacuauaauaugaucauuauggacgaggcucauuucaccgaucccgccuccaucgcggcccgcggauacaucagcacaagagugggcaugggggaagcugccgcuauuuuuaugaccgccacgccuccgggaucugucgaggccuucccccaguccaacgcuguuauccaggacgaagagcgggauauuccugagcgcagcuggaauucuggcuaugacuggaucacagauuuucccgggaagaccgugugguucgugccuagcauuaaauccggaaacgacaucgcgaauugucucagaaagaacggcaaacgggucauccaacuuucuagaaagacauucgauaccgaauaccagaagacgaaaaacaaugacugggacuaugugguuaccacagauauuagcgagaugggggccaacuuucgcgcugaccgggugaucgaucccagacgcugccugaagccggucauucugaaagacggcccugaacgggugauccucgccggacccaugcccguuaccguggccuccgcugcccagagacgcggccggauugggagaaaucagaacaaggagggagaucaauacgucuacaugggccagccucugaauaacgacgaggaucacgcgcauuggacagaagcuaaaaugcuucuggacaauaucaacacccccgaggggauuaucccugcccucuucgaaccggagcgcgaaaagucugccgcuaucgauggagaguauagacugcggggcgaggcccgcaagacauuuguggaacugaugagacggggggaccuccccgucuggcuuagcuacaaaguggcguccgagggcuuccaguauagcgaucgcagauggugcuuugacggagaacggaauaaccagguucuggaggaaaauauggauguggagauuuggaccaaggagggcgaaagaaaaaagcugcgcccucgguggcucgacgccagaacguacucugacccccuggcucuucgcgaguucaaagaauuugccgcugggcggagauccgugagcggagaucugauccucgagauuggcaagcugccucaacaccugacacuccgggcccagaacgcucuugacaaucuggucaugcugcacaacuccgaacaggggggaaaagccuaucgccaugcgauggaggagcuccccgauaccaucgaaacccugaugcuucuggcccucauugcuguucugacaggcggcgugacccuguucuuucucucugggaagggacuuggcaagacaagcaucgggcugcugugugugacggccuccucugcucuccuguggauggccagcgucgagccgcacuggaucgccgcuuccauuauccuugaauucuuucugauggugcuccugauuccugagcccgacagacagcggaccccucaagauaaucagcuggcguacguugugaucggacuccuuuucaugauucugacagucgccgcuaacgagaugggccugcucgaaaccacaaaaaaggaccuggggaucggacauguggccgccgagaaccaccagcacagcaccaugcuugaugucgaccugcaucccgcuucugccuggacgcucuaugcgguggccaccacaguuaucaccccuaugaugcgccacacaauugaaaauaccacggcuaacaucucccugacagccauugcuaaucaagccgcgauccugaugggccucgauaaaggcuggcccauuagcaagauggacaucggggugccgcuucuggcccugggaugcuacucucaggucaacccucucacccugacagcugccgugcuuaugcugguugcucauuacgccauuaucggccccgggcuccaggcuaaagccaccagagaggcgcagaagcggaccgccgcuggaaucaugaagaaucccacaguggauggcauugucgccaucgaccuggauccugugguguaugacgcuaaauuugaaaagcaacuggggcagauuaugcuccuuauccuguguacgucccagauucugcucaugcgcaccacaugggcccugugcgagagcaucacccuugccacaggaccgcugaccacgcucugggagggcucucccggcaaauucuggaacacaaccaucgcgguuagcauggcuaauauuuucagaggguccuaccuggccggagcuggccuggccuuuucucucaugaagagccuugggggaggccggcgcgggaccggagcccagggcgaaacacugggcgagaaauggaagagacaacugaaccagcucuccaagagcgaauucaauaccuauaaacgguccgggaucauggaggucgacagaucugaagcuaaggagggacugaaacgcggcgagacaacgaagcacgccgugagccgggggaccgcgaaacuuagaugguuuguggaacgcaaccuggucaagccugagggaaagguuauugaucucggcugugggcggggaggcugguccuacuauugcgccggccugaaaaaggugacagaagugaaaggguacaccaagggaggccccgggcaugaggaaccuauccccauggcuacauauggauggaaucuggucaaacuccacucuggcaaggacguguucuuuaugccuccggagaaaugugauacccuucugugcgacauuggggagagcucccccaacccuacgaucgaagagggaagaacccugcgcguucucaagaugguggaacccuggcugcggggcaaucaguucuguaucaagauucuuaacccuuacaugcccucugucguggagacacuggagcagaugcaaagaaaacacggcgggaugcucguucgcaauccgcugagccggaacuccacccaugaaauguacugggugagcugcggaacaggcaauaucgucucugccgugaacaugaccuccagaaugcugcucaaccgcuuuacaauggcucaccggaagccuaccuaugagagagauguggaccugggggccggaacgcgccaugucgcgguugaacccgagguggccaaucuugauauuaucggccagagaauugaaaacaucaaaaaugagcaccggagcacauggcacuacgacgaggauaaccccuauaagaccugggcuuaccaugggucuuaugaagugaaaccuuccggaagcgccucuuccauggucaauggcgugguucgccugcucaccaagcccugggacgugauuccuauggucacacagaucgcuaugacggauaccacaccguucggccaacagagaguguuuaaggagaaaguugacacccggacacccagagccaagcgggggaccacacagaucauggaagugaccgcuaaauggcuguggggauuccuuagccgcaacaagaaaccuagaauuuguacgcgggaggaauuuacccgcaaggucagauccaaugccgcgaucggcgccguguucguugacgagaaccaguggaauagcgcuaaggaggccguggaagaugagcgguuuugggaccugguccaccgcgaaagagagcuccauaaacaagggaagugcgcuacaugcguguacaacaugaugggaaaacgggaaaagaaacugggcgaguucgggaaggccaagggcucucgcgccauuugguauauguggcugggagcgagauuccucgaguuugaagcucugggcuucaugaaugaggaucacugguuuagccgggaaaacucccuuucuggggucgagggagagggccugcauaaacucggguacauccugcgcgacauuagcaagauccccggaggcaauauguacgccgaugacaccgccgggugggauacaagaaucaccgaagacgaucuucagaacgaggcuaaaauuacggacaucauggaaccugagcacgcccugcucgcuacauccauuuucaagcugaccuaucagaauaaagugguucgggugcagcgccccgccaagaacggcacagucauggaugugaucucuagacgggaccaaagaggaagcggccagguggggaccuacggacugaacacguuuaccaauauggaaguucagcucauucgccagauggaguccgagggcaucuuccugccgucugaacuugagacaccuaaccuggcggaacgggcccucgauuggcuggagaaacacggggcugaaagacuuaagcgcauggccaucagcggagacgacuguguggucaagcccauugaugaccgguuugcuaccgcccugacagcgcucaaugauaugggcaaagugagaaaggacaucccucaaugggagcccuccaaaggguggaacgauuggcagcagguuccuuucugcagccaucacuuucaucagcugauuaugaaggacggccgcgagaucgugguccccugucggaaucaagaugaacuggugggaagagcccgcgucucucagggcgcuggguggucccuccgggagaccgccugccugggaaaaagcuaugcucagauguggcaacuuauguacuuccacagacgcgaccugcggcucgccgcuaacgccauuuguucugcggugccgguugauugggugccugccuccagaacaaccuggagcauccacgcucaucaccaguggaugacgacagaagacaugcuguccgucuggaaucggguguggaucgaggaaaaccccuggauggaggauaagacccauguuucuagcugggaggaagugcccuaucuuggcaagagagaggaccaguggugcgggucccugauuggacucaccgcccgcgccacaugggcuaccaauauccaggucgccauuaaccaagugcggagacugaucggcaaugaaaacuaccuggacuauaugacaagcaugaaacgcuuuaagaaugagucugauccugagggggcgcucugguga

SEQ ID NO: 19409 - RNA, 9879 nt, Artificial Sequence
  derived and/or modified CDS sequence (opt5) from DENV-1__KC692513__SS-prME
agcgugaccaugcugcugaugcugcuucccacagcccuggcuuuccaccucacgaccagaggaggggagccucauaugaucguguccaagcaggaacggggaaaaucucugcuuuuuaagacaagcguuggcgugaacaugugcacccugauugccauggaccuuggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaggaacaagaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaccgcaagagaccuggaaucggcaggaucugcuggucacauucaagaccgcucacgcgaagaaacaggaagugguugugcucggaucccaagagggcgccaugcacaccgcucugacaggggccacggaaauucagaccucuggaacaaccacaaucuuugccggccaucuuaagugccgccugaaaauggacaagcucacccugaaagggaugagcuaugucauguguacgggcuccuucaagcuggagaaggaaguggcugagacacagcacggaaccguucuugugcaggucaaauacgagggcaccgaugccccuugcaagauucccuuccucacacaagacgaaaaaggggugacccagaacggaagacugaucacagcgaauccuaucgugacggauaaggagaaacccguuaacauugaaaccgagcccccuuuuggcgagagcuauaucgucgugggggcuggagaaaaggcccugaagcucucuugguucaaaaagggcuccagcauugggaaaauguuugaggccacagcucggggcgccagacgcauggcuauccugggagacaccgccugggauuucggcucuauugggggacuuuuuacaagcgugggcaagcugauccaucaggucuucgggaccgcguacggagugcucuuuuccggcguuucuuggacgaugaaaaucgggauuggcauccugcugaccuggcuuggacucaauagccgguccacaagccugucuaugaccuguauugccgugggcauggucacacuguaccucggggugaugguucaggcugacuccggaugcgugaucaacuggaagggcagagaacugaagugugggagcggaauuuucgucaccaacgaggugcacacauggaccgaacaauauaaauuucaggccgauucuccgaagcgccuuuccgcugccaucggcaaagcgugggaggaggggguuugcggcauucggagcgccacgagacuggaaaauaucauguggaagcagaucuccaacgagcucaauuacauucugcuggaaaacgacaugaaauucacaguggucgugggagacaucaauggcauucuugcucaggggaagaaaaugauccgcccccaaccuauggagcauaaguauucuuggaaaagcuggggaaaggccaagauuaucggcgcugauauccagaacaccaccuuuauuaucgacgggcccgauacaccugaaugucccgacgaucagcgggccuggaauauuugggagguggaggacuacggauucggcaucuuuaccacgaacauuuggcucaaacugagagauucccacacacagaugugcgaccaccgccugaugucugccgcuaucaaggauagcaaagcgguccaugccgacaugggcuauuggaucgaauccgagaagaaugaaaccuggaagcucgcucgggccagcuucauugagguuaaaacauguaucuggccgaagucucacacccugugguccaacggggugcuugaaagcgagauggugauuccuaaaaucuacggaggccccauuucucaacauaauuauagaccuggguacuucacacagaccgccggacccuggcaccugggcaagcucgagcuggauuuugaccugugcgaagggacgaccgucgugguugaugagcacugcggauaccgcggcccuucccuucggacaaccacagugaccggcaaaaucauccaugaaugguguugcagaagcuguacgcugcccccgcugcgguuccgcggggaggacggaugcugguauggcauggagauuagaccugucaaggaaaaggaggaaaaccuggugcggucuaugguuagcgcuggguccggagagguggacagcuuuucucucggcauccugugugucuccauucuuaucgaagaggugaugagaagccgcuggucccggaaaaugcugaugacagggacccucgccguuuuccugcugcuuauuaugggacagcugacauggaaugaucucaucagacugugcauuauggugggcgcgaacgcuucugaccgcaugggcauggggaccaccuaccucgcccugauggccacauuuaagaugagacccauguucgcugucggacuucuguuucggcgccucacgagcagagaggugcugcugcuuaccgugggccugucccucgucgccucuguugaacugcccaauagccucgaggaacugggggauggacuugcgaugggcaucaugaugcugaaacuccugacagacuuccaaccucaccagcuguggaccacacuucugucccucaccuuuauccggacgucucugagccucgauuaugcuuggaagacaauggccauggcccuguccauugugagccuuuucccgcugugucugucuaccaccucccagaaaacaaccuggcuccccgugcugcuugggagcuuuggaugcaagccucugacaauguuccucaucacggagaacaagauuuggggccgcaaaucuuggcccaucaacgaaggcauuauggcugucgggaucguguccauccugcucagcucucugcuuaagaaugacguuccucuggccggaccccugauugcuggcgggaugcucaucgccuguuacgugauuuccggaagcuccgcggaucugagccuugagaaagccgcugaggucucuugggaagaggaagccgagcauagcggcaccucccacaacauccugguggaaguucaggacgaugggacaaugaagauuaaagacgaggagagagaugacacccucacaauccugcucaaggcuacccugcuugccgugucuggagucuauccuaugagcauccccgccacgcuguuugugugguacuucuggcagaagaagaagcagcgguccggcguccugugggauaccccgucuccucccgaaguggagcgcgcuguucucgacgacggcauuuauagaauccugcagcgggggcuucugggacgcagccaggugggcgucgggguguuccaagauggaguuuuucauacaauguggcacgugaccagaggcgcgguccucauguaccaggggaaacggcuggaaccuuccugggccucugugaagaaagaccucauuagcuacggaggcggcuggagauuccagggguccuggaauacaggagaggaggugcagguuaucgcugucgaacccggcaagaacccgaaaaaugugcaaaccacaccugggacguuuaagacccccgagggagaagugggcgccauugcccuggauuucaagccugggacaagcggaucucccaucgucaaccgcgagggcaaaauugugggccuuuaugggaauggaguugugaccaccuccggcacauacgucagcgcuaucgcccaggcgaaggcuacgcaggaagggccccugccugagaucgaggacgaaguguuuaaaaagcggaaccugaccauuauggaucuccacccgggaucuggcaaaacaagacgcuaucugcccgccaucguucgggaggccauuaagagaaaacuucgcacccugauccucgcuccuacacggguggucgccuccgaaauggcggaggcucugaaagggaugcccauuagauaccaaaccacggccgucaagagcgaacauacaggccgcgagaucguugaccugaugugccacgccaccuucaccaugcggcuccuuuccccugugagaguccccaauuauaacaugaucauuauggaugaggcucauuuuacagacccugccucuaucgcugcccggggauacauuagcacccgcgugggcaugggggaagcggccgcuaucuucaugacagccaccccgcccggauccguggaggcuuuuccucagagcaaugccgucauucaggaugaagagagagacauccccgaacggucuuggaacuccggcuaugauuggaucacggacuucccugggaaaacaguuugguuugugcccagcauuaagucuggaaaugacaucgccaacugucugcgcaaaaauggcaagagagugauucagcugagccggaagaccuucgauacagaguaccagaagaccaagaacaacgacugggauuacgucgugacgaccgacaucuccgagaugggggcuaauuucagagcggaucgcguuauugacccgcggagaugccucaaaccugugauccugaaggaaggccccgagcgcgucauucuugccggacccaugccugugacaguugcuucugccgcccagcggagaggccgcaucgggcggaaccagaauaaagaaggagaucaguauaucuacaugggccaaccccugaacaaugacgaggaucacgcucauuggaccgaggccaagaugcuccuggacaacauuaauacaccugaagggaucauuccggcgcuguuugagcccgaaagagaaaagagcgcugccaucgauggagaauaucgccucagaggcgaggcccggaaaaccuucguggagcuuaugcgcagaggggaccugccugucuggcuguccuacaagguggcuucugaaggcuuucaguauagcgaucggcgcuggugcuucgacggagagagaaacaaucagguccucgaagagaacauggacguggaaauuuggacaaaagagggcgagcggaagaaacugagaccccgcuggcuugaugcccggaccuacuccgacccucuggcgcucagagaauuuaaggaguucgccgcugggcgccggagcguuucuggagaucugauccuggaaaucggcaaacucccccagcaccuuacgcugagagcccaaaaugcucuggacaaccucgugaugcugcacaauuccgagcaagggggaaaggccuaucggcaugcuauggaggaacuuccggauacaauugagacccugaugcuccuggcccugaucgcggugcucaccggcggcgucacacucuuuuuccugagcgggaagggacugggcaaaaccuccauugggcuccuguguguuauggccucuagcgcccuucucuggauggcuuccguggaaccucacuggaucgcugccucuauuauccucgaguuuuuccugauggugcugcucauccccgaaccugaccgccagagaacaccccaggauaaccaacuugccuacgucgugauuggacugcuguuuaugauccucacgguugcugcgaaugagaugggccugcuugagaccacaaagaaagaccuggggauuggacauguggccgucgaaaaccaccaccaugcuaccaugcucgauguggaccugcggccugccagcgccuggacacuguacgcugucgccaccacggugaucacccccaugaugcgccacacaauugagaacaccacagcgaauaucucccucaccgccauugcuaaccaggccgcuauccuuaugggccuggauaagggcuggccgaucagcaaaauggacauugggguuccucugcucgcccugggaugcuauucucaggugaauccccuuacgcugacagcggccguccucaugcugguggcucauuacgccaucauuggccccgggcugcaagcuaaggccaccagagaagcucagaagcggacagccgcgggaaucaugaaaaacccuaccguugauggcauugugaccaucgaccucgacccggucguguaugaugccaaguucgagaaacagcuugggcagaucaugcugcugauucucuguacaucccaaauccugcuuaugcgcacgaccugggcucugugcgaaagcauuacacucgccaccggaccccugacaacccugugggagggcucuccuggcaaguuuuggaauacgacaaucgcuguguccauggccaacauuuucagagggagcuaccucgccggagcgggccuugcuuucucucugaugaaaagccucgggggaggccggcgcgggaccggagcccagggcgagacccucggcgaaaaguggaagagacagcugaaucagcuuuccaaaucugaguuuaacacauauaagaaaagcgggaucauggaaguugaccgguccgaggcuaaggaaggacugaaaagaggcgagaccacaaagcacgccgucagccgcgggacggccaagcuccggugguucguggagagaaaucuggugaaacccgaaggaaaggucaucgaucugggcugugggcgcggaggcugguccuacuauugcgcuggccucaaaaagguuaccgaggugaaaggguacacaaagggaggcccugggcaugaggagcccauuccuauggccaccuacggauggaaccuugugaaacugcacucuggcaaggacgucuuuuucacaccgcccgaaaagugugauacccugcucugcgacaucggggagagcuccccuaaucccacgauugaggaaggacggacccugagagugcuuaaaaugguugagccuuggcugcgcggcaaccaauuuuguaucaagauucucaaucccuauaugccgucuguggucgaaacacuggagcagaugcagcggaaacacggcgggaugcuggugagaaacccucucagccgcaauuccacccaugagauguacuggguuucuugcggaacaggcaacaucgugagcgcggucaauaugaccucccggaugcugcuuaacagauucacaauggcccaccgcaagcccaccuaugaacgggauguggaccugggggcuggaacgagacauguggccgucgagcccgaaguugcuaaccucgauauuaucggccagcgcaucgagaauauuaaaaacgaacacaagagcacauggcacuacgacgaggauaauccuuauaagaccugggccuaccaugggucuuaugaggugaaacccuccggaagcgcgucuuccauggugaacggcgucgugagacugcuuaccaagccuugggacguuaucccgauggugacacaaauugccaugacggacaccacacccuuuggccagcagcgggucuucaaagaaaagguggauacccgcacaccuagagcuaaacgggggaccgcccaaaucauggagguuacagcuaaguggcuguggggauuucucagcagaaauaagaaaccccggauuuguacccgcgaagaguucacgagaaaggugcggucuaacgccgcuaucggcgccgucuuuguggacgaaaaucaguggaacuccgcgaaagaggccguugaggaugaacgcuucugggaccuggugcacagagagcgggaacugcauaagcaggggaaaugcgcuaccugcgucuacaauaugaugggaaagcgcgagaagaaacucggcgaauuugggaaggccaaaggcagcagagcuaucugguacauguggcugggagcccgguuccuugaguucgaggcccugggcuuuaugaacgaagaucacugguucucccgcgagaauagccucucugggguggaaggagagggccugcauaaacuuggguauauucugagagacaucagcaaaauuccuggaggcaacauguacgcggaugacacagcugggugggauacccggaucacagaggacgaucuccagaaugaagccaagauuaccgacaucauggagcccgaacacgcccugcuggcuacguccaucuuuaaacucacauaucaaaacaaggucgugcgcguucagagaccggccaagucuggcaccgugauggaugucauuagccggcgcgaccagagaggauccggccagguggggacauacggacugaauaccuucacgaacauggaggugcaacuuauccggcagauggaaucugagggcauuuuuagcccuuccgagcuggaaacccccaaccucgcuaaaaagguucuggacuggcuugagaaacacggggccgaaagacugaagcgcauggcgaucucuggagaugacuguguggucaaaccuauugaugaccgguucgccacagcucucaccgcccugaaugauaugggcaaggugagaaaggacaucccccagugggagccuagcaaaggguggaacgauuggcagcaaguucccuuuugcucccaucacuuccaucagcugaucaugaaggacggccgcgaaauuguggucccgugucggaaucaggaugagcucgugggcagagcucgcgucagccagggcgccggguggucucugcgggagacagcgugccuuggaaaauccuaugcccaaauguggcagcugauguacuuucacagacgcgaccuccggcuggcugccaacgcuaucuguagcgccgugccuguugauugggugcccaccucuagaacaaccugguccauucacgcucaucaccaguggaugacgacagaagacaugcuuagcgucuggaaucgcguguggaucgaggaaaaccccuggauggaggacaagacccauguuuccucuugggaagaggugccuuaucugggcaaacgggaggaucaauggugcgggagccucauuggacugaccgccagagcgacaugggccaccaauauccaggucgcuauuaaccaggugcggagacugaucggcuccgaaaauuaccucgacuacaugacaagcaugaagcgcuucaagaacgagucugauccggaaggggcccugugguga

SEQ ID NO: 19410 - RNA, 9879 nt, Artificial Sequence
  derived and/or modified CDS sequence (opt5) from DENV-1__KC692514__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuuuggcgggccuaucagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagauuauccaugagugguguugcagaagcuguacacugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugaccggaacacucgcuguguuccugcuucugaucaugggccagcucaccuggaacgaccugauucggcugugcaucauggucggcgccaaugccuccgaccgcauggggaugggaaccacauaccuugcucugauggccacguuuaagaugagaccuauguucgcggugggccuccuguuucggcgccucaccucuagagaagugcugcuucugacaauugggcucagccuggucgcuuccguugagcugcccaacucucuugaagagcugggagauggccucgccauggggaucaugaugcugaagcuccugaccgaauuccaaccccaccagcuuuggacaacccugcucagccugacguuugugaaaacaacccugucccuugacuaugccuggaagaccacagcuauggugcugagcauugucucucucuucccucugugucucuccaccacaagccagaaaacgaccuggcugccggugcuucugggaucuuuuggcugcaagccccugacaauguuccucaucaccgagaacaaaaucuggggccggaaguccuggccucugaaugaggggauuauggccaucggaauuguuagcauccuucugucuucccuccugaagaacgaugugccccucgcuggcccucugauugccgggggaaugcuuaucgcguguuacgucaucagcggcuccagcgccgaccugucucuggaaaaagcugccgaggugagcugggaacaggaggcugaacauuccggggccucucacaauauucucguugaggugcaagaugacggaacaaugaagaucaaagaugaggaacgcgacgauacccugacgauucuucugaaggccacccuccuggcugucagcggcguguaucccauguccaucccugcgacacucuucgucugguacuuuuggcagaaaaagaaacagagaucuggcgugcugugggacacccccagcccgccugagguugaacgggccgugcuugaugacgggauuuaucgcauccugcagagaggacugcucggccggucccaagucggggugggaguuuuccaggauggcguguuucauacaauguggcacgucaccagaggggcugugcugauguaccagggaaagcgccuugagcccucuugggccagcgugaagaaagaccugaucuccuauggcggcggguggcgguuccagggaagcuggaacacaggcgaggaaguucaagucauugccguggagccugggaagaaucccaaaaacgugcagacgaccccgggaacauuuaagaccccugaaggcgaggucggggcuaucgcccucgacuucaaacccggaaccucuggcuccccuauugugaauagagaaggcaagaucguugggcuguacggaaacggcguggucacaacgagcgggaccuacgugucugcgauugcucaggccaagacaucccaagagggaccccuccccgagaucgaagaugagguuuuuaaaaagcgcaaucugaccauuauggaccuucacccuggcagcgggaaaacacggagauaucugccggccaucgugcgcgaagcuaucaagcggaaacugagaacccucauucuggcccccacgcgcgucguggcguccgagauggcugaagcccuuaagggcaugccuauccgguaccagacaaccgccguuaagucugagcauaccggaagagagauuguggaucugaugugccacgcuacauucaccaugcggcuccugagccccguccgcgugccuaacuauaauaugaucauuauggacgaagcccauuuuacagaucccgcuuccaucgccgcgagaggcuacaucagcacccggguggggaugggagaggccgcugccauuuucaugacggcuacaccuccgggcucugucgaagccuuuccccaguccaacgccguuauccaggacgaggaacgcgauauuccugagagaagcuggaauucuggguaugacuggaucaccgauuuccccggaaaaacagugugguucgugccuagcauuaaguccggcaacgacaucgcuaauugucugcggaaaaacgggaagagagucauccaacucucucgcaaaaccuuugauacggaguaccagaagaccaagaacaaugacugggacuaugugguuacaaccgauauuagcgaaaugggcgcgaacuuccgggccgacagagugaucgauccccgccggugccuuaaaccggucauucugaaggacggaccugagagagugauccuggcuggccccaugcccguuacaguggccuccgccgcucagcgccgggggagaauuggacgcaaucagaacaaagaaggcgaucaauacgucuacauggggcagccucucaauaacgacgaggaucacgcccauuggaccgaggcgaagaugcugcuugacaauaucaacacacccgaaggaauuaucccugcucuguuugagccggaaagagagaaaucugccgccaucgauggcgaauaucggcuccgcggggaggcuagaaagaccuucguggagcugaugcggcgcggcgaccugcccgucuggcucagcuacaagguggccuccgaaggauuucaguauagcgauagacgguggugcuucgacggcgagagaaauaaccagguucuugaagagaauauggauguggaaauuuggacgaaagagggggagcgcaagaaacugcggccuagauggcuggacgcgcgcacauacucugacccccucgcccugcgggaauuuaaggaguucgcugccggaagacgguccgugagcggcgaucuuauccuggaaauugggaaacucccucaacaccugacccugcgcgcucagaacgcccucgacaaucuugucaugcugcacaacuccgagcagggaggcaaggcuuauagacaugccauggaagagcugcccgauaccaucgagacacucaugcugcuugcgcugauugccguucucaccggcggggugacacuguuuuuccugucuggaaaaggccucgggaagacgagcaucggacuucugugugugaccgcuuccucugcccugcucuggauggcuagcgucgaaccgcacuggaucgccgccuccauuauccuggaguuuuuccuuauggugcugcucauuccugaacccgaccggcagcgcacaccucaagauaaucagcuggcuuacguugugaucggccugcucuuuaugauucuuaccgucgcggccaacgagauggggcugcuggagacaaccaagaaagaccucggaaucggcuauguggcugccgaaaaccaucagcacgccacgaugcuggaugucgaccuucaccccgcuagcgccuggacccuguacgcgguggccacaaccguuaucacaccuaugaugagacauaccauugagaauacgacagcuaacaucucucucaccgccauugcuaaucaagccgcgauccugaugggccuggauaagggguggcccauuuccaaaauggacaucggagugccgcuccuugcccugggcugcuacagccaggucaacccucugacacucaccgcugccgugcugaugcuuguugcucacuaugccauuaucgggcccggacugcaggcuaaggccacccgggaagcgcagaaacgcacagccgcuggcaucaugaagaaucccacgguggaugggauugucgccaucgaccucgauccugugguguacgacgcuaaguucgagaaacaacugggacagauuaugcugcucauccuuuguaccucucagauucugcugaugagaacaaccugggcccucugcgaauccaucacacuggccaccggcccgcuuacgacacugugggagggcagccccgggaaguucuggaacaccaccaucgcgguuucuauggcuaauauuuuucggggaagcuaucucgccggcgcugggcuggccuucucccugaugaaaucucucggaggcgggcgcagaggaacaggcgcccagggcgagacccuuggggaaaaguggaaacggcaacugaaccagcugagcaaguccgaguuuaauacauacaagagaagcggaaucauggaagucgaccgcuccgaggcuaaagaaggccucaagcggggggagacgaccaaacaugccgugucuagaggaacagcgaagcugcgcugguucguggagcggaaccuugucaaaccugaaggcaagguuauugaucugggguguggaagaggcggcuggagcuauuacugcgccgggcucaagaaagugaccgaggugaagggauauacaaaaggcgggcccggacacgaagagccuauccccauggcuaccuacggcuggaaucuggucaagcugcauuccgggaaagacguguuuuucaugccuccggaaaagugugauacgcuccuuugcgacauuggagagucuagccccaacccuaccaucgaggaaggccgcacacugcggguucugaaaaugguggagcccuggcucagaggcaaucaguuuuguaucaagauucugaacccuuacaugcccuccgucguggaaacccuugagcagaugcaacgcaagcacgggggaaugcugguucggaauccgcucucuagaaacagcacacacgagauguauuggguguccugcggcaccgggaauaucgucagcgccgugaacaugacaucucgcaugcugcugaaccgguucaccauggcucauagaaaaccuacguacgaacgcgauguggaccucggagccggcacaagacacgucgcgguugagcccgaaguggccaaucuggauauuaucgggcagcggauugagaacaucaagaaugaacauaaauccaccuggcacuaugacgaggauaaccccuacaagaccugggcuuaucacggaagcuacgaggugaaaccuucuggcuccgccagcucuauggucaauggcgugguucgccuucugacaaagcccugggacgugauuccuauggucacgcagaucgcuaugaccgauacaaccccguuugggcaacagagaguguucaaggaaaaaguugacacacggacccccagagccaagcggggaacaacccagaucauggaggugacggcuaaauggcucuggggcuuucugucccgcaacaagaaaccuagaauuuguacccgggaagaguucacacgcaaggucagaagcaaugccgcgaucggggccguguuuguugacgaaaaccaguggaauuccgcuaaggaggccguggaggaugaacgguucugggaccuuguccaucgcgagagagaacugcacaaacaaggaaagugcgcuaccugcguguauaacaugaugggcaaacgggagaagaaacucggggaauucggcaaggccaagggaagccgcgccauuugguacauguggcugggcgcgagauuucuggaguucgaggcucucggguuuaugaaugaagaucauugguucucucgggagaacagccuguccggagucgaaggcgaggggcuucacaaacugggauacauccuccgcgacauuucuaagauccccggcgggaauauguaugccgaugacacagccggcugggauaccagaaucacggaggacgaucugcagaacgaagcuaaaauuacagacaucauggagccugaacaugcccuucuggcuaccagcauuuuuaagcucacauaccagaauaaagugguucgggugcagcgccccgccaagaacggaaccgucauggaugugaucuccagacgggaccaaagaggcucugggcaggugggaacguauggccugaacaccuucacaaauauggagguucagcugauucgccagauggaaagcgaggggaucuuucucccguccgagcuggaaaccccuaaccuugcggagcgggcccuggauuggcucgaaaaacacggagcugagagacugaagcgcauggccaucucuggcgacgacuguguggucaagcccauugaugaccgguucgcuacagcccuuaccgcgcugaaugauauggggaaagugagaaaggacaucccucaaugggaacccagcaaaggcuggaacgauuggcagcagguuccuuuuugcucccaccauuuccaccagcucauuaugaaggacggacgcgagaucgugguccccugucggaaucaagaugagcuggugggcagagcccgcgucagccagggggcuggauggucucugcgggaaacagccugccucggcaaauccuacgcucagauguggcaacugauguauuuucauagacgcgaccuucggcuggccgcuaacgccauuuguagcgcggugccgguugauugggugccugccucuagaaccacgugguccauccacgcucaccaucaguggaugacaaccgaggacaugcucagcgucuggaaucggguguggaucgaagagaaccccuggauggaagauaagacccacguuuccucuugggaggaggugcccuaccuggggaagagagaagaccaguggugcggaagccuuauuggccugacagcccgcgccaccugggcuacaaauauccaggucgccauuaaccaagugcggagacucaucgggaaugagaacuaucuggacuacaugacguccaugaaacgcuucaagaaugaaagcgauccugagggcgcgcugugguga

SEQ ID NO: 19411 - RNA, 9879 nt, Artificial Sequence
  derived and/or modified CDS sequence (opt5) from DENV-1__KC692515__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggacuuuguugagggacucuccggcgccacauggguggaugucgugcuggaacacgggagcugugugacgaccauggcuaagaauaaacccacacuggacaucgagcuccugaagaccgaagucacaaacccugccguucuucgcaaacugugcauugaggcgaagaucucuaauaccacgacagauuccagauguccgacccaaggagaagccacccucguggaggagcaggacgcuaacuucgugugccggcgcacauuugucgauagaggcuggggcaauggguguggacuguucggcaaagggagccuucugaccugcgccaaguuuaagugcgugacaaaacucgaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcugacagauuacggcgcccucacccuggacuguagcccccggacaggccuugacuucaacgagauggugcugcucaccaugaaggagaaaucuuggcugguccauaagcagugguuucuugaucugccucuccccuggacguccggggcuagcacaucccaagaaaccuggaaucgccaggaccugcuggugacauucaaaaccgcgcacgccaagaagcaggaggucgugguucucggaucucaagaaggcgcuaugcacaccgcccugacaggggccacggagauucagaccagcggaacaaccacaaucuuugcuggccaucuuaaaugcagacugaagauggauaaacucacccugaaggggauguccuaugugauguguacgggcagcuucaaacuggaaaaggaggucgccgagacacagcacggaaccgugcuuguucaggugaaguacgaaggcaccgacgcgccgugcaaaauuccuuucucuacacaagaugagaagggggucacccagaacggacggcucaucacagcuaaucccaucgugacggacaaagaaaagccugugaacauugagaccgagccccccuuuggcgaauccuauaucguugucggggccggaggcaaagcccugaagcugagcugguucaagagagggucuagcauuggcaaaauguuugaggcuacagcccgcggagcucggagaauggccauccucggcgauaccgcgugggacuucggguccauuggaggcguguuuacaucuguggggaagcugguccaucagguguucggaaccgccuacggcguucuuuuuagcgggguguccuggacgaugaaaaucggcaucggaauucugcucaccuggcugggccugaauagccgcucuacaucccuuagcaugaccuguaucgcugucgggauggugacacucuaccugggaguuauggugcaggccgauucuggcugcgucauuaacuggaaggggcgggaacugaaauguggauccggcaucuucgugaccaacgagguucacacauggaccgaacaauauaaguuucaggcugacagcccuaagagacucuccgccgcgauugggaaagccugggaggagggcgugugcggaauccgcucugcuacgcggcuggaaaauauuauguggaagcagaucagcaacgagcuuaaucauauccugcucgaaaacgauaugaaauucacagucguggugggcgacgccaaugggauucuggcucagggaaagaaaaugaucagaccgcaacccauggagcacaaguacuccuggaaaucuuggggcaaggccaagauuaucggggccgacauucagaacaccaccuuuaucaucgauggaccugacacacccgaauguccugauggccagcgcgcuuggaauauuugggaggucgaggacuauggcuucgggguuuuuaccacgaacaucuggcugaaacuucgggauagcuacacacagaugugcgaccacagacucauguccgcggccauuaaggauagcaaagcugugcaugccgacaugggauauuggaucgaaucugagaagaaugaaaccuggaaacuggcccgcgcuuccuucauugaggugaagacauguaccuggcccaagagccacacacuguggucuaacggcguccucgaauccgagaugaucaucccgaaaauuuucgggggaccuaucagccaacauaauuaccggcccggcuauuuuacccagacggccgggccuuggcaccugggaaagcuugagcuggauuucgaccucugcgaaggcaccacagugguuguggaugagcacugcggcaacagagggcccucucugcggaccacaaccgucacgggaaaaauuauccaugaaugguguugccgcagcuguacacugccuccccuuagauuucggggcgaggacgggugcugguacggaauggagauuagaccggugaaggaaaaagaggaaaaucucguucgcuccauggugagcgcgggcucuggggaggucgauuccuucagccugggaauccuguguguguccaucaugauugaagagguuaugcggucuagauggagccgcaagaugcucaugaccggcacacuggcuguguuucuucugcucaucaugggccagcugaccuggaacgaccugauuagacuuugcaucauggucggggccaaugccuccgaccggaugggaaugggcaccacauaccuggcucucauggccacguucaagaugcgcccuauguuugcgguggggcugcucuucagacggcugaccucucgcgaggugcuucugcucacaauuggacugagccuggucgcuuccguugaacuucccaacucucuggaggaacucggcgaugggcuggccaugggaaucaugaugcucaaacugcuuaccgaguuucaaccccaccagcuguggacaacccuccugagccugacguucgugaagacaacccuuucccuggacuaugccuggaaaaccacagcuauggugcucagcauugucucucuguuuccucucugucuguccaccacaagccagaagacgaccuggcuuccggugcugcugggcucuuucggcugcaaaccccucacaauguuucugaucaccgaaaacaagaucugggggagaaaguccuggccucuuaaugagggaauuauggccaucggcauuguuagcauccugcucucuucccugcucaaaaacgaugugccccuggcugggccucuuauugccggaggcaugcugaucgcguguuacgucaucagcggguccagcgccgaccugucucucgagaaggcugccgaagugagcugggagcaggaagcugagcauuccggagccucucacaauauucugguugaagugcaagaugacggcacaaugaaaaucaaggaugaggagcgggacgauacccuuacgauucugcucaaagccacccugcucgcugucagcggcguguaucccauguccaucccugcgacacuguucgucugguacuucuggcagaagaaaaagcagcgcucuggggugcuuugggacacccccagcccgccugaaguugagagagccgugcuggaugacggaauuuaucggauccugcagcgcggccuccuggggagaucccaagucggagugggcguuuuucaggaugggguguuccauacaauguggcacgucacccggggagcugugcuuauguaccagggcaagagacuggaacccucuugggccagcgugaaaaaggaccucaucuccuauggcgggggauggcgcuuucagggcagcuggaacacaggggaggagguucaagucauugccguggaaccuggaaaaaaucccaagaacgugcagacgaccccgggcacauucaaaaccccugagggggaagucggagcuaucgcccuggacuuuaagcccggcaccucuggcuccccuauugugaaucgggaggaaaagaucguugggcucuacggaaacggcguggucacaacgagcgggaccuacgugucugcgauugcucaggccaaagccucccaagagggaccccugcccgagaucgaagaugagguuuucaagaaaagaaaucuuacaauuauggaccugcacccuggcagcgggaagacccgccgguaucugccggcuaucgugagagaagccaucaaacgcaagcuccggacacugauucuugcgcccaccagagucguggcuuccgagauggccgaagcccugaagggcaugccuauccgcuaccagacgacagcuguuaaaucugagcauaccggacgggagauuguggaucucaugugccacgccaccuuuacaaugagacugcugagccccguccgggugccuaacuauaauaugaucauuauggacgaagcucauuucaccgaucccgccuccaucgcggcccgcggcuacaucagcacaagaguggggaugggagaggcugccgcuauuuuuaugaccgccacgccuccgggcucugucgaagccuucccccaguccaacgcuguuauccaggacgaggaacgggauauuccugagcgcagcuggaauucuggguaugacuggaucacagauuuucccggaaagaccgugugguucgugccuagcauuaaauccggcaacgacaucgcgaauugucucagaaagaacgggaaacgggucauccaacuuucuagaaagacauucgauaccgaguaccagaagacgaaaaacaaugacugggacuaugugguuaccacagauauuagcgaaaugggcgccaacuuucgcgcugaccgggugaucgaucccagacgcugccugaagccggucauucugaaagacggaccugagcgggugauccucgccggccccaugcccguuaccguggccuccgcugcccagagacgcgggcggauuggaagaaaucagaacaaggaaggcgaucaauacgucuacauggggcagccucugaauaacgacgaggaucacgcgcauuggacagaggcuaaaaugcuucuggacaauaucaacacccccgaaggaauuaucccugcccucuucgagccggaacgcgagaagucugccgcuaucgauggcgaauauagacugcggggggaggcccgcaagacauuuguggagcugaugagacggggcgaccuccccgucuggcuuagcuacaaaguggcguccgaaggauuccaguauagcgaucgcagauggugcuuugacggcgagcggaauaaccagguucuggaagagaauauggauguggaaauuuggaccaaggagggggagagaaaaaagcugcgcccucgguggcucgacgccagaacguacucugacccccuggcucuucgcgaauucaaagaguuugccgcuggacggagauccgugagcggcgaucugauccucgaaauugggaagcugccucaacaccugacacuccgggcccagaacgcucuugacaaucuggucaugcugcacaacuccgagcagggaggcaaagccuaucgccaugcgauggaagagcuccccgauaccaucgagacccugaugcuucuggcccucauugcuguucugacaggcggggugacccuguucuuucucucuggaaagggccuugggaagacaagcaucggacugcugugugugacggccuccucugcucuccuguggauggccagcgucgaaccgcacuggaucgccgcuuccauuauccuugaguucuuucugauggugcuccugauuccugaacccgacagacagcggaccccucaagauaaucagcuggcguacguugugaucggccuccuuuucaugauucugacagucgccgcuaacgagauggggcugcucgagaccacaaaaaaggaccugggaaucggccauguggccgccgaaaaccaccagcacagcaccaugcuugaugucgaccugcaucccgcuucugccuggacgcucuaugcgguggccaccacaguuaucaccccuaugaugcgccacacaauugagaauaccacggcuaacaucucccugacagccauugcuaaucaagccgcgauccugaugggccucgauaaaggguggcccauuagcaagauggacaucggagugccgcuucuggcccugggcugcuacucucaggucaacccucucacccugacagcugccgugcuuaugcugguugcucauuacgccauuaucgggcccggacuccaggcuaaagccaccagagaagcgcagaagcggaccgccgcuggcaucaugaagaaucccacaguggaugggauugucgccaucgaccuggauccugugguguaugacgcuaaauuugagaagcaacugggacagauuaugcuccuuauccuguguacgucccagauucugcucaugcgcaccacaugggcccugugcgaaagcaucacccuugccacaggcccgcugaccacgcucugggagggcucucccgggaaauucuggaacacaaccaucgcgguuagcauggcuaauauuuucagaggauccuaccuggccggcgcugggcuggccuuuucucucaugaagagccuuggaggcgggcggcgcggaaccggcgcccagggcgagacacugggggaaaaauggaagagacaacugaaccagcucuccaagagcgaguucaauaccuauaaacgguccggaaucauggaagucgacagaucugaggcuaaggaaggccugaaacgcggggagacaacgaagcacgccgugagccggggaaccgcgaaacuuagaugguuuguggagcgcaaccuggucaagccugaaggcaagguuauugaucucggguguggacggggcggcugguccuacuauugcgccgggcugaaaaaggugacagaggugaaaggauacaccaagggcgggcccggacaugaagagccuauccccauggcuacauauggcuggaaucuggucaaacuccacucugggaaggacguguucuuuaugccuccggaaaaaugugauacccuucugugcgacauuggagagagcucccccaacccuacgaucgaggaaggcagaacccugcgcguucucaagaugguggagcccuggcugcggggcaaucaguucuguaucaagauucuuaacccuuacaugcccucugucguggaaacacuggagcagaugcaaagaaaacacgggggaaugcucguucgcaauccgcugagccggaacuccacccaugagauguacugggugagcugcggcacagggaauaucgucucugccgugaacaugaccuccagaaugcugcucaaccgcuuuacaauggcucaccggaagccuaccuaugaaagagauguggaccugggagccggcacgcgccaugucgcgguugagcccgaaguggccaaucuugauauuaucgggcagagaauugagaacaucaaaaaugaacaccggagcacauggcacuacgacgaggauaaccccuauaagaccugggcuuaccauggaucuuaugaggugaaaccuuccggcagcgccucuuccauggucaauggcgugguucgccugcucaccaagcccugggacgugauuccuauggucacacagaucgcuaugacggauaccacaccguucgggcaacagagaguguuuaaggaaaaaguugacacccggacacccagagccaagcggggaaccacacagaucauggaggugaccgcuaaauggcuguggggcuuccuuagccgcaacaagaaaccuagaauuuguacgcgggaagaguuuacccgcaaggucagauccaaugccgcgaucggggccguguucguugacgaaaaccaguggaauagcgcuaaggaggccguggaggaugaacgguuuugggaccugguccaccgcgagagagaacuccauaaacaaggaaagugcgcuacaugcguguacaacaugaugggcaaacgggagaagaaacugggggaauucggcaaggccaagggaucucgcgccauuugguauauguggcugggcgcgagauuccucgaguuugaggcucugggguucaugaaugaagaucacugguuuagccgggagaacucccuuucuggagucgaaggcgaggggcugcauaaacucggauacauccugcgcgacauuagcaagauccccggcgggaauauguacgccgaugacaccgccggcugggauacaagaaucaccgaggacgaucuucagaacgaagcuaaaauuacggacaucauggagccugaacacgcccugcucgcuacauccauuuucaagcugaccuaucagaauaaagugguucgggugcagcgccccgccaagaacggaacagucauggaugugaucucuagacgggaccaaagaggcagcgggcaggugggaaccuacggccugaacacguuuaccaauauggagguucagcucauucgccagauggaauccgaggggaucuuccugccgucugagcuugaaacaccuaaccuggcggagcgggcccucgauuggcuggaaaaacacggagcugagagacuuaagcgcauggccaucagcggcgacgacuguguggucaagcccauugaugaccgguuugcuaccgcccugacagcgcucaaugauauggggaaagugagaaaggacaucccucaaugggaacccuccaaaggcuggaacgauuggcagcagguuccuuucugcagccaucacuuucaucagcugauuaugaaggacggacgcgagaucgugguccccugucggaaucaagaugagcuggugggcagagcccgcgucucucagggggcuggauggucccuccgggaaaccgccugccugggcaaaagcuaugcucagauguggcaacuuauguacuuccacagacgcgaccugcggcucgccgcuaacgccauuuguucugcggugccgguugauugggugccugccuccagaacaaccuggagcauccacgcucaucaccaguggaugacgacagaggacaugcuguccgucuggaaucggguguggaucgaagagaaccccuggauggaagauaagacccauguuucuagcugggaggaggugcccuaucuugggaagagagaagaccaguggugcggaucccugauuggccucaccgcccgcgccacaugggcuaccaauauccaggucgccauuaaccaagugcggagacugaucgggaaugagaacuaccuggacuauaugacaagcaugaaacgcuuuaagaaugaaucugauccugagggcgcgcucugguga

SEQ ID NO: 19412 - RNA, 9879 nt, Artificial Sequence
  derived and/or modified CDS sequence (opt5) from DENV-1__KC692516__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcaucuucaccacgaacauuuggcugaaacugcgggauagcuacacacagaugugcgaccacagacuuauguccgcggccaucaaggauagcaaagcuguucaugccgacaugggguauuggauugagucugaaaagaaugagaccuggaaacucgcccgcgcuuccuucaucgaagugaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgaccugugcgagggaaccacagucgugguugaugaacacugcggcaacagaggccccucucuccggaccacaaccgugacggggaaaaucauucaugagugguguugccgcagcuguacacugccuccccugagauuucggggagaggacggcugcugguacgggauggaaaucagaccggucaaggagaaagaagagaaucuugugcgcuccaugguuagcgcgggaucuggcgaaguggauaacuucucccucgggauccugugugucagcauuaugaucgaggaggugaugcgguccagauggucucgcaagaugcugaugaccggaacacucgcuguuuuucugcuucugauuaugggccagcucaccuggaaugaccugaucagacugugcauuauggugggcgccaacgccagcgaccggauggggaugggaaccacauaucuugcucugauggccacguucaagaugcgcccuauguuugcggucggccuccuguucagacggcucaccucccgcgaagugcugcuucugacaaucgggcucucucugguggcuagccuggagcuucccaacucccuggaagagcucggagauggccuggccauggggauuaugaugcucaaacugcuuaccgaauuucaaccccaccagcuguggacaacccuccugucucugacguucgucaagacaacccuuagccuggacuacgccuggaaaaccacagcuaugguucucuccaucgugagccuguuuccucucugucugucuaccacaucccagaagacgaccuggcuuccggugcugcugggaagcuucggcugcaaaccccucacaauguuucugaucaccgagaauaagauuuggggcagaaagucuuggccucuuaacgaggggaucauggccauuggaaucgucuccauucugcucagcucucugcucaaaaaugaugugccccuggcuggcccucuuaucgccgggggaaugcugaucgcguguuauguuauuuccggcagcuccgccgaccugagccucgaaaaggcugccgaggugucuugggaacaggaggcugaacauagcggggccucccacaacauccuggucgaggugcaagaugacggaacaaugaaaauuaaggaugaggaacgggacgauacccuuacgauccugcucaaagccacccugcucgcuguuucuggcguguaccccaugagcauuccugcgacacuguucgucugguauuucuggcagaagaaaaagcagcgcuccggcgugcuuugggacacccccucuccgccugaggucgaaagagccgugcuggaugacgggaucuaccggauccugcagcgcggacuccugggcagaagccaaguuggggugggagucuuucaggauggcguguuccauacaauguggcacguuacccggggggcugugcuuauguaucagggaaagagacuggagcccuccugggccugcgucaaaaaggaccucauuucuuacggcggcggguggcgcuuucagggacuguggaauacaggcgaggaagugcaagugaucgccguugagccugggaaaaaccccaagaauguccagacgaccccgggaacauucaaaaccccugaaggcgaggugggggcuauugcccucgacuuuaagcccggaaccagcggcuccccuaucgugaaccgggaaggcaagauugucgggcuguacggaaauggcgugguuacaacgagcgggaccuaugugucugcgaucgcucaggccaaagccucccaagagggaccccuucccgagauugaagaugaggucuucaagaaaagaaaccugacaaucauggaccugcacccuggcagcgggaagacccgccgguaccucccggcuaucgugagagaagccauuaaacgcaagcugcggacacuuauccuggcgcccaccagaguuguggcuucugagauggccgaagcccucaagggcaugccuauucgcuaucagacgacagcugucaaauccgagcauaccggacgggagaucguggaucugaugugucacgccaccuuuacaaugagacugcucagccccguucgggugccuaauuacaacaugauuaucauggacgaagcucauuucaccgaucccgccuccaucgcggcccgcggcuauauuucuacaagagucgggaugggagaggcugccgcuaucuuuaugaccgccacgccuccgggcagcguggaagccuucccccaguccaaugcugugauucaggacgaggaacgggauaucccugagcgcagcuggaacucuggguacgacuggauuacagauuuucccggaaagaccgucugguucguuccuuccaucaaaagcggcaaugacaucgcgaacugccuuagaaagaacgggaaacgggugauucaacugucuagaaagacauucgauaccgaguaucagaagacgaaaaauaacgacugggacuacguggucaccacagauaucagcgaaaugggcgccaauuuucgcgcugaccgggugauugaucccagacgcugccugaagccgguuauccucaaagacggaccugagcgggugauucuggccggccccaugcccgucaccguggccuccgcugcccagagacgcgggcggaucggaagaaaccagaauaaggaaggcgaucaauacguuuauauggggcagccucuuaacaaugacgaggaucacgcgcauuggacagaggcuaaaaugcugcucgacaacauuaauacccccgaaggaaucaucccugcccuguucgagccggaacgcgagaagucugccgcuauugauggcgaauacagacugcggggggaggcccgcaagacauuuguggagcucaugagacggggcgaccuucccgucuggcugagcuauaaaguggcguccgaaggauuccaguacucugaucgcagaugguguuuugacggcgagcggaacaaucagguccuggaagagaacauggauguggaaaucuggaccaaggagggggagagaaaaaagcuccgcccucgguggcuggacgccagaacguauagcgacccccuugcucugcgcgaauucaaagaguuugccgcuggacggagauccguuagcggcgaucucauucuggaaaucgggaagcugccucaacaccucacacuucgggcccagaaugcucuggacaaccuggugaugcuccacaauucugagcagggaggcaaagccuaccgccaugcgauggaagagcugcccgauaccauugagacccuuaugcugcucgcccugaucgcugugcugacaggcggggucacccucuucuuucuuuccggaaagggccuggggaagacaagcaucggacugcucugcguuacggccuccucugcucugcuuuggauggccagcguggaaccgcacuggauugccgcuuccaucauucuggaguucuuucucauggugcugcugaucccugaacccgacagacagcggaccccucaagauaaccagcucgcguaugucgugauuggccuucuguucaugauccugacaguugccgcuaacgagauggggcuccuggagaccacaaaaaaggaccuuggaaucggccauguggccgccgaaaaucaccagcacgcuaccaugcuggaugucgaccuccaucccgccucugcguggacgcuguacgccguggcuaccacagucauuaccccuaugaugcgccacacaaucgagaacaccacggccaauauuagccugacagcuaucgccaaccaagcggccauucucaugggccuugauaaaggguggcccaucuccaagauggacauuggagugccgcugcuggcucucggcuguuacagccagguuaauccucugacccuuacagccgcugugcugaugcucgucgcccauuaugcuaucaucgggcccggacugcaggccaaagcgaccagagaagcccagaagcggaccgcugccggcauuaugaagaaccccacaguggaugggaucguugcuauugaccuggauccuguggucuacgacgccaaauuugagaagcaacucggacagaucaugcuucugauucugugcacgucucagauccuccugaugcgcaccacaugggcccuuugugaauccaucacccuggcgacaggcccgcucaccacgcugugggagggcagccccgggaaauucuggaauacaaccauugcugugucuauggccaacaucuucagaggauccuaucuggcuggcgccgggcucgccuuuagccuuaugaagucucugggaggcgggcggcgcggaaccggcgcucagggcgagacacugggggaaaaauggaagagacaacucaaucagcugagcaaguccgaguucaacaccuacaaacggucuggaauuauggaaguggacagaagcgaggccaaggaaggccuuaaacgcggggagacaacgaagcacgcgguuucccggggaaccgccaaacugagaugguuugucgagcgcaaucucgugaagccugaaggcaaggugaucgaucuggggugcggacggggcggcuggagcuauuacugugcugggcugaaaaaggucacagagguuaaaggauauaccaagggcgggcccggacaugaagagccuauucccauggccacauacggcuggaaccucgugaaacuucacuccgggaaggacguguucuuuaugccuccggaaaaaugcgauacccugcugugugacaucggagagucuagccccaauccuacgaucgaggaaggcagaacccuccgcguccugaagaugguggagcccuggcuucggggcaaccaguucugcauuaagauccugaauccuuacaugcccuccguuguggaaacacucgagcagaugcaaagaaaacacgggggaaugcugguccgcaacccgcugucucggaauagcacccaugagauguauuggguguccagaggcacagggaacauuguuucugcugugaacaugaccagccgcaugcuccugaaucgguuuacaauggcccacagaaagccuaccuacgaacgcgaugucgaccuuggagcgggcacgagacauguggccguggagcccgaagucgcuaaccuggauaucauugggcagcggaucgagaauauuaaaaacgaacacaaguccacauggcacuaugacgaggauaaucccuacaaaaccugggccuaucauggaagcuacgagguuaagccuucuggcuccgcuagcucuauggugaacggcgugguccgccuccugaccaagcccugggacgugaucccuaugguuacacagaucgccaugacggauaccacaccguucgggcaacagagaguguuuaaagaaaaggucgacacccggacacccagagcuaaacggggaaccacacagauuauggaggugaccgccaaguggcuuuggggcuuccugucccgcaauaaaaagccuagaaucuguacgcgggaagaguuuacccgcaagguuagaagcaacgcggccauuggggcuguguucgucgacgaaaaacaguggaauucugccaaggaggcuguggaggaugaacgguuuugggaccucguucaccgcgagagagaacugcauaaacaaggaaagugcgccacaugcguguauaacaugaugggcaaacgggagaagaagcugggggaauucggcaaagccaagggaucccgcgcgaucugguacauguggcucggcgcuagauuccuggaguuugaggcccuuggguucaugaaugaagaucacugguuuagccgggagaacucccugagcggagucgaaggcgaggggcuccauaaacugggauacauucuucgcgacaucucuaagauccccggcgggaauauguaugccgaugacaccgcuggcugggauacaagaauuaccgaggacgaucugcagaacgaagccaaaaucacggacauuauggagccugaacacgcucuccuggccacaagcaucuucaagcugaccuaccagaauaaagugguccgggugcagcgccccgcgaagaacggaacaguuauggaugugauuuccagacgggaccaaagaggcucugggcaggucggaaccuauggccucaacacguuuaccaauauggaggugcagcugauccgccagauggaaagcgaggggaucuuccuuccguccgagcuggaaacaccuaaccucgccgagcgggugcuggauuggcuugaaaagcacggagcugagagacugaaacgcauggccauuucuggcgacgacuguguugugaagcccaucgaugaccgguuugcuaccgcccucacagcgcugaaugauauggggaaagucagaaaggacauuccucaaugggaacccagcaaaggcuggaacgauuggcagcaggugccuuucugcucccaucacuuucaucagcugaucaugaaggacggacgcgagauuguugugcccugucggaaucaagaugagcucgucggcagagcccgcgugucucagggggcuggauggagccugcgggaaaccgccugccuuggcaaguccuacgcucagauguggcaacugauguauuuccacagacgcgaccuccggcuggccgcuaacgccaucuguagcgcggucccgguggauuggguuccuacaucuagaaccacgugguccauccacgcccaucaccaguggaugacaaccgaggacaugcuuagcguguggaaucgggucuggauugaagagaaccccuggauggaagauaaaacccaugugucuuccugggaggagguucccuaccuggggaagagagaagaccaguggugcggaagccucaucggccugacagcucgcgccaccugggccacaaauauucagguggcuaucaaccaaguccggagacugauugggaaugagaacuaucucgacuacaugacguccaugaaacgcuuuaagaaugaaucugauccugagggcgcccugugguga

SEQ ID NO: 19413 - RNA, 9879 nt, Artificial Sequence
  derived and/or modified CDS sequence (opt5) from DENV-1__KC692517__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaucgaacacggaaccauugcuacaaucaccccccaggccccuacguccgagauucagcugaccgacuacggcgcccucacacuggacuguagcccccggaccggccuugauuucaacgaaauggugcugcucacaaugaaggagaaaucuuggcugguccauaagcagugguuucuugaccugccucuccccuggaccuccggggcuagcacgccgcaagagacauggaaucgccaggaucugcuggugaccuucaaaacagcgcacgccaagaagcaggaagucgugguucucggaucccaagagggcgcuaugcacaccgcccugaccggggccacagaaauccagacgucuggaaccacaaccauuuuugcuggccaucuuaaaugcagacugaagauggacaaacucacacugaaggggaugagcuaugugauguguaccggcuccuucaaacuggagaaggaagucgccgagacgcagcacggaacagugcuuguucaggugaaguacgagggcaccgaugcgccuugcaaaauccccuucagcacccaagacgaaaagggggucacacagaacggacggcucaucaccgcuaauccuauugugacagauaaagagaagucugugaacaucgaaacggagccccccuuuggcgaguccuauauuguugucggggugggagaaaaagcccugaagcugagcugguucaagaaaggcucuagcaucgggaagauguuugaggccaccgcuagaggcgcccgccggauggcuauucucggagacacagccugggauuucggcuccaucgggggaguguuuaccucugucggcaaacuggugcaucagguuuucgggacagcguacggagugcuuuuuagcggcgucuccuggaccaugaagaucgggauuggcauccugcucacguggcugggacugaauagcagaucuaccucccuuagcaugacauguauugccgugggcaugguuacccucuaccugggggugaugguccaggcugacucuggaugcgugaucaacuggaaaggccgcgaacugaaguguggguccggaauuuucguuacaaacgaggugcacaccuggacagaacaauauaaguuucaggccgauagcccuaaacggcucuccgcugccaucggcaaggcgugggaggagggggucugcggcauuagaucugccacccgccuggaaaauaucauguggaaacagaucagcaacgagcuuaaucauauucugcucgaaaacgacaugaaguucacggugguggucggagacgcuaauggcauccuggcccaggggaaaaagaugauucggccgcaacccauggagcacaaauacuccuggaagucuuggggaaaggcuaaaaucauuggcgccgauauccagaacacaaccuuuaucauugacgggccugauacccccgaauguccugacggacagagagccuggaauaucugggagguugaggauuauggcuucggcauuuuuacaaccaacaucuggcugaagcuucgcgacagcuacacgcagaugugcgaucaccggcucauguccgcugcgauuaaagacagcaaggccgugcaugcugauaugggguauuggaucgaaucugagaaaaaugaaacauggaagcuggccagagccuccuucaucgaggugaagaccuguacauggcccaaaagccacacccuguggucuaacggaguccucgaauccgagaugauuaucccgaagauuuacggcgggccuaucagccaacauaauuaucgccccggauacuucacacagaccgcuggcccuuggcaccuggggaaacuugagcuggacuuugaucucugcgaaggaacgaccgugguuguggacgagcacugcggcaaccggggccccucucugagaacaaccacagucaccgggaagauuauccaugaaugguguugccggagcuguacgcugccuccccuucgcuucagaggagaggauggcugcugguacgggauggagauccggccggugaaagaaaaggaggaaaaucucguuagauccauggugagcgccggaucuggcgaggucgacuccuuuagccuggggauucuguguguguccaucaugauugaagagguuaugcgcucucgguggagcagaaagaugcucaugacaggaacccuggcgguguuccuucugcucaucaugggccagcugacauggaacgaccugauucgccuuugcaucauggucggcgcuaaugccuccgauagaauggggaugggaaccaccuaucuggcccucauggcuacauuuaaaaugcggccuauguucgccgugggccugcucuuucgcagacugacgucucgggaggugcuucugcucaccauugggcugagccuggucgcguccguugaacuucccaacucucuggaggaacucggagacggccuggcuauggggaucaugaugcucaagcugcuuacagaguuccaaccccaccagcuguggaccacacuccugagccugaccuuugugaaaacgacacuuucccuggauuacgccuggaagaccaccgccauggugcucagcaucgucucucuguucccucucugucuguccacaaccagccagaaaacaacguggcuuccggugcugcugggaucuuuuggcugcaacccccucaccauguuccugauuacagaaaauaagaucuggggccgcaaguccuggccucuuaacgaggggauuauggcuaucggaauuguuagcauccugcucucuucccugcucaaaaaugacgugccccuggccggcccucuuaucgcugggggaaugcugauugccuguuaugucaucagcggcuccagcgcggaucugucucucgagaaggccgcugaagugagcugggagcaggaagccgagcauuccggggcuucucacaacauucugguugaagugcaagacgauggaaccaugaaaaucaaggacgaggagagagaugacacacuuaccauucugcucaaagccacgcugcucgccgucagcggcguguaccccauguccaucccugcuacccuguuugucugguauuucuggcagaagaaaaagcagcggucuggcgugcuuugggauacacccagcccgccuaagguugaacgcgcggugcuggacgaugggaucuacagaauucugcagcggggacuccugggccgcucccaagucggggugggaguuuuccaggacggcguguuucauaccauguggcacgucacaagaggggccgugcuuauguaucagggaaaacggcuggagcccucuugggcuagcgugaagaaagaccucaucuccuacggcggcggguggagauuccagggaagcuggaauaccggcgaagagguucaagucauugccguggagccugggaagaaccccaaaaaugugcagacaacgccgggaaccuuuaagacaccugaaggcgaggucggggccaucgcucuggauuucaagcccggaaccucuggcuccccuauugugaaccgcgaaggcaaaaucguugggcucuacggaaauggcguggucaccacaagcgggacguaugugucugccauugcgcaggcuaaggccucccaagagggaccccugcccgaaaucgaggacgagguuuuuaaaaagcggaaccuuaccaucauggaucugcacccuggcagcgggaaaacaagacgcuaccugccggccauugugcgggaagcuaucaagagaaagcuccgcacccugauucuugcccccacacgggucguggcguccgagauggcugaagcccugaaaggcaugccuaucagauaucagaccacggccguuaagucugagcauacaggacgcgaaauuguggaccucaugugccacgcuaccuucaccaugcggcugcugagccccgucagagugccuaauuacaacaugaucaucauggaugaggcccauuuuacagaccccgcuuccauugccgcgcggggcuauaucagcacccgcguggggaugggagaggccgcugccauuuucaugacagcuaccccuccgggcucugucgaagccuuuccccaguccaaugccguuauccaggaugaggaaagagacauuccugagcggagcuggaacucuggguacgauuggaucacggacuuccccggaaaaacagugugguuugugccuagcaucaaguccggcaaugauauugcuaacugucuccgcaaaaacgggaagagagucauccaacuuucucggaagaccuucgacacagaauaucagaaaaccaagaauaacgacugggauuacgugguuacgaccgacauuagcgagaugggcgcgaauuucagagccgaucgcgugaucgacccccggagaugccugaaaccggucauucugaaggauggaccugagcgcgugauccucgcuggccccaugcccguuacaguggccuccgccgcucagcggagagggcgcauuggacggaaccagaauaaagaaggcgaccaauacgucuauauggggcagccucugaacaaugaugaggaccacgcccauuggaccgaagcgaagaugcuucuggauaacaucaauacacccgagggaaucauuccugcucucuuugagccggaaagagagaagucugccgccaucgacggcgaauaccgccugagaggggaggcucggaaaaccuucguggaacugaugcgcagaggcgaucuccccgucuggcuuagcuauaagguggccuccgagggauuucaguacagcgaccggcgcuggugcuucgauggcgagagaaacaaucagguucuggaagagaacauggacguggaaauuuggacaaaagagggggaacggaagaaacugagaccucgcuggcucgacgcgcggaccuauucugauccccuggcccuuagagaguuuaaggaguucgcugccggacgccgguccgugagcggcgaccugauccucgaaauugggaaacugccucaacaccugacgcucagagcucagaaugcccuugauaaccuggucaugcugcacaauuccgagcagggaggcaaggcuuaccggcaugccauggaagagcuccccgacacaaucgaaacccugaugcuucuggcgcucaucgccguucugaccggcggggugacacuguuuuuccucucuggaaagggccuugggaaaaccagcauuggacugcugugugugacagcuuccucugcccuccuguggauggcuagcgucgagccgcacuggaucgccgccuccauuauccuugaguuuuuccugauggugcuccugauuccugaacccgaucgccagagaacgccucaagacaaccagcuggcuuauguugugaucggccuccuuuuuaugauccugaccgucgcggccaacgagauggggcugcucgaaacaaccaagaaagaucugggaauuggcuacguggcugccgagaaucaucagcacgccacaaugcuugacgucgaucugcggcccgcuagcgccuggacccucuacgcgguggccacgaccguuaucacaccuaugaugcgccacaccauugagaacacaaccgcuaauaucucucugacggccauugcuaaccaagccgcgauccugaugggccucgacaagggguggcccauuuccaaaauggauaucggagugccgcuucuggcccugggcugcuauagccaggucaauccucucacacugaccgcugccgugcuuaugcugguugcucauuacgccaucauugggcccggacuccaggcuaaggccacaagagaagcgcagaagcggaccgccgcuggcaucaugaaaaaccccaccguggacgggauugucgccaucgaucuggacccugugguguaugacgcuaaguucgagaaacaacugggacagauuaugcuccuuauccuguguacaucucagauccugcucaugcgcacgaccugggcccugugcgaauccauuacacuugccaccggcccgcugacaacccucugggagggcagccccgggaaguuuuggaauacgacaaucgcgguuucuauggcuaacauuuucagaggaagcuaccuggccggcgcugggcuggccuucucccucaugaaaucucuuggaggcgggcggcgcggaaccggcgcccagggcgaaacccugggggagaaguggaagagacaacugaaucagcucagcaaauccgaguuuaacacauauaagcggagcggaaucauggaagucgauagauccgaggcuaaagaaggccugaagcgcggggagaccacaaaacacgccgugucucggggaacggcgaagcuuagaugguucguggaacgcaaucuggucaagccugagggcaaaguuauugaccucggguguggacggggcggcuggagcuacuauugcgccgggcugaagaaagugaccgaggugaagggauacacaaaaggcgggcccggacaugaagagccuauccccauggcuaccuacggcuggaaccuggucaagcuccacuccgggaaagauguguuuuucaugccuccggaaaagugugacacacuucugugcgauaucggagagucuagccccaauccuaccauugaagagggcagaacgcugcgcguucucaagaugguggagcccuggcugcggggcaaccaguuuuguaucaaaauucuuaauccuuauaugcccuccgucguggaaacccuggagcagaugcaaagaaagcaugggggaaugcucguucgcaacccgcugucucggaauagcacacacgaaauguacuggguguccugcggcaccgggaacaucgucagcgccgugaacaugacaucuagaaugcugcucaaucgcuucaccauggcucaccggaaaccuacauaugagagagacguggaucugggagccggcacccgccaugucgcgguugagcccgaaguggccaaccuugacauuaucgggcagagaauugagaauaucaagaacgaacacaaauccacguggcauuacgaugaggacaaucccuauaagacaugggcuuaccacggaagcuaugaagugaagccuucuggcuccgccagcucuauggucaacggcgugguucggcugcucaccaaacccugggaugugaucccuauggucacccagauugcuaugacagacacgaccccguuugggcaacagcgcguguucaaggagaaaguugacacaagaaccccccgggccaagagaggaacaacccagaucauggaggugacagcuaaauggcuguggggcuuucuuucccggaauaagaagccucgcauuuguaccagagaagaguucacgcggaaaguccgcagcaacgccgcgaucggggccguguuuguugaugaaaaucaguggaacuccgcuaaggaggccguggaagacgagagauucugggaucugguccaccgggagcgcgaacuccauaaacaaggaaagugcgcuaccugcguguacaauaugaugggcaaaagagagaagaagcugggggaauuuggcaaagccaagggaagccgggccauuugguacauguggcugggcgcgcgcuuccucgaguucgaagcucugggguuuaugaacgaggaccacugguucucuagagagaauagccuuuccggagucgaaggcgaggggcugcauaaacucggauauauccugcgggauaucucuaagauucccggcgggaacauguacgccgacgauacagccggcugggacacccgcaucacagaagaugaccuucagaaugaggcuaaaauuaccgauaucauggagccugaacacgcccugcucgcuacgagcauuuuuaagcugacauaucagaacaaagugguuagagugcagcggcccgccaagaacggaaccgucauggacgugaucucccgcagagaucaacggggcucugggcaggugggaacauacggccugaauaccuucacgaacauggagguucagcucgugagacagauggaaagcgaggggaucuuucugccguccgaacuugagaccccuaaucuggcggagcgcguccucgacuggcuggaaaagcauggaguggagcggcuuaaaagaauggccauuucuggcgacgauuguguugugaagcccaucgacgaucgcuucgcuacagcccugaccgcucucaacgacauggggaaaguccggaaggauauuccucaaugggaacccagcaaaggcuggaaugacuggcagcaggugccuuuuugcucccaccacuuccaucagcugaucaugaaggauggaagagagauugucgugcccugucgcaaccaagacgaacugguuggccgggccagagugagccagggggcgggauggucucuccgcgagacagccugccugggcaaguccuaugcucagauguggcaacuuauguacuuucaccggagagaucugcgccucgccgcuaaugccaucuguagcgcugucccgguggacuggguuccuaccucucggacaaccugguccauccaugcccaccaccaguggaugacgacagaggauaugcugagcguguggaacagagucuggauugaagagaaucccuggauggaagacaaaacccauguguccucuugggaggaagugcccuaucuugggaagcgggaggaccaguggugcggaagccugaucggccucaccgcgagagccacaugggcuaccaacauucagguugccaucaaucaaguccgccggcugauugggaacgagaauuaccuggauuacaugacauccaugaaaagauucaagaacgaaagcgacccugagggcgcccucugguga

SEQ ID NO: 19414 - RNA, 9879 nt, Artificial Sequence
  derived and/or modified CDS sequence (opt5) from DENV-1__KC762649__SS-prME
agcgugaccaugcugcucaugcugaugcccaccgcccuugcuuuccaccugacgacccggggaggggaaccucauaugaucguguccaagcaggaacggggaaaaucucuccuguuuaagacaagcgccggcguuaacaugugcacccuuauugcgauggaccugggggaacucugugaagauacacugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauuggggcuucuaucacacagaagggaaucauuuucauccugcuuaugcuggucaccccuagcauggccaugagaugcgugggcauugggucccgggauuuuguugagggacucagcggcgcuaccuggguggacgucgugcuggagcacgggucuugugugacaacgauggccaaggauaaacccacccuggacaucgaacuccugaagacagaggucaccaacccugcgguucuucgcaaacugugcauugaagccaagaucuccaauacaaccacggauagcagauguccgacacaaggagaggcuacccucguggaagaacaggacgccaacuucgugugccggcgcaccuuugucgauagaggcuggggcaauggguguggacuguucggcaaagggucucuuauuacaugcgcuaaguuuaagugcguguccaaacuggagggaaagaucguucaguacgaaaaccucaaauauagcgugaucgucaccgugcacacaggcgaccagcaucaaguugggaaugagucuacggaacacggaaccacagccaccauuacaccccaggccccuaccacggagauccagcugaccgacuacggcgcucugacacucgauuguagcccccggaccggccuggacuucaacgaaauggugcuucugacaaugaaggagaaaagcuggcucguccauaagcagugguuucuggaucuuccucugcccuggaccuccggggcgucuacgagccaagagacauggaaucgccaggaccuccuggugaccuucaaaacagcccacgcuaagaagcaggaagucgugguucugggaucccaagagggcgccaugcacaccgcccucaccggggcuacagaaauucagacgagcggaaccacaaccaucuuugccggccaucugaaaugcagacuuaagauggauaaacugacacucaaggggaugucuuaugugauguguaccggcuccuucaaacuggagaaggaagucgcggagacgcagcacggaacagugcugguucagauuaaguacgagggcaccgacgcuccgugcaaaaucccuuucagcacccaagaugaaaagggggugacacagaacggacggcuuaucaccgccaaucccauugucacagacaaagagaagccugugaacaucgaagccgagccgcccuuuggcgagucuuauauugugaucggggcuggagaaaaagcccucaagcugagcugguucaagaaaggcuccucuauugggaagauguuugaggcuacggccagaggcgcgcgccggauggccauccugggagauaccgcuugggacuucggcagcaucgggggaguuuuuacauccgucggcaaacucgugcaucagauuuucgggaccgccuacggagugcuguuuagcggcgucucuuggacaaugaagaucgggauuggcgugcuucugaccuggcucggacucaauuccagaagcacgucucuguccaugaccuguaucgcuguuggccuugugacacucuaccugggggucauggugcaggccgauagcggaugcguuauuaacuggaaaggccgcgaacugaaguguggguccggaaucuucgugaccaaugagguccacacauggaccgaacaauauaaguuucaggcggacucuccuaaacggcucagcgccgcuauuggcaaggccugggaggagggggugugcggcaucagauccgcuacacgccuggaaaacaucauguggaaacagauuucuaacgagcuuaaucauauccugcucgaaaacgacaugaaguucaccguuguggucggagauguggccggcauucuggcccaggggaaaaagaugauccggccgcaacccauggagcacaaauacagcuggaaguccuggggaaaggcuaaaauuaucggcgcggacgugcagaauacgacauuuaucauugaugggccuaacacccccgaauguccugacgaucagagagccuggaauaucugggaggucgaggacuauggauucggcauuuuuaccacaaacaucuggcugaaacuucgcgauagcuacacccagguuugcgaccaccggcucaugucugcugccauuaaagauuccaaggccgugcaugcugacaugggcuauuggaucgaaagcgagaaaaaugaaacguggaagcuggccagagcgucuuucaucgaggugaagacauguauuuggcccaaaucccacacccuguggagcaacgggguccucgaaucugagaugaucauuccgaagaucuacggaggcccuauuagccaacauaauuaucgccccggguacuucacacagaccgcuggaccuuggcaccugggcaaacuugagcuggauuuugaccucugcgaagggacaaccgugguuguggaugagcacugcggaaaccggggccccucccugagaacgaccacagucaccggcaagaucauccaugaaugguguugccggagcuguacacugccuccccuucgcuucagaggggaggacggaugcugguacggcauggagauucggccggugaaagaaaaggaggaaaaucucguuaagucuaugguguccgccgggagcggagaggucgacuccuuuucucugggccugcucuguaucagcauuaugaucgaagaggugaugagaucccgcuggucucggaaaaugcugaugaccgggacgcuugccguuuucuuucugcucauuaugggacagcugacauggaacgaucugaucagacuuugcauuauggugggcgcuaaugccagcgaccgcaugggcauggggaccacauaucuggcgcucauggcuaccuucaagaugagaccuauguuugccgucggacugcuguuccggcgccugaccuccagagaggugcuucugcucacaaucggccugucucugguggccagcgucgaacuucccaacucccuggaggaacucggggauggacuggcuaugggcaucaugauucucaaacugcuuacggacuuucaaagccaccagcugugggccacccuccugucucugacauucaucaagaccacauuuucccuucauuacgcuuggaaaaccauggccaugguucugagcauugugucucucuucccccugugucucuccacgacaagccagaagaccaccuggcugccugugcuucuggggucucugggaugcaagccgcucacaauguuucugaucgcggagaauaaaauuuggggccggaaguccuggccccuuaacgaaggcaucauggccgucgggaucgugagcauucugcucuccagccugcucaaaaacgauguuccucuggcuggaccccuuaucgccggcgggaugcugauugcuuguuaugugaucucuggaagcuccgccgaccugucucucgagaaggccgcugaggucagcugggaagaggaagcggagcacuccggcgccucucauaauauucugguggaaguucaggaugacgggaccaugaaaaucaaggaugaggagcgcgacgauacacuuacgauccugcucaaagcuacccugcucgccgugagcggagucuacccucuguccauucccgccacacuuuucgugugguauuucuggcaaaagaagaaacagagaucuggcguccugugggacaccccuuccccucccgaaguggagcgggcuguucuggaugacggcaucuaccgcauuaugcagagagggcuccugggacggucccaggugggcgucgggguguuucaagaaaacguuuuccacacaauguggcacgugacccgcggagccguccuuauguaucagggcaagagacuggagcccagcugggcgucugugaaaaaggaccucaucuccuacgggggaggcuggcggcugcagggcagcuggaauacgggggaggaagugcagguuauugcugucgagcccggcaagaauccuaagaaugugcaaaccgcccccggcaucuuuaagacaccggaaggggaggugggagccauugcucucgauuucaaaccuggcaccucugggucccccaucgucaacagagaaggaaagaucgugggccuguacggcaaugggguugugacaaccagcggaacauaugucuccgccauugcgcaggcuaaagccucucaggagggcccucuucccgagaucgaagacgagguguuucgcaagcggaaccugacgauuauggaucugcaucccgggagcggaaaaaccagacgcuaccucccugccaucguucgggaagcuauuaagagaaagcugcgcacacuuauccuggccccgacccggguggucgcuuccgagauggccgaagcgcucaaaggcaugcccaucagauaucaaaccacagccgucaagagcgagcacacggggaaagagauuguugaccugaugugccaugcuaccuucacaaugcgccugcucucuccugugcggguccccaauuacaacaugaucauuauggaugaagcccacuuuaccgacccuuccagcaucgcugccagaggcuauauuucuacacgggugggaaugggcgaggccgcugcgaucuucaugaccgccacgcccccugggagcguggaggcuuuuccgcaguccaaugccgucauccaggaugaggaacgcgacauucccgagagaucuuggaacagcggauacgaguggaucacagauuucccuggcaagaccguuugguuugugcccuccauuaaaucugggaaugacaucgccaacugucuucggaagaauggaaagcgcgugauucagcugagcagaaaaaccuucgauacagaauaucaaaagaccaaaaacaacgacugggacuacgucgugacaaccgauaucuccgagaugggcgcuaauuuccgggccgacagaguuauugauccucgccggugccugaagcccgugauccucaaagacgggccggaaagagucauccuggcgggcccuaugcccgugacgguugcuagcgccgcccagcgccggggaagagugggccgcaaccauaauaaggagggggaucaguacauuuauaugggacagccccuuaacaaugacgaggaucacgcucacuggacagaagccaagaugcugcucgacaacaucaauaccccugagggcauuauccccgcgcuguuugaaccugagcgggaaaaaucugccgcuauugauggggaguacagacugcgcggagaggccagaaagacauucgucgaacucaugcggcgcggcgaccuuccgguguggcuguccuauaaagucgcuagcgagggguuucaauacuccgauagacgguggugcuucgacggcgaacgcaacaaucaggugcuggaggaaaacauggauguugagaucuggaccaaggagggagaacgcaagaagcuccggcccagauggcuggacgcccgcacguauucugacccucuugcucugcgggaguuuaaagaguucgccgcgggcagacgcagcguguccggggaucucauccuggagauuggaaagcugccccagcaucucacccagcgggcccaaaaugcucuugacaaccuggugaugcugcacaauucugaacagggcgggagagccuaccggcaugcuauggaggagcucccugauacaaucgaaacccugaugcuucuggcccucauugccguccugacaggaggcguuacccuguuuuuccucagcggccgcgggcuuggaaagacauccaucggccugcugugugugauggcuagcucugugcuccuguggauggcguccgucgagccccacuggauugccgcuagcaucauccuugaauuuuuccugauggugcuccugauuccggagccugacagacagcggacaccccaggauaaccaacuggccuauguugugaucgggcuccuuuuuaugauucugacggucgccgcuaaugagaugggacugcucgaaacaaccaaaaaggaccugggcaucgggcacguggccgucgagaaccaucaccaugcggccaugcuugauguggaccugcacccugcuucugccuggacccucuacgcuguugccacaaccauuaucacacccaugaugcgccauacgauugaaaacaccacagcgaauaucucccugaccgccaucgcuaaccaggccgcuauucugaugggacucgauaaaggcuggccuaucagcaagauggacauuggcgugccccuucuggcccuggggugcuacucucaggucaauccgcucacacugaccgcugccgugcuuaugcugguugcgcacuaugccaucauuggaccuggccuccaagcuaaagccacgagagaggcucagaagcggaccgccgccgggaucaugaagaaccccacaguggauggaaucgucgcgauugaccuggaucccgugguguacgacgcuaaauucgaaaagcagcugggccagaucaugcuccuuauucuguguaccagccaaauccugcucaugcgcacaaccugggcccugugcgaguccauuacgcuugcuacagggccucugaccacacucugggagggaucuccgggcaaauuuuggaauaccaccaucgccguuagcauggccaacaucuucagaggcuccuaucuggcuggggccggacuggcguucagccucaugaagucccuuggcgggggacggcgcggcacaggggcccagggagaaacgcugggcgagaaauggaagagacagcugaaucagcucucuaagagcgaauuuaacaccuacaaacgguccggcauuauggaggucgacagaucugaagcuaaggaggggcugaaacgcggagagacaaccaagcacgccgugagccggggcacagcuaaacuuagaugguucguggaacgcaaucuggucaagcccgaggggaagguuaucgaucucggauguggcagagggggaugguccuauuacugcgccggccugaaaaaggugaccgaagugaaaggcuauacgaaagggggaccuggccaugaggaacccauuccuauggcgacauacggguggaaccuggucaaacuccacucuggaaaggacguguuuuucauucccccugagaaaugugauacccuucugugcgacaucggcgagagcuccccgaaucccaccaucgaagaggggagaacacugcgcguucucaagaugguggaaccuuggcugcggggaaaccaauuuuguauuaagauccuuaaucccuacaugccuagcgucguggagacccuggagcagaugcagagaaaacauggcggcaugcucguucgcaacccccugucuagaaauuccacacacgaaauguauugggugagcugcgggacgggaaacaucgucucugccgugaauaugaccuccagaaugcugcucaaccgcuucacaauggcucaccggaagccgaccuacgagagagauguggaccugggcgccgggacacgccaugucgcuguugaaccugagguggccaaccuugauauuaucggacagagaauugaaaauaucaaacacgagcauaagagcaccuggcacuaugacgaggauaaccccuacaaaacgugggcuuaucauggcucuuacgaagugaagcccuccgggagcgccuccagcauggucaauggagugguuaagcugcucaccaaaccuugggacgugauucccauggucacacaaaucgcgaugaccgauacaaccccuuuuggccagcagcggguguucaaggagaaaguugacacacgcaccccgaaggccaaaagaggcacgacacaaaucauggaagugaccgcucgguggcuguggggguuucuuucuagaaacaagaagccccggauuuguacccgcgaggaguucacaagaaaaguccggagcaaugccgcuaucggagccguguuuguugacgagaaccaguggaacuccgccaaggaggcgguggaagaugagcgcuucugggaccugguccacagagaacgggagcuccacaaacagggcaagugcgcuacgugcguguauaacaugauggggaaacgcgaaaagaagcugggagaguuuggcaaagccaaggggucuagagccauuugguacauguggcugggcgcucgguuccucgaguucgaagcccugggauuuaugaaugaggaucauugguucagccgcgaaaacucccuuucuggcgucgagggggagggacugcacaaacucggcuacauccugagagacauuagcaagaucccugggggaaauauguaugcugaugacaccgccggcugggauacacggaucaccgaagacgaucuucagaacgaggcgaaaauuacagacaucauggaacccgagcaugcccugcucgcuaaggccauuuuuaaacugaccuaccaaaauaaggugguucgcgugcagagaccugcuaagaacgggacagucauggaugugaucucccggcgcgaccagagaggcucuggacaggugggcaccuaugggcugaauacguucaccaacauggaagcccaacucauucggcagauggagagcgagggaaucuuuucccccagcgaacuggagacaccgaaccuugcggaaagaguucuggauuggcucgagaaauacggcguggaacgccugaagcggauggccaucucuggggacgacugugucgugaaaccuauugaugacagauucgcuaccgcccuuacagcucugaaugauaugggaaagguucgcaaagacaucccccagugggagccuuccaagggcuggaacgauuggcagcaagugcccuuuugcagccaccacuuccaucagcucauuaugaaggacgggcgggagaucgucgugccuuguagaaaucaggaugaacuggucggccgcgcccgggugucucagggagcuggcuggucccugagagagaccgccugccucgggaaaagcuaugcgcaaauguggcagcugauguacuuucaccgccgggaccuuagacuggccgcuaacgccauuuguuccgccguucccguggauugggucccgacgucucgcacaaccuggagcauccaugcucaccaucaguggaugacaaccgaagacaugcucuccguguggaaucggguuuggauugaggaaaacccuuggauggaggauaagacgcacaucagcucuugggaggacgugcccuaucugggaaaaagagaagaccaauggugcggcucccuuaucgggcugaccgcccgggcgacaugggcuaccaauauucaggucgccaucaaccaggugagacgccucauuggaaaugagaacuaccuggauuacaugacaagcaugaagcgguucaaaaaugaaucugaccccgagggcgcccugugguga

SEQ ID NO: 19415 - RNA, 9879 nt, Artificial Sequence
  derived and/or modified CDS sequence (opt5) from DENV-1__KC762625__SS-prME
uccgugaccaugcugcucaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggagcucugugaagauacacugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcguguccaaacuggagggaaagaucguucaguacgaaaaccucaaauauagcgugaucgucacagugcacacgggcgaccagcaucaaguugggaaugagucuaccgaacacggaacaaccgcuacaauuacaccccaggccccuacgaccgagauccagcugacagacuacggcgcccugacccucgauuguagcccccggacaggccuggacuucaacgaaauggugcuucugaccaugaaggagaaaagcuggcucguccauaagcagugguuucuggaucuuccucugcccuggacguccggggcuucuacaagccaagagaccuggaaucgccaggaccuccuggugacauucaaaaccgcgcacgccaagaagcaggaagucgugguucugggaucccaagagggcgcuaugcacaccgcccucacaggggccacggaaauucagaccagcggaacaaccacaaucuuugcuggccaucugaaaugcagacuuaagauggauaaacugacccucaaggggaugucuuaugugauguguacgggcuccuucaaacuggagaaggaagucgccgagacacagcacggaaccgugcugguucagauuaaguacgagggcaccgacgcgccgugcaaaaucccuuucagcacacaagaugaaaagggggugacccagaacggacggcuuaucacagcuaaucccauugucacggacaaagagaagccugugaacaucgaagccgagccgcccuuuggcgagucuuauauugugaucggggccggagaaaaagcucucaagcugagcugguucaagaaaggcuccucuauugggaagauguuugaggccaccgcuagaggcgcccgccggauggcgauccugggagauacagccugggacuucggcagcaucgggggaguuuuuaccuccgucggcaaacucgugcaucagauuuucgggacagcuuacggagugcuguuuagcggcgucucuuggaccaugaagaucgggauuggcgugcuucugacguggcucggacucaauuccagaagcaccucucuguccaugacauguaucgccguuggccuugugacccucuaccugggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcucagcgcggccauuggcaaggcuugggaggagggggugugcggcaucagauccgccacccgccuggaaaacaucauguggaaacagauuucuaacgagcuuaaucauauccugcucgaaaacgacaugaaguucacgguuguggucggagauguggcuggcauucuggcccaggggaaaaagaugauccggccgcaacccauggagcacaaauacagcuggaaguccuggggaaaggccaaaauuaucggcgcugacgugcagaauacaaccuuuaucauugaugggccuaacacccccgaauguccugacgaucagagagcguggaauaucugggaggucgaggacuauggauucggcauuuuuacaaccaacaucuggcugaaacuucgcgauagcuacacgcagguuugcgaccaccggcucaugucugccgcuauuaaagauuccaaggccgugcaugccgacaugggcuauuggaucgaaagcgagaaaaaugaaacauggaagcuggcuagagccucuuucaucgaggugaaguccuguauuuggcccaaaagccacacccuguggucuaacgggguccucgaaagcgagaugaucauuccgaagaucuacggaggcccuauuucccaacauaauuaucgccccggguacuucacacagaccgcgggaccuuggcaccugggcaaacuugagcuggauuuugaccucugcgaagggacaaccgugguuguggaugagcacugcggaaaccggggccccagccugagaacgaccacagucaccggcaagaucauccaugaaugguguugccggucuuguacacugccuccccuucgcuucagaggggaggacggaugcugguacggcauggagauucggccggugaaagaaaaggaggaaaaucucguuaaguccauggugagcgcuggguccggagaggucgacucuuuuagccugggccugcucuguaucuccauuaugaucgaagaggugaugagaucucgcuggagccggaaaaugcugaugaccgggacgcuugccguuuucuuucugcucauuaugggacagcugacauggaacgaucugaucagacuuugcauuauggugggcgccaaugcuuccgaccgcaugggcauggggaccacauaucuggcccucauggcgaccuucaagaugagaccuauguuugcugucggacugcuguuccggcgccugaccucuagagaggugcuucugcucacaaucggccugagccugguggccuccgucgaacuucccaacagccuggaggaacucggggauggacuggccaugggcaucaugauucucaaacugcuuacggacuuucaaucucaccagcugugggcuacccuccugucccugacauucaucaagaccacauuuagccuucauuacgccuggaaaaccauggcuaugguucugucuauugugucccucuucccccugugucucagcacgacaucucagaagaccaccuggcugccugugcuucuggggucccugggaugcaagccgcucacaauguuucugaucgccgagaauaaaauuuggggccggaaguccuggccccuuaacgaaggcaucauggcggucgggaucguguccauucugcucagcucucugcucaaaaacgauguuccucuggccggaccccuuaucgcuggcgggaugcugauugccuguuaugugaucagcggauccucugcugaccugagccucgagaaggccgccgaggucuccugggaagaggaagcugagcacucuggcgcgagccauaauauucugguggaaguucaggaugacgggaccaugaaaaucaaggaugaggagcgcgacgauacacuuacgauccugcucaaagccacccugcucgcuguguccggagucuacccucugucuauucccgccacacuuuucgugugguauuucuggcaaaagaagaaacagagaagcggcguccugugggacaccccuagcccucccgaaguggagcgggccguucuggaugacggcaucuaccgcauuaugcagagagggcuccugggacggagccaggugggcgucgggguguuucaagaaaacguuuuccacacaauguggcacgugacccgcggagcuguccuuauguaucagggcaagagacuggagcccucuugggccuccgugaaaaaggaccucaucagcuacgggggaggcuggcggcugcagggcucuuggaauacgggggaggaagugcagguuauugcggucgagcccggcaagaauccuaagaaugugcaaaccgcucccggcacauuuaagaccccggaaggggaggugggagccaucgcccucgauuucaaaccuggcacauccgggagccccauugucaacagagaaggaaagaucgugggccuguacggcaaugggguugugaccacauccggaacguaugucucugcuaucgcccaggcgaaagcuagccaggagggcccucuucccgagauugaagacgagguguuucgcaagcggaaccugaccaucauggaucugcaucccggguccggaaaaacaagacgcuaccucccugccauuguucgggaagccaucaagagaaagcugcgcacccuuauucuggcuccgacccggguggucgccagcgagauggcugaagcccucaaaggcaugcccaucagauaucaaacaacggcggugaagucugagcacaccgggaaagagaucguugaccugaugugccaugccacauucaccaugcgccugcucuccccugugcggguccccaauuacaacaugauuaucauggaugaagcucacuuuacagacccuagcucuauugccgcuagaggcuauaucagcacccgggugggaaugggcgaggccgccgcuauuuucaugacggcgacacccccuggguccguggaagccuuuccgcagucuaaugcugucauccaggaugaggaacgcgacauccccgagagaagcuggaacuccggauacgaguggauuaccgauuucccuggcaagaccguuugguuugugcccucuaucaaaagcgggaaugacauugccaacugucuucggaagaauggaaagcgcgugauccagcuguccagaaaaacauucgauaccgaauaucaaaagaccaagaacaacgacugggacuacgucgugaccacggauauuagcgagaugggcgccaauuuccgggcugacagaguuaucgauccucgccggugccugaagcccgugauucucaaagacgggccggaaagagucauccuggccggcccuaugcccgugacaguugcgucugcugcccagcgccggggaagagugggccgcaaccauaauaaggagggggaucaguacaucuauaugggacagccccuuaacaaugacgaggaucacgcccacuggaccgaagcuaagaugcugcucgacaacauuaauacaccugagggcaucauucccgcccuguuugaaccugagcgggaaaaauccgcggccaucgauggggaguacagacugcgcggagaggcuagaaagaccuucgucgaacucaugcggcgcggcgaccuuccgguguggcugagcuauaaagucgccuccgagggguuucaauacucugauagacgguggugcuucgacggcgaacgcaacaaucaggugcuggaggaaaacauggauguugagauuuggacgaaggagggagaacgcaaaaagcuccggcccagauggcuggacgcucgcaccuauagcgacccucuugcccugcgggaguuuaaagaguucgcugccggcagacgcuccgugucuggggaucucauccuggagaucggaaagcugccccagcaucucacacagcgggcgcaaaaugcccuugacaaccuggugaugcugcacaauagcgaacagggcgggagagcuuaccggcaugccauggaggagcucccugauaccauugaaacacugaugcuucuggcucucaucgccguccugaccggaggcguuacacuguuuuuccucuccggccgcgggcuuggaaagaccagcauuggccugcugugugugauggccucuuccgugcuccuguggauggcuagcgucgagccccacuggaucgcggccucuauuauccuugaauuuuuccugauggugcuccugaucccggagccugacagacagcggacgccccaggauaaccaacuggcuuauguugugauugggcuccuuuuuaugauccugacagucgccgccaaugagaugggacugcucgaaaccaccaaaaaggaccugggcauugggcacguggcugucgagaaccaucaccaugccgcgaugcuugauguggaccugcacccugccuccgcuuggacacucuacgccguugcuaccacaaucauuacgcccaugaugcgccauaccaucgaaaacacaaccgccaauauuagccugacagcgaucgccaaccaggcugccauccugaugggacucgauaaaggcuggccuauuucuaagauggacaucggcgugccccuucuggcucuggggugcuacagccaggucaauccgcucacccugacggccgcugugcuuaugcugguugcccacuaugcgauuaucggaccuggccuccaagccaaagcuaccagagaggcccagaagcggacagcugccgggauuaugaagaaccccaccguggauggaaucgucgccaucgaccuggaucccgugguguacgacgcgaaauucgaaaagcagcugggccagauuaugcuccuuauccuguguacaucccaaauucugcucaugcgcaccacgugggcucugugcgagucuaucacacuugccaccgggccucugacaacccucugggagggaagcccgggcaaauuuuggaauaccacaauugcuguuuccauggccaacaucuucagaggcagcuaucuggccggggcuggacuggccuucucccucaugaagucucuuggcgggggacggcgcggcacgggggcgcagggagaaacccugggcgagaaauggaagagacagcugaaucagcucagcaaguccgaauuuaacacauacaaacggucuggcaucauggaggucgacagaagcgaagccaaggaggggcugaaacgcggagagaccacaaagcacgcugugucccggggcaccgccaaacuuagaugguucguggaacgcaaucuggucaagcccgaggggaagguuauugaucucggauguggcagagggggauggucuuauuacugcgcuggccugaaaaaggugacggaagugaaaggcuauacaaaagggggaccuggccaugaggaacccaucccuauggccaccuacggguggaaccuggucaaacuccacagcggaaaggacguguuuuucauucccccugagaaaugugauacccuucugugcgacaucggcgaguccagcccgaaucccacaauugaagaggggagaacccugcgcguucucaagaugguggaaccuuggcugcggggaaaccaauuuuguaucaagauucuuaaucccuacaugccuucugucguggagacacuggagcagaugcagagaaaacauggcggcaugcucguucgcaacccccugucccggaauagcacgcacgaaauguauugggugucuugcgggaccggaaacaucgucuccgcggugaauaugacaagcagaaugcugcucaaccgcuucaccauggcccaccggaagccgacauacgagagagauguggaccugggcgcugggacccgccaugucgccguugaaccugagguggcuaaccuugauaucauuggacagagaaucgaaaauauuaaacacgagcauaagucuacguggcacuaugacgaggauaaccccuacaaaaccugggccuaucauggcuccuacgaagugaagcccagcggguccgcuagcucuauggucaauggagugguuaagcugcucacaaaaccuugggacgugauccccauggucacccaaauugccaugacagauaccacaccuuuuggccagcagcggguguucaaggagaaaguugacacccgcacgccgaaggcgaaaagaggcacaacccaaaucauggaagugaccgcccgguggcuguggggguuucuuagcagaaacaagaagccccggaucuguacacgcgaggaguucacgagaaaaguccgguccaaugcugccauuggagcuguguuuguugacgagaaccaguggaacucugccaaggaggccguggaagaugagcgcuucugggaccugguccacagagaacgggagcuccacaaacagggcaagugcgcgaccugcguguauaacaugauggggaaacgcgaaaagaagcugggagaguuuggcaaagcuaaggggagcagagccaucugguacauguggcugggcgcccgguuccucgaguucgaagcucugggauuuaugaaugaggaucauugguucucccgcgaaaacucucuuagcggcgucgagggggagggacugcacaaacucggcuacauucugagagacaucuccaagauuccugggggaaauauguaugccgaugacacagcuggcugggauacccggaucacagaagacgaucuucagaacgaggccaaaaucaccgacauuauggaacccgagcaugcgcugcucgccaaggcuaucuuuaaacugacauaccaaaauaaggugguucgcgugcagagaccugccaagaacgggaccgucauggaugugauuucucggcgcgaccagagaggcagcggacaggugggcacguaugggcugaauaccuucacaaacauggaagcucaacucauccggcagauggaguccgagggaauuuuuagccccucugaacuggagaccccgaaccuugccgaaagaguucuggauuggcucgagaaauacggcguggaacgccugaagcggauggcgaucuccggggacgacugugucgugaaaccuaucgaugacagauucgccacagcucuuaccgcccugaaugauaugggaaagguucgcaaagacauuccccagugggagccuagcaagggcuggaacgauuggcagcaagugcccuuuugcucucaccacuuccaucagcucaucaugaaggacgggcgggagauugucgugccuuguagaaaucaggaugaacuggucggccgcgcucgggugucccagggagccggcuggagccugagagagacggcuugccucgggaaauccuaugcccaaauguggcagcugauguacuuucaccgccgggaccuuagacuggcggccaacgcuaucuguucugccguucccguggauugggucccgacaagccgcaccacaugguccauucaugcccaccaucaguggaugaccacggaagacaugcucagcguguggaaucggguuuggaucgaggaaaacccuuggauggaggauaagacccacauuucuuccugggaggacgugcccuaucugggaaaaagagaagaccaauggugcggcagccuuaucgggcugacagcucgggccaccugggcgacaaauauccaggucgcuauuaaccaggugagacgccucaucggaaaugagaacuaccuggauuacaugaccucuaugaagcgguucaaaaaugaaagcgaccccgagggcgcccugugguga

SEQ ID NO: 19416 - RNA, 9879 nt, Artificial Sequence
  derived and/or modified CDS sequence (opt5) from DENV-1__KC762635__SS-prME
agcgugaccaugcugcucaugcugaugcccacagcccuugcuuuccaccugacgaccagaggcggggaaccucauaugaucgucuccaagcaggaacggggaaaaucucuccuguuuaagaccagcgccggcguuaauaugugcacccuuauugcgauggaccugggggagcucugugaagauacacugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagcgcguugaaacaugggcucuuagacaccccggcuucaccgugaucgcccuguuucucgcgcaugccauugggacaucuaucacccagaaaggaaucauuuucauccugcuuaugcuggucaccccuagcauggcuaugcggugcgugggcauugggucccgcgauuuuguugagggacucagcggcgccacauggguggacgucgugcuggagcacgggucuugugugacgaccauggcuaaggauaagcccacacuggacaucgaacuccugaaaaccgaggucacaaacccugccguucuuagaaagcugugcauugaagcgaaaaucuccaauaccacgacagauagccgguguccgacccaaggagaggccacccucguggaagaacaagacgcuaacuucgugugccgcagaacauuugucgaucggggcuggggcaauggguguggacuguucggcaaggggucucuuauuaccugcgccaaauuuaagugcgugacaaagcuggagggaaaaaucguucaguacgaaaaccucaaguauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccgcaccggccuggacuucaacgaaauggugcuucugacgaugaaagagaaguccuggcucguccauaaacagugguuucuggaucuuccucugcccuggacaagcggggcuuccaccucucaagagacauggaauagacaggaccuccuggugaccuucaagaccgcgcacgccaaaaagcaggaagucgugguucugggaagccaagagggcgcuaugcacacagcccucacgggggccaccgaaauucagacauccggaaccacaaccaucuuugcuggccaucugaagugccggcuuaaaauggauaagcugacgcucaaagggaugagcuaugugauguguacaggcucuuucaagcuggagaaagaagucgccgagacccagcacggaaccgugcugguucagauuaaguacgagggcacagacgcgccgugcaagaucccuuucuccacccaagaugaaaaaggggugacacagaacggaagacuuaucacggcuaaucccauugucaccgacaaggagaaaccugugaacaucgaagccgagccgcccuuuggcgagagcuauauugugaucggggccggagaaaaggcucucaaacugucuugguucaagaagggcagcuccauugggaaaauguuugaggccacagcucgcggcgcccggagaauggcgauccugggagauaccgccugggacuucggcucuaucgggggaguuuuuacaagcgucggcaagcucgugcaucagauuuucgggaccgcuuacggagugcuguuuuccggcgucagcuggacgaugaaaaucgggauuggcgugcuucugaccuggcucggacucaauucucgcuccacaagccugucuaugaccuguaucgccguuggccuugugacacucuaccugggggucauggugcaggcugauuccggaugcguuauuaacuggaagggccgggaacugaaaugugggagcggaaucuucgugaccaaugagguccacacauggaccgaacaauauaaguuucaggccgacuccccuaagagacucucugcggccauuggcaaggcuugggaggagggggugugcggcauccgcagcgccacgcggcuggaaaacaucauguggaagcagauuuccaacgagcuuaaucauauccugcucgaaaacgacaugaaauucacaguuguggucggagauguggcuggcauucuggcccaggggaagaaaaugaucagaccgcaacccauggagcacaaguacucuuggaaaagcuggggaaaggccaagauuaucggcgcugacgugcagaauaccaccuuuaucauugaugggccuaacacacccgaauguccugacgaucagcgcgcguggaauaucugggaggucgaggacuauggauucggcauuuuuaccacgaacaucuggcugaaacuucgggauuccuacacacagguuugcgaccacagacucaugagcgccgcuauuaaggauucuaaagccgugcaugccgacaugggcuauuggaucgaauccgagaagaaugaaaccuggaaacuggcucgcgccagcuucaucgaggugaagacauguauuuggcccaagucucacacccugugguccaacgggguccucgaaagcgagaugaucauuccgaaaaucuacggaggcccuauuucucaacauaauuaucggcccggguacuucacacagaccgcgggaccuuggcaccugggcaaacuugagcuggauuuuaaccucugcgaagggacgaccgugguuguggacgagcacugcggaaauagaggccccagccugcggacaaccacagucaccggcaaaaucauccaugaaugguguugccgcuccuguacgcugccuccccuuagauucagaggggaagauggaugcugguacggcauggagauucggccggugaaggaaaaagaggaaaaccucguuaagagcauggugucugcuggguccggagaggucgacagcuuuucccugggccugcucuguaucucuauuaugaucgaagaggugaugcgcagccggugguccagaaagaugcugaugacagggacccuugccguuuucuuucugcucauuaugggacagcugacauggaaugaccugauccgccuuugcauuauggugggcgccaacgcuucugauagaaugggcauggggaccaccuaucuggcccucauggcgacauucaaaaugcggccuauguuugcugucggacugcuguuccgcagacugacgagccgggaggugcuucugcucaccaucggccugucccugguggccucugucgaacuucccaauagccuggaggaacucggggacggacuggccaugggcaucaugauucucaagcugcuuacagauuuucaaucccaccagcugugggcuacccuccugagccugacauucaucaaaaccacguuuucucuucauuacgccuggaagacaauggcuaugguucuguccauugugagccucuucccccugugucucucuaccaccucccagaaaacaaccuggcugccugugcuucuggggagccugggaugcaagccgcucacaauguuucugaucgccgagaacaagauuuggggccgcaaaucuuggccccuuaacgaaggcaucauggcggucgggaucguguccauucugcucagcucccugcucaagaaugacguuccucuggccggaccccuuaucgcuggcgggaugcugauugccuguuaugugaucagcggaucuagcgcugaucugucccucgagaaagccgccgaggucucuugggaagaggaagcugagcacagcggcgcgucccauaacauucugguggaaguucaggacgaugggacgaugaagaucaaagacgaggagagagaugacacccuuacaauccugcucaaggccacccugcucgcugugucuggagucuacccucugagcauucccgccacacuuuucgugugguauuucuggcagaagaagaagcagcgguccggcguccugugggauaccccuucucccccggaaguggagcgcgccguucuggacgauggcaucuacagaauuaugcagcgggggcuccugggacgcagccaggugggcgucgggguguuucaagaaaauguuuuccacacgauguggcacgugaccagaggagcuguccuuauguaucagggcaaacggcuggagccuuccugggccagcgugaagaaagaccucaucucuuacgggggaggcuggagacugcagggcuccuggaacacaggggaggaagugcagguuauugcggucgagcccggaaagaauccuaaaaacgugcaaaccgcucccggcacauuuaagaccccggaaggggaggugggagccaucgcccucgacuucaagccuggcacaagcgggucucccauugucaaucgcgaaggaaaaaucgugggccuguacggcaacgggguugugacgaccuccggaacauaugucagcgcuaucgcccaggcgaaggcuucccaggagggcccucuucccgagauugaagaugagguguuucggaaaagaaaucugaccaucauggaccugcaucccgggucuggaaagacccgccgguaccucccugccauuguuagagaagccaucaaacgcaagcugcggacacuuauucuggcuccgacgagaguggucgccagcgagauggcugaagcccucaagggcaugcccauccgcuaucaaaccacagcggugaaauccgagcacaccgggaaggagaucguugaucugaugugccaugccacauucaccaugcggcugcucagcccugugagaguccccaacuacaauaugauuaucauggacgaagcucacuuuacggauccuucuuccauugccgcucggggcuauaucagcacacgcgugggaaugggcgaggccgccgcuauuuucaugaccgcgacacccccugggucuguggaagccuuuccgcagagcaacgcugucauccaggacgaggaaagagauauccccgagcgguccuggaacucuggauacgaguggauuacagacuucccuggcaaaaccguuugguuugugcccagcaucaaguccgggaacgauauugccaauugucuucgcaaaaacggaaagagagugauccagcugucucggaagacauucgacaccgaauaucagaaaacgaagaacaaugauugggacuacgucgugacaaccgacauuagcgagaugggcgccaacuucagagcugaucgcguuaucgacccucggagaugccugaaacccgugauucucaaggaugggccggaacgcgucauccuggccggcccuaugcccgugacaguugcguccgcugcccagcggagaggacgcgugggccggaaucauaacaaagagggggaccaguacaucuauaugggacagccccuuaauaacgaugaggaccacgcccacuggaccgaagcuaagaugcugcucgauaauauuaacacgccugagggcaucauucccgcccuguuugaaccugagagagaaaagagcgcggccaucgacggggaguaccgccugagaggagaggcucggaaaaccuucgucgaacucaugcgcagaggcgaucuuccgguguggcugucuuauaaggucgccuccgagggguuucaauacagcgaccggcgcuggugcuucgauggcgaaagaaauaaccaggugcuggaggaaaauauggacguugagauuuggacaaaagagggagaacggaagaaacucagaccccgcuggcuggaugcucggaccuauuccgacccucuugcccugagagaguuuaaggaguucgcugccggccgccggucugugagcggggaccucauccuggagaucggaaaacugccccagcaucucacacagagagcgcaaaacgcccuugauaaucuggugaugcugcacaacuccgaacagggcgggcgggcuuaccgccaugccauggaggagcucccugacaccauugaaacacugaugcuucuggcucucaucgccguccugaccggaggcguuacgcuguuuuuccucucuggcagagggcuuggaaagacaagcauuggccugcugugugugauggccuccagcgugcuccuguggauggcuucugucgagccccacuggaucgcggccuccauuauccuugaauuuuuccugauggugcuccugaucccggagccugaucggcagcgcacaccccaagacaaucaacuggcuuauguugugauugggcuccuuuuuaugauccugaccgucgccgccaacgagaugggacugcucgaaaccaccaagaaagaucugggcauugggcacguggcugucgagaaccaucaccaugccgcgaugcuugacguggaucugcacccugccagcgcuuggacacucuacgccguugcuacgaccaucauuacacccaugaugagacauaccaucgaaaauacaaccgccaacauuucucugacggcgaucgccaaucaggcugccauccugaugggacucgacaagggcuggccuauuuccaaaauggauaucggcgugccccuucuggcucuggggugcuacagccaggucaacccgcucacccugacagccgcugugcuuaugcugguugcccacuaugcgauuaucggaccuggccuccaagccaaggcuacccgggaggcccagaaacgcacagcugccgggauuaugaagaaucccaccguggacggaaucgucgccaucgaucuggaccccgugguguacgaugcgaaguucgaaaaacagcugggccagauuaugcuccuuauccuguguacgucucaaauucugcucaugagaacaaccugggcucugugcgagagcaucacacuugccaccgggccucugaccacacucugggagggauccccgggcaaguuuuggaacacgaccauugcuguuucuauggccaauaucuuccggggcagcuaucuggccggggcuggacuggccuucucccucaugaaaagccuuggcgggggacgcagaggcacaggggcgcagggagaaacccugggcgagaaguggaaacggcagcugaaccagcucuccaagucugaauuuaauacauacaagagaagcggcaucauggaggucgaccgcuccgaagccaaagaggggcugaagcggggagagaccacgaaacacgcugugucuagaggcacagccaaacuucgcugguucguggaacggaaccuggucaaacccgaggggaagguuauugaccucggauguggcagagggggauggagcuauuacugcgcuggccugaagaaagugaccgaagugaagggcuauaccaaagggggaccuggccaugaggaacccaucccuauggccacauacggguggaaucuggucaagcuccacuccggaaaagauguguuuuucauucccccugagaagugugacacccuucugugcgauaucggcgagucuagcccgaaccccacaauugaagaggggcgcacgcugcggguucucaaaaugguggaaccuuggcugagaggaaaucaauuuuguaucaagauucuuaaccccuacaugccuuccgucguggagacccuggagcagaugcagcgcaagcauggcggcaugcucguucggaauccccugagcagaaacucuacacacgaaauguauuggguguccugcgggaccggaaauaucgucagcgcggugaacaugacaucucgcaugcugcucaaccgguucaccauggcccacagaaaaccgacguacgagcgcgacguggaucugggcgcugggaccagacaugucgccguugaaccugagguggcuaaucuugacaucauuggacagcggaucgaaaacauuaagcacgagcauaaauccacauggcacuaugaugaggacaaucccuacaagaccugggccuaucauggcagcuacgaagugaaacccucuggguccgcuagcuccauggucaacggagugguuaagcugcucacaaagccuugggaugugauccccauggucacccaaauugccaugacagacaccacgccuuuuggccagcagcgcguguucaaagagaagguugauacaagaaccccgaaagcgaagcggggcaccacacaaaucauggaagugacggccagauggcuguggggguuucuuagccggaauaaaaagccccgcaucuguaccagagaggaguucacacggaagguccgcucuaacgcugccauuggagcuguguuuguugacgagaaucaguggaacagcgccaaagaggccguggaagacgagagauucugggaucugguccaccgggaacgcgagcuccacaagcagggcaaaugcgcgaccugcguguauaauaugauggggaagagagagaaaaagcugggagaguuuggcaaggcuaaagggucccgggccaucugguacauguggcugggcgcccgcuuccucgaguucgaagcucugggauuuaugaacgaggaccauugguucucuagagaaaauagccuuuccggcgucgagggggagggacugcacaagcucggcuacauucugcgggauaucucuaaaauuccugggggaaacauguaugccgacgauacagcuggcugggacacccgcaucacagaagaugaccuucagaaugaggccaagaucaccgauauuauggaacccgagcaugcgcugcucgccaaagcuaucuuuaagcugacguaccaaaacaaagugguuagagugcagcggccugccaagaaugggaccgucauggacgugauuagccgcagagaucagcggggcuccggacaggugggcacauaugggcugaacaccuucacaaacauggaagcucaacucaucagacagauggagucugagggaauuuuuagccccuccgaacuggagaccccgaaucuugccgaacgcguucuggacuggcucgagaaguacggcguggaacggcugaaaagaauggcgaucagcggggaugacugugucgugaagccuaucgacgaucgcuucgccacggcucuuacagcccugaacgacaugggaaaaguucggaaggauauuccccagugggagccuucuaaaggcuggaaugacuggcagcaagugcccuuuugcucccaccacuuccaucagcucaucaugaaggaugggagagagauugucgugccuugucgcaaccaggacgaacuggucggccgggcuagagugagccagggagccggcuggucucugcgcgagaccgcuugccucgggaaguccuaugcccaaauguggcagcugauguacuuucaccggagagaucuucgccuggcggccaaugcuaucuguagcgccguucccguggacugggucccgacaucccggaccacguggucuauucaugcccaccaucaguggaugaccacagaagauaugcucagcguguggaacagaguuuggaucgaggaaaauccuuggauggaggacaaaacccacauuuccagcugggaggaugugcccuaucugggaaagcgggaagaccaauggugcggcucucuuaucgggcugacagcuagagccaccugggcgacaaacauccaggucgcuauuaaucaggugcgccggcucaucggaaacgagaauuaccuggacuacaugaccuccaugaaaagauucaagaacgaaagcgaucccgagggcgcccugugguga

SEQ ID NO: 19417 - RNA, 9879 nt, Artificial Sequence
  derived and/or modified CDS sequence (opt5) from DENV-1__KC762650__SS-prME
agcgugaccaugcugcucaugcugaugcccacagcccuugcuuuccaccugacgaccagaggcggggaaccucauaugaucgucuccaagcaggaacggggaaaaucucuccuguuuaagaccagcgccggcguuaauaugugcacccuuaucgcgauggaccugggggagcucugugaagauacacugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagcgcguugaaacaugggcucuuagacaccccggcuucaccgugaucgcccuguuucucgcgcaugccauugggacaucuaucacccagaaaggaaucauuuucauccugcuuaugcuggucaccccuagcauggcuaugcggugcgugggcauugggucccgcgauuuuguugagggacucagcggcgccacauggguggacgucgugcuggagcacgggucuugugugacgaccauggcuaaggauaagcccacacuggacaucgaacuccugaaaaccgaggucacaaacccugccguucuuagaaagcugugcauugaagcgaaaaucuccaauaccacgacagauagccgguguccgacccaaggagaggccacccucguggaagaacaagacgcuaacuucgugugccgcagaacauuugucgaucggggcuggggcaauggguguggacuguucggcaaggggucucuuauuaccugcgccaaauuuaagugcgugacaaagcuggagggaaaaaucguucaguacgaaaaccucaaguauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccgcaccggccuggacuucaacgaaauggugcuucugacgaugaaagagaaguccuggcucguccauaaacagugguuucuggaucuuccucugcccuggacaagcggggcuuccaccucucaagagacauggaauagacaggaccuccuggugaccuucaagaccgcgcacgccaaaaagcaggaagucgugguucugggaagccaagagggcgcuaugcacacagcccucacgggggccaccgaaauucagacauccggaaccacaaccaucuuugcuggccaucugaagugccggcuuaaaauggauaagcugacgcucaaagggaugagcuaugugauguguacaggcucuuucaagcuggagaaagaagucgccgagacccagcacggaaccgugcugguucagauuaaguacgagggcacagacgcgccgugcaagaucccuuucuccacccaagaugaaaaaggggugacacagaacggaagacuuaucacggcuaaucccauugucaccgacaaggagaaaccugugaacaucgaagccgagccgcccuuuggcgagagcuauauugugaucggggccggagaaaaggcucucaaacugucuugguucaagaagggcagcuccauugggaaaauguuugaggccacagcucgcggcgcccggagaauggcgauccugggagauaccgccugggacuucggcucuaucgggggaguuuuuacaagcgucggcaagcucgugcaucagauuuucgggaccgcuuacggagugcuguuuuccggcgucagcuggacgaugaaaaucgggauuggcgugcuucugaccuggcucggacucaauucucgcuccacaagccugucuaugaccuguaucgccguuggccuugugacacucuaccugggggucauggugcaggcugauuccggaugcguuauuaacuggaagggccgggaacugaaaugugggagcggaaucuucgugaccaaugagguccacacauggaccgaacaauauaaguuucaggccgacuccccuaagagacucucugcggccauuggcaaggcuugggaggagggggugugcggcauccgcagcgccacgcggcuggaaaacaucauguggaagcagauuuccaacgagcuuaaucauauccugcucgaaaacgacaugaaauucacaguuguggucggagauguggcuggcauucuggcccaggggaagaaaaugaucagaccgcaacccauggagcacaaguacucuuggaaaagcuggggaaaggccaagauuaucggcgcugacgugcagaauaccaccuuuaucauugaugggccuaacacacccgaauguccugacgaucagcgcgcguggaauaucugggaggucgaggacuauggauucggcauuuuuaccacgaacaucuggcugaaacuucgggauuccuacacacagguuugcgaccacagacucaugagcgccgcuauuaaggauucuaaagccgugcaugccgacaugggcuauuggaucgaauccgagaagaaugaaaccuggaaacuggcucgcgccagcuucaucgaggugaagacauguauuuggcccaagucucacacccugugguccaacgggguccucgaaagcgagaugaucauuccgaaaaucuacggaggcccuauuucucaacauaauuaucggcccggguacuucacacagaccgcgggaccuuggcaccugggcaaacuugagcuggauuuuaaccucugcgaagggacgaccgugguuguggacgagcacugcggaaauagaggccccagccugcggacaaccacagucaccggcaaaaucauccaugaaugguguugccgcuccuguacgcugccuccccuuagauucagaggggaagauggaugcugguacggcauggagauucggccggugaaggaaaaagaggaaaaccucguuaagagcauggugucugcuggguccggagaggucgacagcuuuucccugggccugcucuguaucucuauuaugaucgaagaggugaugcgcagccggugguccagaaagaugcugaugacagggacccuugccguuuucuuucugcucauuaugggacagcugacauggaaugaccugauccgccuuugcauuauggugggcgccaacgcuucugauagaaugggcauggggaccaccuaucuggcccucauggcgacauucaaaaugcggccuauguuugcugucggacugcuguuccgcagacugacgagccgggaggugcuucugcucaccaucggccugucccugguggccucugucgaacuucccaauagccuggaggaacucggggacggacuggccaugggcaucaugauucucaagcugcuuacagauuuucaaucccaccagcugugggcuacccuccugagccugacauucaucaaaaccacguuuucucuucauuacgccuggaagacaauggcuaugguucuguccauugugagccucuucccccugugucucucuaccaccucccagaaaacaaccuggcugccugugcuucuggggagccugggaugcaagccgcucacaauguuucugaucgccgagaacaagauuuggggccgcaaaucuuggccccuuaacgaaggcaucauggcggucgggaucguguccauucugcucagcucccugcucaagaaugacguuccucuggccggaccccuuaucgcuggcgggaugcugauugccuguuaugugaucagcggaucuagcgcugaucugucccucgagaaagccgccgaggucucuugggaagaggaagcugagcacagcggcgcgucccauaacauucugguggaaguucaggacgaugggacgaugaagaucaaagacgaggagagagaugacacccuuacaauccugcucaaggccacccugcucgcugugucuggagucuacccucugagcauucccgccacacuuuucgugugguauuucuggcagaagaagaagcagcgguccggcguccugugggauaccccuucucccccggaaguggagcgcgccguucuggacgauggcaucuacagaauuaugcagcgggggcuccugggacgcagccaggugggcgucgggguguuucaagaaaauguuuuccacacgauguggcacgugaccagaggagcuguccuuauguaucagggcaaacggcuggagccuuccugggccagcgugaagaaagaccucaucucuuacgggggaggcuggagacugcagggcuccuggaacacaggggaggaagugcagguuauugcggucgagcccggaaagaauccuaaaaacgugcaaaccgcucccggcacauuuaagaccccggaaggggaggugggagccaucgcccucgacuucaagccuggcacaagcgggucucccauugucaaucgcgaaggaaaaaucgugggccuguacggcaacgggguugugacgaccuccggaacauaugucagcgcuaucgcccaggcgaaggcuucccaggagggcccucuucccgagauugaagaugagguguuucggaaaagaaaucugaccaucauggaccugcaucccgggucuggaaagacccgccgguaccucccugccauuguuagagaagccaucaaacgcaagcugcggacacuuauucuggcuccgacgagaguggucgccagcgagauggcugaagcccucaagggcaugcccauccgcuaucaaaccacagcggugaaauccgagcacaccgggaaggagaucguugaucugaugugccaugccacauucaccaugcggcugcucagcccugugagaguccccaacuacaauaugauuaucauggacgaagcucacuuuacggauccuucuuccauugccgcucggggcuauaucagcacacgcgugggaaugggcgaggccgccgcuauuuucaugaccgcgacacccccugggucuguggaagccuuuccgcagagcaacgcugucauccaggacgaggaaagagauauccccgagcgguccuggaacucuggauacgaguggauuacagacuucccuggcaaaaccguuugguuugugcccagcaucaaguccgggaacgauauugccaauugucuucgcaaaaacggaaagagagugauccagcugucucggaagacauucgacaccgaauaucagaaaacgaagaacaaugauugggacuacgucgugacaaccgacauuagcgagaugggcgccaacuucagagcugaucgcguuaucgacccucggagaugccugaaacccgugauucucaaggaugggccggaacgcgucauccuggccggcccuaugcccgugacaguugcguccgcugcccagcggagaggacgcgugggccggaaucauaacaaagagggggaccaguacaucuauaugggacagccccuuaauaacgaugaggaccacgcccacuggaccgaagcuaagaugcugcucgauaauauuaacacgccugagggcaucauucccgcccuguuugaaccugagagagaaaagagcgcggccaucgacggggaguaccgccugagaggagaggcucggaaaaccuucgucgaacucaugcgcagaggcgaucuuccgguguggcugucuuauaaggucgccuccgagggguuucaauacagcgaccggcgcuggugcuucgauggcgaaagaaauaaccaggugcuggaggaaaauauggacguugagauuuggacaaaagagggagaacggaagaaacucagaccccgcuggcuggaugcucggaccuauuccgacccucuugcccugagagaguuuaaggaguucgcugccggccgccggucugugagcggggaccucauccuggagaucggaaaacugccccagcaucucacacagagagcgcaaaacgcccuugauaaucuggugaugcugcacaacuccgaacagggcgggcgggcuuaccgccaugccauugaggagcucccugacaccaucgaaacacugaugcuucuggcucucauugccguccugaccggaggcguuacgcuguuuuuccucucuggcagagggcuuggaaagacaagcaucggccugcugugugugauggccuccagcgugcuccuguggauggcuucugucgagccccacuggauugcggccuccaucauccuugaauuuuuccugauggugcuccugauuccggagccugaucggcagcgcacaccccaagacaaucaacuggcuuauguugugaucgggcuccuuuuuaugauucugaccgucgccgccaacgagaugggacugcucgaaaccaccaagaaagaucugggcaucgggcacguggcugucgagaaccaucaccaugccgcgaugcuugacguggaucugcacccugccagcgcuuggacacucuacgccguugcuacgaccauuaucacacccaugaugagacauaccauugaaaauacaaccgccaacaucucucugacggcgaucgccaaucaggcugccauucugaugggacucgacaagggcuggccuaucuccaaaauggauauuggcgugccccuucuggcucuggggugcuacagccaggucaacccgcucacccugacagccgcugugcuuaugcugguugcccacuaugcgaucauuggaccuggccuccaagccaaggcuacccgggaggcccagaaacgcacagcugccgggaucaugaagaaucccaccguggacggaaucgucgccauugaucuggaccccgugguguacgaugcgaaguucgaaaaacagcugggccagaucaugcuccuuauucuguguacgucucaaauccugcucaugagaacaaccugggcucugugcgagagcauuacacuugccaccgggccucugaccacacucugggagggauccccgggcaaguuuuggaacacgaccaucgcuguuucuauggccaauaucuuccggggcagcuaucuggccggggcuggacuggccuucucccucaugaaaagccuuggcgggggacgcagaggcacaggggcgcagggagaaacccugggcgagaaguggaaacggcagcugaaccagcucuccaagucugaauuuaauacauacaagagaagcggcauuauggaggucgaccgcuccgaagccaaagaggggcugaagcggggagagaccacgaaacacgcugugucuagaggcacagccaaacuucgcugguucguggaacggaaccuggucaaacccgaggggaagguuaucgaccucggauguggcagagggggauggagcuauuacugcgcuggccugaagaaagugaccgaagugaagggcuauaccaaagggggaccuggccaugaggaacccauuccuauggccacauacggguggaaucuggucaagcuccacuccggaaaagauguguuuuucauucccccugagaagugugacacccuucugugcgauauuggcgagucuagcccgaaccccacaaucgaagaggggcgcacgcugcggguucucaaaaugguggaaccuuggcugagaggaaaucaauuuuguauuaagauccuuaaccccuacaugccuuccgucguggagacccuggagcagaugcagcgcaagcauggcggcaugcucguucggaauccccugagcagaaacucuacacacgaaauguauuggguguccugcgggaccggaaauaucgucagcgcggugaacaugacaucucgcaugcugcucaaccgguucaccauggcccacagaaaaccgacguacgagcgcgacguggaucugggcgcugggaccagacaugucgccguugaaccugagguggcuaaucuugacauuaucggacagcggauugaaaacaucaagcacgagcauaaauccacauggcacuaugaugaggacaaucccuacaagaccugggccuaucauggcagcuacgaagugaaacccucuggguccgcuagcuccauggucaacggagugguuaagcugcucacaaagccuugggaugugauucccauggucacccaaaucgccaugacagacaccacgccuuuuggccagcagcgcguguucaaagagaagguugauacaagaaccccgaaagcgaagcggggcaccacacaaaucauggaagugacggccagauggcuguggggguuucuuagccggaauaaaaagccccgcauuuguaccagagaggaguucacacggaagguccgcucuaacgcugccaucggagcuguguuuguugacgagaaucaguggaacagcgccaaagaggccguggaagacgagagauucugggaucugguccaccgggaacgcgagcuccacaagcagggcaaaugcgcgaccugcguguauaauaugauggggaagagagagaaaaagcugggagaguuuggcaaggcuaaagggucccgggccauuugguacauguggcugggcgcccgcuuccucgaguucgaagcucugggauuuaugaacgaggaccauugguucucuagagaaaauagccuuuccggcgucgagggggagggacugcacaagcucggcuacauccugcgggauauuucuaaaaucccugggggaaacauguaugccgacgauacagcuggcugggacacccgcaucacagaagaugaccuucagaaugaggccaagauuaccgauaucauggaacccgagcaugcgcugcucgccaaagcuauuuuuaagcugacguaccaaaacaaagugguuagagugcagcggccugccaagaaugggaccgucauggacgugaucagccgcagagaucagcggggcuccggacaggugggcacauaugggcugaacaccuucacaaacauggaagcucaacucauuagacagauggagucugagggaaucuuuagccccuccgaacuggagaccccgaaucuugccgaacgcguucuggacuggcucgagaaguacggcguggaacggcugaaaagaauggcgaucagcggggaugacugugucgugaagccuauugacgaucgcuucgccacggcucuuacagcccugaacgacaugggaaaaguucggaaggauaucccccagugggagccuucuaaaggcuggaaugacuggcagcaagugcccuuuugcucccaccacuuccaucagcucauuaugaaggaugggagagagaucgucgugccuugucgcaaccaggacgaacuggucggccgggcuagagugagccagggagccggcuggucucugcgcgagaccgcuugccucgggaaguccuaugcccaaauguggcagcugauguacuuucaccggagagaucuucgccuggcggccaaugcuauuuguagcgccguucccguggacugggucccgacaucccggaccacguggucuauccaugcccaccaucaguggaugaccacagaagauaugcucagcguguggaacagaguuuggauugaggaaaauccuuggauggaggacaaaacccacaucuccagcugggaggaugugcccuaucugggaaagcgggaagaccaauggugcggcucucuuaucgggcugacagcuagagccaccugggcgacaaacauucaggucgcuaucaaucaggugcgccggcucauuggaaacgagaauuaccuggacuacaugaccuccaugaaaagauucaagaacgaaagcgaucccgagggcgcccugugguga

SEQ ID NO: 19418 - RNA, 9879 nt, Artificial Sequence
  derived and/or modified CDS sequence (opt5) from DENV-1__KC762623__SS-prME
uccgugaccaugcugcucaugcugaugcccacagcccuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauacacugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcguguccaaacuggagggaaagaucguucaguacgaaaaccucaaauauagcgugaucgucacagugcacacgggcgaccagcaucaaguugggaaugagucuaccgaacacggaacaaccgcuacaauuacaccccaggccccuacgaccgagauccagcugacagacuacggcgcccugacccucgauuguagcccccggacaggccuggacuucaacgaaauggugcuucugaccaugaaggagaaaagcuggcucguccauaagcagugguuucuggaucuuccucugcccuggacguccggggcuucuacaagccaagagaccuggaaucgccaggaccuccuggugacauucaaaaccgcgcacgccaagaagcaggaagucgugguucugggaucccaagagggcgcuaugcacaccgcccucacaggggccacggaaauucagaccagcggaacaaccacaaucuuugcuggccaucugaaaugcagacuuaagauggauaaacugacccucaaggggaugucuuaugugauguguacgggcuccuucaaacuggagaaggaagucgccgagacacagcacggaaccgugcugguucagauuaaguacgagggcaccgacgcgccgugcaaaaucccuuucagcacacaagaugaaaagggggugacccagaacggacggcuuaucacagcuaaucccauugucacggacaaagagaagccugugaacaucgaagccgagccgcccuuuggcgagucuuauauugugaucggggccggagaaaaagcucucaagcugagcugguucaagaaaggcuccucuauugggaagauguuugaggccaccgcuagaggcgcccgccggauggcgauccugggagauacagccugggacuucggcagcaucgggggaguuuuuaccuccgucggcaaacucgugcaucagauuuucgggacagcuuacggagugcuguuuagcggcgucucuuggaccaugaagaucgggauuggcgugcuucugacguggcucggacucaauuccagaagcaccucucuguccaugacauguaucgccguuggccuugugacccucuaccugggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcucagcgcggccauuggcaaggcuugggaggagggggugugcggcaucagauccgccacccgccuggaaaacaucauguggaaacagauuucuaacgagcuuaaucauauccugcucgaaaacgacaugaaguucacgguuguggucggagauguggcuggcauucuggcccaggggaaaaagaugauccggccgcaacccauggagcacaaauacagcuggaaguccuggggaaaggccaaaauuaucggcgcugacgugcagaauacaaccuuuaucauugaugggccuaacacccccgaauguccugacgaucagagagcguggaauaucugggaggucgaggacuauggauucggcauuuuuacaaccaacaucuggcugaaacuucgcgauagcuacacgcagguuugcgaccaccggcucaugucugccgcuauuaaagauuccaaggccgugcaugccgacaugggcuauuggaucgaaagcgagaaaaaugaaacauggaagcuggcuagagccucuuucaucgaggugaaguccuguauuuggcccaaaagccacacccuguggucuaacgggguccucgaaagcgagaugaucauuccgaagaucuacggaggcccuauuucccaacauaauuaucgccccggguacuucacacagaccgcgggaccuuggcaccugggcaaacuugagcuggauuuugaccucugcgaagggacaaccgugguuguggaugagcacugcggaaaccggggccccagccugagaacgaccacagucaccggcaagaucauccaugaaugguguugccggucuuguacacugccuccccuucgcuucagaggggaggacggaugcugguacggcauggagauucggccggugaaagaaaaggaggaaaaucucguuaaguccauggugagcgcuggguccggagaggucgacucuuuuagccugggccugcucuguaucuccauuaugaucgaagaggugaugagaucucgcuggagccggaaaaugcugaugaccgggacgcuugccguuuucuuucugcucauuaugggacagcugacauggaacgaucugaucagacuuugcauuauggugggcgccaaugcuuccgaccgcaugggcauggggaccacauaucuggcccucauggcgaccuucaagaugagaccuauguuugcugucggacugcuguuccggcgccugaccucuagagaggugcuucugcucacaaucggccugagccugguggccuccgucgaacuucccaacagccuggaggaacucggggauggacuggccaugggcaucaugauucucaaacugcuuacggacuuucaaucucaccagcugugggcuacccuccugucccugacauucaucaagaccacauuuagccuucauuacgccuggaaaaccauggcuaugguucugucuauugugucccucuucccccugugucucagcacgacaucucagaagaccaccuggcugccugugcuucuggggucccugggaugcaagccgcucacaauguuucugaucgccgagaauaaaauuuggggccggaaguccuggccccuuaacgaaggcaucauggcggucgggaucguguccauucugcucagcucucugcucaaaaacgauguuccucuggccggaccccuuaucgcuggcgggaugcugauugccuguuaugugaucagcggauccucugcugaccugagccucgagaaggccgccgaggucuccugggaagaggaagcugagcacucuggcgcgagccauaauauucugguggaaguucaggaugacgggaccaugaaaaucaaggaugaggagcgcgacgauacacuuacgauccugcucaaagccacccugcucgcuguguccggagucuacccucugucuauucccgccacacuuuuccugugguauuucuggcaaaagaagaaacagagaagcggcgugcugugggacaccccuagcccucccgaagucgagcgggccgugcucgaugacggcaucuaccgcauuaugcagagagggcugcuuggacggagccagguuggcgugggggucuuucaagaaaacguguuccacacaauguggcacguuacccgcggagcugugcugauguaucagggcaagagacucgagcccucuugggccuccgucaaaaaggaccugaucagcuacgggggaggcuggcggcuccagggcucuuggaauacgggggaggaaguccaggugauugcgguugagcccggcaagaauccuaagaauguccaaaccgcucccggcacauuuaagaccccggaaggggaggugggagccaucgcccuggauuucaaaccuggcacauccgggagccccauugugaacagagaaggaaagaucgucggccuuuacggcaauggggugguuaccacauccggaacguaugugucugcuaucgcccaggcgaaagcuagccaggagggcccucugcccgagauugaagacgaggucuuucgcaagcggaaccugaccaucauggaucuccaucccggguccggaaaaacaagacgcuaccugccugccauugugcgggaagccaucaagagaaaacuucgcacccugauucucgcuccgacccggguuguggccagcgagauggcugaagcccugaaaggcaugcccaucagauaucaaacaacggcggucaagucugagcacaccgggaaagagaucguggaccugaugugccaugccacauucaccaugcgccuccuuuccccuguucgggugcccaauuacaacaugauuaucauggaugaagcucacuuuacagacccuagcucuauugccgcuagaggcuauaucagcacccgggucggaaugggcgaggccgccgcuauuuucaugacggcgacacccccuggguccguggaagccuuuccgcagucuaaugcugugauccaggaugaggaacgcgacauccccgagagaagcuggaacuccggauacgaguggauuaccgauuucccuggcaagaccgucugguuuguucccucuaucaaaagcgggaaugacauugccaacugucugcggaagaauggaaagcgcgugauccagcuguccagaaaaacauucgauaccgaauaucaaaagaccaagaacaacgacugggacuacguggucaccacggauauuagcgagaugggcgccaauuuccgggcugacagagugaucgauccucgccggugccucaagcccguuauucugaaagacgggccggaaagagugauccuugccggcccuaugcccgucacaguggcgucugcugcccagcgccggggaagaguuggccgcaaccauaauaaggagggggaucaguacaucuauaugggacagccccugaacaaugacgaggaucacgcccacuggaccgaagcuaagaugcuccuggacaacauuaauacaccugagggcaucauucccgcccuguuugaaccugagcgggaaaaauccgcggccaucgauggggaguacagacuccgcggagaggcuagaaagaccuucguggaacuuaugcggcgcggcgaccugccggucuggcugagcuauaaaguggccuccgagggguuucaauacucugauagacgguggugcuucgacggcgaacgcaacaaucagguccucgaggaaaacauggauguggagauuuggacgaaggagggagaacgcaagaagcugcggcccagauggcuugacgcucgcaccuauagcgacccucuggcccuccgggaguuuaaagaguucgcugccggcagacgcuccguuucuggggaucugauccuggagaucggaaagcucccccagcaucuuacacagcgggcgcaaaaugcccuggacaaccuggugaugcuccacaauagcgaacagggcgggagagcuuaccggcaugccauggaggagcugccugauaccauugaaacacuuaugcugcucgcucugaucgccgugcugaccggaggcgucacacucuuuuuccuuuccggccgcgggcugggaaagaccagcauuggccugcucuguguuauggccucuuccgugcugcuuuggauggcuagcguggagccccacuggaucgcggccucuauuauccuggaauuuuuccucaugguccugcugaucccggagccugacagacagcggacgccccaggauaaccaacucgcuuaugugguuauugggcuucuguuuaugauccugacaguggccgccaaugagaugggacuccuggaaaccaccaaaaaggaccuuggcauugggcacgucgcuguggagaaccaucaccaugccgcgaugcuggaugucgaccuccacccugccuccgcuuggacacuguacgccguggcuaccacaaucauuacgcccaugaugcgccauaccaucgaaaacacaaccgccaauauuagccugacagcgaucgccaaccaggcugccauccucaugggacuugauaaaggcuggccuauuucuaagauggacaucggcguuccccugcuggcucucgggugcuacagccaggugaauccgcugacccuuacggccgcuguccugaugcucguggcccacuaugcgauuaucggaccuggccugcaagccaaagcuaccagagaggcccagaagcggacagcugccgggauuaugaagaaccccaccguugauggaaucguggccaucgaccuggaucccgucguguacgacgcgaaauucgaaaagcagcucggccagauuaugcuucugauccuguguacaucccaaauucuccugaugcgcaccacgugggcucuuugcgagucuaucacacuggccaccgggccucucacaacccugugggagggaagcccgggcaaauuuuggaauaccacaauugcuguguccauggccaacaucuucagaggcagcuaucuggccggggcuggacucgccuucucccuuaugaagucucugggcgggggacggcgcggcacgggggcgcagggagaaacccugggcgagaaauggaagagacagcucaaucagcugagcaaguccgaauuuaacacauacaaacggucuggcaucauggagguugacagaagcgaagccaaggaggggcuuaaacgcggagagaccacaaagcacgcugucucccggggcaccgccaaacugagaugguucguggaacgcaaucucgugaagcccgaggggaaggucauugaucugggauguggcagagggggauggucuuauuacugcgcuggccugaaaaagguuacggaagugaaaggcuauacaaaagggggaccuggccaugaggaacccaucccuauggccaccuacggguggaaccucgugaaacuucacagcggaaaggacgucuuuuucauucccccugagaaaugugauacccugcugugcgacaucggcgaguccagcccgaaucccacaauugaagaggggagaacccuccgcgugcugaagaugguugaaccuuggcuucggggaaaccaauuuuguaucaagauucugaaucccuacaugccuucuguggucgagacacucgagcagaugcagagaaaacauggcggcaugcuggugcgcaacccccugucccggaauagcacgcacgaaauguauuggguuucuugcgggaccggaaacaucguguccgcggucaauaugacaagcagaaugcuccugaaccgcuucaccauggcccaccggaagccgacauacgagagagauguggaccuuggcgcugggacccgccauguggccgucgaaccugagguugcuaaccuggauaucauuggacagagaaucgaaaauauuaaacacgagcauaagucuacguggcacuaugacgaggauaaccccuacaaaaccugggccuaucauggcuccuacgaagugaagcccagcggguccgcuagcucuauggugaauggagucgugaagcuccugacaaaaccuugggacguuauccccauggugacccaaauugccaugacagauaccacaccuuuuggccagcagcgggucuucaaggagaaaguggacacccgcacgccgaaggcgaaaagaggcacaacccaaaucauggaaguuaccgcccgguggcuuuggggguuucugagcagaaacaagaagccccggaucuguacacgcgaggaguucacgagaaaagugcgguccaaugcugccauuggagcugucuuuguggacgagaaccaguggaacucugccaaggaggccguugaagaugagcgcuucugggaccucgugcacagagaacgggagcugcacaaacagggcaagugcgcgaccugcgucuauaacaugauggggaaacgcgaaaagaagcugggagaguuuggcaaagcuaaggggagcagagccaucugguacauguggcucggcgcccgguuccuggaguucgaagcucuuggauuuaugaaugaggaucauugguucucccgcgaaaacucucugagcggcguggagggggagggacuccacaaacugggcuacauucuuagagacaucuccaagauuccugggggaaauauguaugccgaugacacagcuggcugggauacccggaucacagaagacgaucugcagaacgaggccaaaaucaccgacauuauggaacccgagcaugcgcuccuggccaaggcuaucuuuaaacugacauaccaaaauaaggucgugcgcguucagagaccugccaagaacgggaccgugauggaugucauuucucggcgcgaccagagaggcagcggacaggugggcacguaugggcucaauaccuucacaaacauggaagcucaacugauccggcagauggaguccgagggaauuuuuagccccucugaacuugagaccccgaaccuggccgaaagagugcucgauuggcuggagaaauacggcguugaacgccuuaagcggauggcgaucuccggggacgacuguguggucaaaccuaucgaugacagauucgccacagcucugaccgcccucaaugauaugggaaaggugcgcaaagacauuccccagugggagccuagcaagggcuggaacgauuggcagcaaguucccuuuugcucucaccacuuccaucagcugaucaugaaggacgggcgggagauuguggucccuuguagaaaucaggaugaacuggugggccgcgcucgggucucccagggagccggcuggagccucagagagacggcuugccuggggaaauccuaugcccaaauguggcagcuuauguacuuucaccgccgggaccugagacucgcggccaacgcuaucuguucugccgugcccguugauugggugccgacaagccgcaccacaugguccauucaugcccaccaucaguggaugaccacggaagacaugcugagcgucuggaaucggguguggaucgaggaaaacccuuggauggaggauaagacccacauuucuuccugggaggacguucccuaucuuggaaaaagagaagaccaauggugcggcagccugaucgggcucacagcucgggccaccugggcgacaaauauccagguggcuauuaaccaggucagacgccugaucggaaaugagaacuaccuggauuacaugaccucuaugaagcgguucaaaaaugaaagcgaccccgagggcgcccucugguga

SEQ ID NO: 19419 - RNA, 9879 nt, Artificial Sequence
  derived and/or modified CDS sequence (opt5) from DENV-1__KC762632__SS-prME
agcgugaccaugcugcucaugcugaugcccacagcccuugcuuuccaccugacgacccggggcggggagccucauaugaucgucuccaagcaggaacggggaaaaucucuccuguuuaagaccagcgccggcguuaauaugugcacccuuauugcgauggaccugggggagcucugugaagauacacugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagaugcagcgcguugaaacaugggcucuuagacaccccggcuucaccgugauugcccuguuucucgcgcaugccaucgggacaucuauuacccagaaaggaaucaucuucauucugcuuaugcuggucaccccuagcauggcuaugcggugcgugggcaucgggucccgcgauuuuguugagggacucagcggcgccacauggguggacgucgugcuggagcacgggucuugugugacgaccauggcuaaggauaagcccacacuggacauugaacuccugaaaaccgaggucacaaacccugccguucuuagaaagcugugcaucgaagcgaaaauuuccaauaucaccacggauagccgguguccgacacaaggagaggccacccucguggaagaacaagacgcuaacuucgugugccgcagaaccuuugucgaucggggcuggggcaauggguguggacuguucggcaaggggucucuuauuacaugcgccaaauuuaagugcgugaccaagcuggagggaaaaaucguucaguacgaaaaccucaaguauuccgugaucgucacagugcacacgggcgaccagcaucaaguugggaaugagagcaccgaacacggaacaaccgcuacaauuacgccccaagccccuaccaccgagauccagcugacagacuacggcgcccugacccucgauuguucuccccgcacaggccuggacuucaacgaaauggugcuucugaccaugaaagagaaguccuggcucguccauaaacagugguuucuggaucuuccucugcccuggacgagcggggcuuccacaucucaagagaccuggaauagacaggaccuccuggugacauucaagaccgcgcacgccaaaaagcaggaagucgugguucugggaagccaagagggcgcuaugcacaccgcccucacaggggccacggaaauucagaccuccggaacaaccacaaucuuugcuggccaucugaagugccggcuuaaaauggauaagcugacccucaaagggaugagcuaugugauguguacgggcucuuucaagcuggagaaagaagucgccgagacacagcacggaaccgugcugguucagauuaaguacgagggcaccgacgcgccgugcaagaucccuuucuccacacaagaugaaaaaggggugacccagaacggaagacuuaucacagcuaaucccauugucacggacaaggagaaaccugugaacaucgaagccgagccgcccuuuggcgagagcuauauugugaucggggccggagaaaaggcucucaaacugucuugguucaagaagggcagcuccauugggaaaauguuugaggccaccgcucgcggcgcccggagaauggcgauccugggagauacagccugggacuucggcucuaucgggggaguuuuuaccagcgucggcaagcucgugcaucagauuuucgggacagcuuacggagugcuguuuuccggcgucagcuggaccaugaaaaucgggauuggcgugcuucugacguggcucggacucaauucucgcuccaccagccugucuaugacauguaucgccguuggccuugugacccucuaccugggggucauggugcaggcugauuccggaugcguuauuaacuggaagggccgggaacugaaaugugggagcggaaucuucgugacaaaugagguccacaccuggacagaacaauauaaguuucaggccgacuccccuaagagacucucugcggccauuggcaaggcuugggaggagggggugugcggcauccgcagcgccacccggcuggaaaacaucauguggaagcagauuuccaacgagcuuaaucauauccugcucgaaaacgacaugaaauucacgguuguggucggagauguggcuggcauucuggcccaggggaagaaaaugaucagaccgcaacccauggagcacaaguacucuuggaaaagcuggggaaaggccaagauuaucggcgcugacgugcagaauacaaccuuuaucauugaugggccuaacacccccgaauguccugacgaucagcgcgcguggaauaucugggaggucgaggacuauggauucggcauuuuuacaaccaacaucuggcugaaacuucgggauuccuacacgcagguuugcgaccacagacucaugagcgccgcuauuaaggauucuaaagccgugcaugccgacaugggcuauuggaucgaauccgagaagaaugaaacauggaaacuggcucgcgccagcuucaucgaggugaagaccuguauuuggcccaagucucacacacugugguccaacgggguccucgaaagcgagaugaucauuccgaaaaucuacggaggcccuauuucucaacauaauuaucggcccggguacuucacccagacagcgggaccuuggcaccugggcaaacuugagcuggauuuuaaccucugcgaagggaccacggugguuguggacgagcacugcggaaauagaggccccagccugcggaccacaaccgucacaggcaaaaucauccaugaaugguguugccgcuccuguacccugccuccccuuagauucagaggggaggauggaugcugguacggcauggagauuagaccggugaaggaaaaagaggaaaaccucguuaagagcauggugucugcuggguccggagaggucgacagcuuuucccugggccugcucuguaucucuauuaugaucgaagaggugaugcgcagccggugguccagaaagaugcugaugacggggacacuugccguuuucuuucugcucauuaugggacagcugaccuggaaugaccugauccgccuuugcauuauggugggcgccaacgcuucugauagaaugggcauggggacaaccuaucuggcccucauggcgaccuucaaaaugcggccuauguuugcugucggacugcuguuccgcagacugacaagccgggaggugcuucugcucacgaucggccugucccugguggccucugucgaacuucccaauagccuggaggaacucggggacggacuggccaugggcaucaugauucucaagcugcuuaccgauuuucaaucccaccagcugugggcuacacuccugagccugaccuucaucaaaacaaccuuuucucuucauuacgccuggaagacgauggcuaugguucuguccauugugagccucuucccccugugucucucuacaaccucccagaaaaccacauggcugccugugcuucuggggagccugggaugcaagccgcucaccauguuucugaucgccgagaacaagauuuggggccgcaaaucuuggccccuuaacgaaggcaucauggcggucgggaucguguccauucugcucagcucccugcucaagaaugacguuccucuggccggaccccuuaucgcuggcgggaugcugauugccuguuaugugaucagcggaucuagcgcugaucugucccucgagaaagccgccgaggucucuugggaagaggaagcugagcacagcggcgcgucccauaacauucugguggaaguucaggacgaugggacaaugaagaucaaagacgaggagagagaugacacgcuuaccauccugcucaaggccacacugcucgcugugucuggagucuacccucugagcauucccgccacccuuuucgugugguauuucuggcagaagaagaagcagcgguccggcguccugugggauacaccuucucccccggaaguggagcgcgccguucuggacgauggcaucuacagaauuaugcagcgggggcuccugggacgcagccaggugggcgucgggguguuucaagaaaauguuuuccacaccauguggcacgugacgagaggagcuguccuuauguaucagggcaaacggcuggagccuuccugggccagcgugaagaaagaccucaucucuuacgggggaggcuggagacugcagggcuccuggaacaccggggaggaagugcagguuauugcggucgagcccggaaagaauccuaaaaacgugcaaacagcucccggcaccuuuaagacaccggaaggggaggugggagccaucgcccucgacuucaagccuggcaccagcgggucucccauugucaaucgcgaaggaaaaaucgugggccuguacggcaacgggguugugacaacguccggaaccuaugucagcgcuaucgcccaggcgaaggcuucccaggagggcccucuucccgagauugaagaugagguguuucggaaaagaaaucugacaaucauggaccugcaucccgggucuggaaagacccgccgguaccucccugccauuguuagagaagccaucaaacgcaagcugcggacccuuauucuggcuccgacaagaguggucgccagcgagauggcugaagcccucaagggcaugcccauccgcuaucaaacgaccgcggugaaauccgagcacacagggaaggagaucguugaucugaugugccaugccaccuucacaaugcggcugcucagcccugugagaguccccaacuacaauaugauuaucauggacgaagcucacuuuaccgauccuucuuccauugccgcucggggcuauaucagcacgcgcgugggaaugggcgaggccgccgcuauuuucaugacagcgacacccccugggucuguggaagccuuuccgcagagcaacgcugucauccaggacgaggaaagagauauccccgagcgguccuggaacucuggauacgaguggauuaccgacuucccuggcaaaacaguuugguuugugcccagcaucaaguccgggaacgauauugccaauugucuucgcaaaaacggaaagagagugauccagcugucucggaagaccuucgacacagaauaucagaaaaccaagaacaaugauugggacuacgucgugacgacagacauuagcgagaugggcgccaacuucagagcugaucgcguuaucgacccucggagaugccugaaacccgugauucucaaggaugggccggaacgcgucauccuggccggcccuaugcccgugaccguugcguccgcugcccagcggagaggacgcgugggccggaaucauaacaaagagggggaccaguacaucuauaugggacagccccuuaauaacgaugaggaccacgcccacuggacagaagcuaagaugcugcucgauaauauuaacaccccugagggcaucauucccgcccuguuugaaccugagagagaaaagagcgcggccaucgacggggaguaccgccugagaggagaggcucggaaaacguucgucgaacucaugcgcagaggcgaucuuccgguguggcugucuuauaaggucgccuccgagggguuucaauacagcgaccggcgcuggugcuucgauggcgaaagaaauaaccaggugcuggaggaaaauauggacguugagauuuggaccaaagagggagaacggaagaaacucagaccccgcuggcuggaugcucggacauauuccgacccucuugcccugagagaguuuaaggaguucgcugccggccgccggucugugagcggggaccucauccuggagaucggaaaacugccccagcaucucacccagagagcgcaaaacgcccuugauaaucuggugaugcugcacaacuccgaacagggcgggcgggcuuaccgccaugccauggaggagcucccugacacaauugaaacccugaugcuucuggcucucaucgccguccugacaggaggcguuacccuguuuuuccucucuggcagagggcuuggaaagacgagcauuggccugcugugugugauggccuccagcgugcuccuguggauggcuucugucgagccccacuggaucgcggccuccauuauccuugaauuuuuccugauggugcuccugaucccggagccugaucggcagcgcacaccccaggacaaucaacuggcuuauguugugauugggcuccuuuuuaugauccugaccgucgccgccaacgagaugggacugcucgaaaccacaaagaaagaucugggcauugggcacguggcugucgagaaccaucaccaugccgcgaugcuugacguggaucugcacccugccagcgcuuggacccucuacgccguugcuacaacgaucauuacccccaugaugagacauacaaucgaaaauaccacagccaacauuucucugaccgcgaucgccaaucaggcugccauccugaugggacucgacaagggcuggccuauuuccaaaauggauaucggcgugccccuucuggcucuggggugcuacagccaggucaacccgcucacgcugaccgccgcugugcuuaugcugguugcccacuaugcgauuaucggaccuggccuccaagccaaggcuacacgggaggcccagaaacgcaccgcugccgggauuaugaagaaucccacaguggacggaaucgucgccaucgaucuggaccccgugguguacgaugcgaaguucgaaaaacagcugggccagauuaugcuccuuauccuguguaccucucaaauucugcucaugagaacgacaugggcucugugcgagagcaucacccuugccacagggccucugaccacccucugggagggauccccgggcaaguuuuggaacacaacgauugcuguuucuauggccaauaucuuccggggcagcuaucuggccggggcuggacuggccuucucccucaugaaaagccuuggcgggggacgcagaggcaccggggcgcagggagaaacacugggcgagaaguggaaacggcagcugaaccagcucuccaagucugaauuuaauaccuacaagagaagcggcaucauggaggucgaccgcuccgaagccaaagaggggcugaagcggggagagacaaccaaacacgcugugucuagaggcacggccaaacuucgcugguucguggaacggaaccuggucaaacccgaggggaagguuauugaccucggauguggcagagggggauggagcuauuacugcgcuggccugaagaaagugacagaagugaagggcuauaccaaagggggaccuggccaugaggaacccaucccuauggccaccuacggguggaaucuggucaagcuccacuccggaaaagauguguuuuucauucccccugagaagugugacacacuucugugcgauaucggcgagucuagcccgaaccccaccauugaagaggggcgcacacugcggguucucaaaaugguggaaccuuggcugagaggaaaucaauuuuguaucaagauucuuaaccccuacaugccuuccgucguggagacgcuggaccagaugcagcgcaagcauggcggcaugcucguucggaauccccugagcagaaacucuacccacgagauguauuggguguccugcgggacaggaaauaucgucagcgcggugaacaugaccucucgcaugcugcucaaccgguucacaauggcccacagaaaaccgaccuacgaacgcgauguggaccugggcgcugggacgagacaugucgccguugagccugaaguggcuaaucuugauaucauuggacagcggaucgagaacauuaagcacgaacauaaauccaccuggcacuaugacgaggauaaucccuacaagacaugggccuaucauggcagcuacgaggugaaacccucuggguccgcuagcuccauggucaacggagugguuaagcugcucaccaagccuugggacgugauccccauggucacacaaauugccaugaccgauacaaccccuuuuggccagcagcgcguguucaaagaaaagguugacacgagaacaccgaaagcgaagcggggcaccacccaaaucauggaggugacagccagauggcuguggggguuucuuagccggaauaaaaagccccgcaucuguacgagagaagaguucacccggaagguccgcucuaacgcugccauuggagcuguguuuguugacgaaaaucaguggaacagcgccaaagaggccguggaggaugaaagauucugggaccugguccaccgggagcgcgaacuccacaagcagggcaaaugcgcgacaugcguguauaauaugauggggaagagagagaaaaagcugggagaauuuggcaaggcuaaagggucccgggccaucugguacauguggcugggcgcccgcuuccucgaguucgaggcucugggauuuaugaacgaagaucauugguucucuagagagaauagccuuuccggcgucgaaggggagggacugcacaagcucggcuacauucugcgggacaucucuaaaauuccugggggaaacauguaugccgaugacaccgcuggcugggauacacgcaucaccgaggacgaucuucagaaugaagccaagaucacagacauuauggagcccgaacaugcgcugcucgccaaagcuaucuuuaagcugaccuaccaaaacaaagugguuagagugcagcggccugccaagaaugggacggucauggaugugauuagccgcagagaccagcggggcuccggacaggugggcaccuaugggcugaacacauucaccaacauggaggcucaacucaucagacagauggaaucugagggaauuuuuagccccuccgagcuggaaacaccgaaucuugccgagcgcguucuggauuggcucgaaaaguacggcguggagcggcugaaaagaauggcgaucagcggggacgacugugucgugaagccuaucgaugaccgcuucgccaccgcucuuacggcccugaacgauaugggaaaaguucggaaggacauuccccagugggaaccuucuaaaggcuggaaugauuggcagcaagugcccuuuugcucccaccacuuccaucagcucaucaugaaggacgggagagagauugucgugccuugucgcaaccaggaugagcuggucggccgggcuagagugagccagggagccggcuggucucugcgcgaaacagcuugccucgggaaguccuaugcccaaauguggcagcugauguacuuucaccggagagaccuucgccuggcggccaaugcuaucuguagcgccguucccguggauugggucccgaccucccggacaaccuggucuauucaugcccaccaucaguggaugacgaccgaggacaugcucagcguguggaacagaguuuggaucgaagagaauccuuggauggaagauaaaacacacauuuccagcugggaggacgugcccuaucugggaaagcgggaggaccaauggugcggcucucuuaucgggcugaccgcuagagccacaugggcgaccaacauccaggucgcuauuaaucaggugcgccggcucaucggaaacgaaaauuaccuggauuacaugacauccaugaaaagauucaagaacgagagcgaccccgaaggcgcccugugguga

SEQ ID NO: 19420 - RNA, 9879 nt, Artificial Sequence
  derived and/or modified CDS sequence (opt5) from DENV-1__KC762637__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccgugguuguggaugagcacugcggaaaccggggccccagccugagaacaaccacagucaccggcaagaucauccaugaaugguguugccgguccuguacgcugccuccccuucgcuucagaggggaggacggaugcugguacggcauggagauucggccggugaaagaaaaggaggaaaaucucguuaagagcauggugucugcuggguccggagaggucgacagcuuuucccugggccugcucuguaucucuauuaugaucgaagaggugaugagaagccgcuggucccggaaaaugcugaugacagggacccuugccguuuucuuucugcucauuaugggacagcugacauggaacgaucugaucagacuuugcauuauggugggcgccaaugcuucugaccgcaugggcauggggaccaccuaucuggcccucauggcgacauucaagaugagaccuauguuugcugucggacugcuguuccggcgccugacgagcagagaggugcuucugcucaccaucggccugucccugguggccucugucgaacuucccaacagccuggaggaacucggggauggacuggccaugggcaucaugauucucaaacugcuuacagacuuucaaucccaccagcugugggcuacccuccugagccugacauucaucaagaccacguuuucucuucauuacgccuggaaaacaauggcuaugguucuguccauugugagccucuucccccugugucucucuaccaccucccagaagacaaccuggcugccugugcuucuggggagccugggaugcaagccgcucacaauguuucugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuaugugaucagcggaucuagcgcugaccugucccucgagaaggccgccgaggucucuugggaagaggaagcugagcacagcggcgcgucccauaauauucugguggaaguucaggaugacgggacgaugaaaaucaaggaugaggagcgcgacgauacccuuacaauccugcucaaagccacccugcucgcugugucuggagucuacccucugagcauucccgccacacuuuucgugugguauuucuggcaaaagaagaaacagagauccggcguccugugggacaccccuucucccccggaaguggagcgggccguucuggaugacggcaucuaccgcauuaugcagagagggcuccugggacggagccaggugggcgucgggguguuucaagaaaacguuuuccacacgauguggcacgugacccgcggagcuguccuuauguaucagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauuuaagaccccggaaggggaggugggagccaucgcccucgauuucaaaccuggcacaagcgggucucccauugucaacagagaaggaaagaucgugggccuguacggcaaugggguugugacgaccuccggaacauaugucagcgcuaucgcccaggcgaaggcuucccaggagggcccucuucccgagauugaagacgagguguuucgcaagcggaaccugaccaucauggaucugcaucccgggucuggaaaaaccagacgcuaccucccugccauuguucgggaagccaucaagagaaagcugcgcacacuuauucuggcuccgacgcggguggucgccagcgagauggcugaagcccucaaaggcaugcccaucagauaucaaaccacagcggugaaguccgagcacaccgggaaagagaucguugaccugaugugccaugccacauucaccaugcgccugcucagcccugugcggguccccaauuacaacaugauuaucauggaugaagcucacuuuacggacccuucuuccauugccgcuagaggcuauaucagcacacgggugggaaugggcgaggccgccgcuauuuucaugaccgcgacacccccugggucuguggaagccuuuccgcagagcaaugcugucauccaggaugaggaacgcgacauccccgagagauccuggaacucuggauacgaguggauuacagauuucccuggcaagaccguuugguuugugcccagcaucaaauccgggaaugacauugccaacugucuucggaagaauggaaagcgcgugauccagcugucuagaaaaacauucgauaccgaauaucaaaagacgaaaaacaacgacugggacuacgucgugacaaccgauauuagcgagaugggcgccaauuuccgggcugacagaguuaucgauccucgccggugccugaagcccgugauucucaaagacgggccggaaagagucauccuggccggcccuaugcccgugacaguugcguccgcugcccagcgccggggaagagugggccgcaaccauaauaaggagggggaucaguacaucuauaugggacagccccuuaacaaugacgaggaucacgcccacuggaccgaagcuaagaugcugcucgacaacauuaauacgccugagggcaucauucccgcccuguuugaaccugagcgggaaaagagcgcggccaucgauggggaguacagacugcgcggagaggcuagaaagaccuucgucgagcucaugcggcgcggcgaccuuccgguguggcugucuuauaaagucgccuccgagggguuucaauacagcgauagacgguggugcuucgacggcgaacgcaacaaucaggugcuggaggaaaacauggauguugagauuuggacaaaggagggagaacgcaaaaagcuccggcccagauggcuggacgcucgcaccuauuccgacccucuugcccugcgggaguuuaaagaguucgcugccggcagacgcucugugagcggggaucucauccuggagaucggaaagcugccccagcaucucacacagcgggcgcaaaaugcccuugacaaccuggugaugcugcacaauuccgaacagggcgggagagcuuaccggcaugccauggaggagcucccugauaccauugaaacacugaugcuucuggcucucaucgccguccugaccggaggcguuacgcuguuuuuccucucuggccgcgggcuuggaaagacaagcauuggccugcugugugugauggccuccagcgugcuccuguggauggcuucugucgagccccacuggaucgcggccuccauuauccuugaauuuuuccugauggugcuccugaucccggagccugacagacagcggacaccccaggauaaccaacuggcuuauguugugauugggcuccuuuuuaugauccugaccgucgccgccaaugagaugggacugcucgaaacaaccaaaaaggaccugggcauugggcacguggcugucgagaaccaucaccaugccgcgaugcuugauguggaccugcacccugccagcgcuuggacacucuacgccguugcuacgaccaucauuacacccaugaugcgccauaccaucgaaaacacaaccgccaauauuucucugacggcgaucgccaaccaggcugccauccugaugggacucgauaaaggcuggccuauuuccaagauggacaucggcgugccccuucuggcucuggggugcuacagccaggucaauccgcucacccugacagccgcugugcuuaugcugguugcccacuaugcgauuaucggaccuggccuccaagccaaagcuaccagagaggcccagaagcggacagcugccgggauuaugaagaaccccaccguggauggaaucgucgccaucgaccuggaucccgugguguacgacgcgaaauucgaaaagcagcugggccagauuaugcuccuuauccuguguacgucucaaauucugcucaugcgcacaaccugggcucugugcgagagcaucacacuugccaccgggccucugaccacacucugggagggauccccgggcaaauuuuggaauacgaccauugcuguuucuauggccaacaucuucagaggcagcuaucuggccggggcuggacuggccuucucccucaugaaaagccuuggcgggggacggcgcggcacaggggcgcagggagaaacccugggcgagaaauggaagagacagcugaaucagcucuccaagucugaauuuaacacauacaaacggagcggcaucauggaggucgacagauccgaagccaaggaggggcugaaacgcggagagaccacgaagcacgcugugucucggggcacagccaaacuuagaugguucguggaacgcaaucuggucaagcccgaggggaagguuauugaucucggauguggcagagggggauggagcuauuacugcgcuggccugaaaaaggugaccgaagugaaaggcuauaccaaagggggaccuggccaugaggaacccaucccuauggccacauacggguggaaccuggucaaacuccacuccggaaaggacguguuuuucauucccccugagaaaugugauacccuucugugcgacaucggcgagucuagcccgaaucccacaauugaagaggggagaacgcugcgcguucucaagaugguggaaccuuggcugcggggaaaccaauuuuguaucaagauucuuaaucccuacaugccuuccgucguggagacccuggagcagaugcagagaaaacauggcggcaugcucguucgcaacccccugagcagaaauucuacacacgaaauguauuggguguccugcgggaccggaaacaucgucagcgcggugaauaugacaucuagaaugcugcucaaccgcuucaccauggcccaccggaagccgacguacgagagagauguggaccugggcgcugggacccgccaugucgccguugaaccugagguggcuaaccuugauaucauuggacagagaaucgaaaauauuaaacacgagcauaaguccacauggcacuaugacgaggauaaccccuacaaaaccugggccuaucauggcagcuacgaagugaagcccucuggguccgcuagcuccauggucaauggagugguuaagcugcucacaaaaccuugggacgugauccccauggucacccaaauugccaugacagauaccacgccuuuuggccagcagcggguguucaaggagaaaguugacacacgcaccccgaaggcgaaaagaggcaccacacaaaucauggaagugacggcccgguggcuguggggguuucuuagcagaaacaagaagccccggaucuguacccgcgaggaguucacaagaaaaguccggucuaaugcugccauuggagcuguguuuguugacgagaaccaguggaauagcgccaaggaggccguggaagaugagcgcuucugggaccugguccacagagaacgggagcuccacaaacagggcaagugcgcgaccugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcgucgagggggagggacugcacaaacucggcuacauucugagagacaucucuaagauuccugggggaaauauguaugccgaugacacagcuggcugggauacccggaucacagaagacgaucuucagaacgaggccaaaaucaccgacauuauggaacccgagcaugcgcugcucgccaaggcuaucuuuaaacugacguaccaaaauaaggugguucgcgugcagagaccugccaagaacgggaccgucauggaugugauuagccggcgcgaccagagaggcuccggacaggugggcacauaugggcugaauaccuucacaaacauggaagcucaacucauccggcagauggagucugagggaauuuuuagccccuccgaacuggagaccccgaaccuugccgaaagaguucuggauuggcucgagaaauacggcguggaacgccugaagcggauggcgaucagcggggacgacugugucgugaaaccuaucgaugacagauucgccacggcucuuacagcccugaaugauaugggaaagguucgcaaagacauuccccagugggagccuucuaagggcuggaacgauuggcagcaagugcccuuuugcucccaccacuuccaucagcucaucaugaaggacgggcgggagauugucgugccuuguagaaaucaggaugaacuggucggccgcgcucgggugagccagggagccggcuggucucugagagagaccgcuugccucgggaaauccuaugcccaaauguggcagcugauguacuuucaccgccgggaccuuagacuggcggccaacgcuaucuguagcgccguucccguggauugggucccgacaucccgcaccacguggucuauucaugcccaccaucaguggaugaccacagaagacaugcucagcguguggaaucggguuuggaucgaggaaaacccuuggauggaggauaagacccacauuuccagcugggaggacgugcccuaucugggaaaaagagaagaccaauggugcggcucucuuaucgggcugacagcucgggccaccugggcgacaaauauccaggucgcuauuaaccaggugagacgccucaucggaaaugagaacuaccuggauuacaugaccuccaugaagcgguucaaaaaugaaagcgaccccgagggcgcccugugguga

SEQ ID NO: 19421 - RNA, 9879 nt, Artificial Sequence
  derived and/or modified CDS sequence (opt5) from DENV-1__KC762620__SS-prME
agcgugacaaugcuguucaugcuccugcccacagcccuugcuuuucaccugacgaccagaggcggggaaccucauaugaucguguccaagcaggaacggggaaagucucuccuguucaagacaagcgccggcguuaacaugugcacccuuauugcgauggaccugggggagcucugugaagauacaaugaccuacaagugcccccgcaucacagagaccgaacccgacgauguggacuguuggugcaaugcuacggagaccugggugacauauggaaccuguucccaaacaggcgagcacagacgggauaagcgcucuguugcccuggccccucauguggggcugggacucgaaaccagaacggagacauggaugagcuccgaaggcgcuuggaaacagauucagaagguugagaccugggcccugcggcaccccggcuuuacagugaucgcucuuuuccuggcccaugcgauugggaccucuaucacccagaagggaaucauuuuuauccuccugaugcuugucacaccuagcauggccaugcgcugcgugggcauugggaacagagacuucguugagggacuguccggcgcuacguggguggaugucgugcucgaacacgggagcugugugaccacaauggccaaagacaagcccacccuggauaucgagcugcucaaaacagaagucaccaauccugcuguucugcggaaacuuugcauugaggccaaaaucucuaacacgacaaccgacucccgcuguccgacccaaggagaagcgacacugguggaggagcaggauaccaauuuugugugcagacggacauucgucgaccgcggcuggggcaacggguguggacucuuuggcaaggggagccugauuacgugcgccaaguucaaaugcgugaccaaacuugaaggaaaaaucguucaguacgagaaucugaaguauucugugaucgucacagugcacaccggcgaucagcaucaaguugggaacgaaacaauugagcacggaaccacggcuaccaucacaccccaggccccuaccuccgaaauucagcucacagacuacggcgcucugacccuggacuguagccccagaacgggccucgauuuuaaugagauggugcugcuuacaaugaaagagaagucuuggcugguccauaaacagugguuccucgaccugccucuucccuggaccuccggggccagcacaucccaagaaaccuggaaccggcaggaucugcucgugaccuuuaagacagcccacgcuaagaaacaggaggucgugguucugggaucucaagaaggcgcgaugcacacggcccugaccggggcuacagagauccagaccagcggaacaaccacgauuuucgccggccaucucaagugccgccugaaaauggacaaacuuacacugaaagggguguccuaugucauguguaccggcagcuucaagcucgaaaaggagguggccgagacccagcacggaacaguucuggugcaggucaaauacgaaggcaccgaugcuccgugcaagaucccuuuuucuucccaagacgagagaggggugauccagaauggacggcugauuacagccaaccccaucgugacggauaaagaaaagccuguuaauauugaggcggagccgcccuucggcgaaagcuauaucgucgugggggcuggagagaaagcccuuaagcucucuugguuuaagaaaggcagcuccauugggaagauguucgaagccaccgcuagaggcgcccgccggauggcuauccugggagacacagccugggauuuuggcucuaucgggggaguguucaccagcgucggcaaacuggugcaucagauuuuugggacagcguacggaguucucuucuccggcgugagcuggaccaugaagaucgggauuggcauccugcuuacguggcugggacucaacucuagaaauaccucccugagcaugacauguauugccgucggcauggugacccuguaccuugggguuauggugcaggcugacucuggaugcgucaucaacuggaaaggccgcgagcucaaguguggguccggaauuuuugugacaaacgaaguucacaccuggacagagcaauauaaguuccaggccgauagcccuaaacggcuguccgcugccaucggcaaggcgugggaggaaggggugugcggcaucagaucugccacccgccuggagaauauuauguggaaacagaucagcaacgaacucaaucauauucugcuugagaacgacaugaaguuuacggucguggugggagacgucuccggcauccuggcucaggggaaaaagaugauucggccgcaacccauggaacacaaauacucuuggaaaagcuggggaaaggccaaaaucaucggcgcugauguucagaauacaaccuucauuaucgacgggccuaacacccccgaguguccugauaaucagagagccuggaacauuugggagguggaagacuauggauuuggcguguucacaaccaauaucuggcucaagcugcgcgauuccuacacgcaggucugcgaccaccggcugaugagcgccgcuauuaaagauucuaaggcggugcaugccgacaugggcuauuggaucgaguccgagaagaaugagacauggaaacuugaaagagcuagcuucaucgagguuaagaccuguauuuggccccgcucucacacacucugguccaauggggugcuggagagcgaaaugaucauuccgaaaaccuacggaggcccugucucucaacauaacuaucggcccggguacuuuacacagaccgccggaccuuggcaccugggcaagcucgagcuggauuucgaccuuugcgaagggacgaccgugguuguggaugagaauugcggaaacagaggccccagccugcggacaaccacagucaccggcaaaaucauucacgagugguguugccgcuccuguacgcucccuccccugagauuuaagggggaagacggaugcugguacggcauggagauccggccggugaaagaaaaggaggaaaaucugguuaagagcauggugucugccggguccggagaggucgauagcuucucccuuggccuccuguguaucucuauuaugaucgaggaagugaugagaagccgcugguccgggaaaaugcugaugacaggaacccucgcuguguuucugcuucugacaaugggccagcucaccuggaacgaccugauucggcugugcaucauggucggcgccaacgcgucugacaugauggggaugggaaccacauaucuugcucugauggccacguucagaaugcgcccuauguuugccguuggccuccuguucagacggcucaccagccgcgaggugcugcuucugacaguggggcucucccuggcugccucugucgaacugcccaauagccuugaggaacugggagauggccucgcgauggggauuaugaugcugaagcuccugaccgacuuucaaucccaucagcuuugggcuacacugcucagccugaccuucgugaaaacgacauuuucucugcacuacgccuggaagaccauggccaugauccuuuccauuguuagccuguucccccucugucugucuaccacaucccagaaaaccacauggcucccugugcugcuuggaagccugggcugcaagccgcugacgaugcuccugaucaccgagaacaagaucuggggcagacggucuuggcccauuaaugaggggaucauggcuauuggaaucgucuccauucuucugagcucccuccugaaaaacgaugugccucucgccggcccccugaucgcugggggaaugcuuaucgccuguuauguuauuagcggcucuagcgcggaccugucccuggaaaaggccgcugaggugucuugggaagaugaggccgaacauagcggggcuucccacaauauccucgucgaggugcaggacgauggaacaaugaaaauuaaggacgaggaacgcgaugacacccugacaauccuucugaaagccacccuccuggccauuucuggcgucuacccuaugagcauccccgcuacgcucuuugugugguauuucuggcaaaagaaaaagcagagauccggcguucugugggauaccccuucucccccggagguggaacgggcgguccuugacgaugggaucuaccgcauucugcagagaggacugcucggccggagccagguggggguuggaguguuccaagagggcgucuuucauacaauguggcacgugacccgcggggccgugcugauguaucagggaaagagacuugagccuuccugggcuagcguuaaaaaggaccugaucucuuacggcggcggguggcgguuccagggauccuggaacacaggcgaagagguccaggugauugccguggaacccgggaaaaauccuaagaacguccaaaccacacccggaacguuuaaaaccagcgagggcgaagugggggccaucgcucucgacuucaagccgggaacaucuggcuccccuauuguuaauagagagggcaagaucguggggcuguacggaaacggcgucgugaccaccagcgggacauauguuuccgccauugcgcaggcuaaagccucucaggagggaccccucccugaaaucgaggaugaaguguuucgcaagcggaaucugacgaucauggaccuucaccccggcagcgggaaaaccagacgcuaccugcccgccauucugcgggaggcuaucaagagaaaacuccgcacacugguccuugccccuacccgggugguugcguccgaaauggcugaggcccugaagggcaugccgauuagauaucaaacaaccgccgucaagagcgagcauacgggaaaagaaaucgucgaucucaugugccacgcuacauucaccaugcgccugcugucucccgugcgggugccuaacuacaauaugauuaucauggacgaggcccauuuuaccgaucccgcuuccaucgccgcgagaggcuauauuagcacacgggucgggaugggagaagccgcugccaucuucaugaccgcuacaccucccggcucuguugaggccuuuccucagagcaacgccgugauucaggacgaagaaagagauaucccggagagauccuggaacucuggguacgacuggauuaccgauuuccccggaaagacggugugguuugucccuagcaucaaauccggcaacgacaucgcuaacugucuccggaagaaugggaaacgcgugguucagcuuucuagaaagacauucgauaccgaauaucaaaagaccaagaauaaugacugggacuacguggucaccacggauauuagcgagaugggcgcgaacuuccgggccgacagagugaucgauccccgccggugccugaagccuguuauucugaaagacggacccgaaagagugauccucgcuggcccgaugccugucaccguggccuccgccgcucagcgccgggggagaauuggacgcaauagcaacaaggagggcgaucaguacgucuauauggggcagccccugaauaacgacgaggaucacgcccauuggacagaagcgaaaaugcuucuggacaauaucaacacccccgagggaauuaucccugcucucuuugaacccgagcgggaaaagucugccgccaucgauggcgaguacagacugcgcggggaggcuagaaagacauucguggaacugaugcggcgcggcgaccucccuguuuggcuuuccuauaaaguggccagcgagggauuucaauacuccgauagacgguggugcuucgacggcgaacgcaauaaccaggugcuggaggaaaauauggaugucgagauuuggaccaaggagggggaacgcaagaagcugcggccgagauggcucgacgcgcgcacauauucugacccccuggcccuucgggaguuuaaagaguucgcugccggaagacgcagcguuuccggcgaucugauccucgagauugggaagcugccucagcaccugacccagaaagcucaaaacgcccucgacaaucuugugaugcugcacaacucugaacagggaggcaaggcuuaccggcaugccauggaggagcugcccgauacgaucgaaacacucaugcugcuugcgcugauugccgugcucaccggcggggucacccuguuuuuccugagcggaagaggccucgggaagacauccaucggacuucugugugugauggcuagcucugcccugcucuggauggcuuccguugagccucacuggaucgccgccagcauuauccuggaauuuuuccuuauggugcugcucauucccgagccggaccggcagcgcaccccucaggauaaccaacuggcuuaugucgugaucggccugcucuuuaugauucuuacagucgcggccaaugagauggggcugcuggaaacgaccaaaaaggaccucggaaucggccaugcugccgccgagaaccaccaccaugcugccaugcuggauguggaccuucaccccgcgucugccuggacacuguacgcuguugccaccacaaucauuaccccuaugaugagacauacgaucgaaaauaccacagcuaacauuucccucaccgccaucgcgaaucaggccgcuauucugaugggccuggauaaaggguggcccaucagcaagauggacauuggagugccucuccuugcccugggcugcuacucucaggucaacccccugacacucaccgcugccgugcugaugcuuguugcucacuaugccaucaucgggccgggacugcaagcgaaagccacgcgggaggcucagaagcgcacagccgcuggcauuaugaagaauccuaccguggaugggaucgucgccauugaccucgaucccgugguguacgacgccaaauucgaaaagcagcugggacagaucaugcugcucauucuuuguacaagccaaauccugcugaugagaaccaccugggcgcucugcgaguccaucacacuggcuacgggcccccuuaccacacugugggagggcucuccugggaaauuuuggaacaccacaauugccguuagcauggcuaauaucuuccggggauccuaucucgccggcgccgggcuggcuuucagccugaugaagucccucggaggcgggcgcagaggaaccggcgcccagggcgaaacgcuuggggagaaauggaagcggcagcugaaccagcugucuaagagcgaauuuaauauuuacaaacgcuccggaaucauggaggucgacagaucugaagcgaaggagggccucaaaagaggggaaacaaccaagcaugccgugagccggggaaccgcuaaacugcgcugguucguggaacggaaccuugucaagccggagggcaagguuauugaucugggguguggaagaggcggcugguccuauuacugcgccgggcucaaaaaggugacagaagugaaaggauauaccaagggcgggcccggacacgaggaaccuguccccauggcuacauacggcuggaaucuggugaaacugcacucugggaaggacgucuuuuucacgccucccgagaaaugugauacccuccuuugcgacaucggagagagcuccccuaacccgacaaucgaagagggccgcacccugcgggugcugaagauggucgaacccuggcucagaggcaaucaauuuuguauuaagauccugaacccuuacaugcccagcgugguugagacacuugagcagaugcagcgcaaacaugggggaaugcuggugcggaauccucucucuagaaacuccacccacgaaauguauugggucagcugcggcacggggaacauugugucugccgugaauaugaccucccgcaugcugcugaaccgguucacaauggcgcauagaaagcccaccuacgagaaagaugucgaccucggagccggcacacgccacguugcuguggaaccggagguggccaaucuggauaucauugggcagcggaucgaaaacauuaagaaugagcacaaaagcaccuggcauuaugacgaggauaacccuuacaagacaugggcuuaucacggaucuuacgaagucaagcccuccggcagcgccuccagcauggugaauggcguugugagacuucugaccaaacccugggacgucaucccuauggugacgcaaaucgcuaugacagauaccacccccuuugggcagcagcgcguuuucaaggagaaaguggacacaagaacgccuaaggccaaacggggaaccgcgcaaauuauggaagucacagccaaguggcucuggggcuuucugucucgcaacaagaaaccgagaaucuguacccgggaggaguucacaagaaaggugcggagcaaugcugccauuggggcuguuuuuguggacgagaaccaguggaacuccgccaaagaggccgucgaagaugagcgcuucugggaccuugugcauagagaacgggagcugcacaagcagggaaaaugcgcgaccugcgucuauaacaugaugggcaagcgcgaaaagaaacucggggaguuuggcaaggcuaaaggaucuagagccaucugguacauguggcugggcgcccgguuccuggaguucgaagcucucggguuuaugaaugaggaucauugguucagccgcgaaaacucccugucuggaguggagggcgaggggcuucacaagcugggauacauucucagagacaucagcaaaauccccggcgggaaucuguaugccgaugacacagcuggcugggauacccggauuacggaagacgaucuucagaacgaggccaagaucaccgacauuauggaaccugagcacgcgcugcucgccacauccaucuuuaaacugaccuaccaaaacaagguugugcgcguccagagacccgcuaagaauggaacagugauggaugugauuucucggcgcgaccagagaggcagcgggcagguuggaaccuauggccugaacacguucacaaauauggaagcccaacucauccggcagauggaguccgaggggaucuuuagcccuucugaacuggagacccccaaccuugcuaaacgcgugcuggauuggcucgaaaagcauggaauugagagacugaaacggauggccaucuccggcgacgacugugucgugaagccgauugaugacagauucgcgacagcccuuaccgcucugaaugauauggggaaaguucgcaaggacaucccucagugggaacccagcaagggcuggaacgauuggcagcaagugccuuuuugcucucaccauuuccaccagcucauuaugaaagacggacgggagaucgucgugcccuguagaaaucaggaugagcugaucggccgcgcccgggucucccagggggcuggauggagccugagagaaacggccugccucggcaaguccuacgcucaaauguggcagcugauguauuuucaccgccgggaccuuagacuggccgcgaacgccauuuguucugcugugccuguugauugggugcccaccagccgcacaaccugguccauccaugcccaccaucaguggaugacaaccgaggacaugcucagcgucuggaaucggguguggauugaagagaacccguggauggaagauaaaacacacguuucuuccugggaggacgugccuuaccuggggaagagagaggaccaauggugcggaagccuuaucggccugaccgcccgcgcuacgugggccucuaauauucaggucgcgaucaaccaggugcggagacucauugggaaugaaaacuaucuggauuacaugacaagcaugaaacgguucaagaaugaguccgaccccgaaggcgcucugugguga

SEQ ID NO: 19422 - RNA, 9879 nt, Artificial Sequence
  derived and/or modified CDS sequence (opt5) from DENV-1__KC762631__SS-prME
agcgugaccaugcugcuuaugcugaugcccacagcccuugcuuuccaccugacgaccagaggaggggagccucauaugacaguguccaagcaggaacggggaaaaucucuccuguuuaagaccagcgccggcguuaacaugugcacacuuaucgcgauggaccugggggagcucugugaagauacccugacauacaaaugcccccgcauuaccgaggcugaacccgacgauguggacuguuggugcaaugccacggauaccugggugacauauggaaccuguucccaaacaggcgagcaccggcgggacaagcgcucugucgcccuggcuccucauguggggcucggacuggagaccagaacggaaacauggaugagcuccgagggcgccuggaaacagauccagcggguugaaaccugggcucuuagacaccccggcuucacagugauugcccuguuucucgcgcaugccaucgggaccucuauuacccagaagggaaucaucuucauucugcuuaugcuggucacaccuagcauggcuaugagaugcgugggcaucgggucccgggauuuuguugagggacucagcggcgccacguggguggacgucgugcuggagcacgggucuugugugaccacaauggcuaaggauaaacccacccuggacauugaacuccugaagacagaggucaccaacccugccguucuucgcaaacugugcaucgaagcgaagauuuccaauacgacaaccgauagcagauguccgacccaaggagaggccacacucguggaagaacaggacgcuaacuucgugugccggcgcaccuuugucgauagaggcuggggcaauggguguggacuguucggcaaagggucucuuaucacaugcgccaaguuuaagugcgugacgaaacuggagggaaagauuguucaguacgaaaaccucaaauauuccgugaucgucaccgugcacacaggcgaccagcaucaaguugggaaugagagcaccgaacacggaacaaccgcuacgaucacaccccaggccccuacaaccgagauucagcugacagacuacggcgcccugacccucgauuguucuccccggacgggccuggacuucaacgaaauggugcuucugacaaugaaggagaaauccuggcucguccauaagcagugguuucuggaucuuccucugcccuggaccagcggggcuuccacaucucaagagaccuggaaucgccaggaccuccuggugaccuucaaaacagcgcacgccaagaagcaggaagucgugguucugggaagccaagagggcgcuaugcacacggcccucaccggggccacagaaauccagaccuccggaacaaccacgauuuuugcuggccaucugaaaugcagacuuaagauggauaaacugacacucaaggggaugagcuaugugauguguaccggcucuuucaaacuggagaaggaagucgccgagacccagcacggaacagugcugguucagaucaaguacgagggcaccgacgcgccgugcaaaauuccuuucuccacacaagaugaaaagggggugacgcagaacggacggcuuaucaccgcuaaucccaucgucacagacaaagagaagccugugaacauugaagccgagccgcccuuuggcgagagcuauaucgugauuggggccggagaaaaagcucucaagcugucuugguucaagaaaggcagcuccaucgggaagauguuugaggccaccgcuagaggcgcccgccggauggcgauucugggagauacagccugggacuucggcucuaucgggggaguuuuuaccagcgucggcaaacucgugcaucagaucuucgggacggcuuacggagugcuguuuuccggcgucagcuggaccaugaagauugggaucggcgugcuucugacauggcucggacucaauucuagauccaccagccugucuaugacauguauugccguuggccuugugacccucuaccugggggucauggugcaggcugauuccggaugcguuaucaacuggaaaggccgcgaacugaagugugggagcggaauuuucgugacaaaugagguccacaccuggacggaacaauauaaguuucaggccgacuccccuaaacggcucucugcggccaucggcaaggcuugggaggagggggugugcggcauuagaagcgccacacgccuggaaaacaucauguggaaacagaucuccaacgagcuuaaucauauucugcucgaaaacgacaugaaguucaccguuguggucggagauguggcuggcauccuggcccaggggaaaaagaugauucggccgcaacccauggagcacaaauacucuuggaaaagcuggggaaaggccaagaucauuggcgcugacgugcagaauaccacauuuaucaucgaugggccuaacacccccgaauguccugacgaucagagagcguggaauauuugggaggucgaggacuauggauucggcaucuuuacgacaaacauuuggcugaaacuucgcgauuccuacacccagguuugcgaccaccggcucaugagcgccgcuaucaaagauucuaaggccgugcaugccgacaugggcuauuggauugaauccgagaaaaaugaaacauggaagcuggcuagagccagcuucaucgaggugaagaccuguaucuggcccaaaucucacacacugugguccaacgggguccucgaaagcgagaugauuaucccgaagauuuacggaggcccuaucucucaacauaauuaucgccccggguacuucacccagacggcgggaccuuggcaccugggcaaacuugagcuggauuuugaccucugcgaagggaccacagugguuguggaugagcacugcggaaaccggggccccagccugagaaccacaaccgucacgggcaagauuauccaugaaugguguugccgguccuguacacugccuccccuucgcuucagaggggaggacggaugcugguacggcauggagauccggccggugaaagaaaaggaggaaaaucucguuaagagcauggugucugcuggguccggagaggucgacagcuuuucccugggccugcucuguauuucuaucaugauugaagaggugaugagaagccgcuggucccggaaaaugcugaugaccgggacacuugccguuuucuuucugcucaucaugggacagcugaccuggaacgaucugauuagacuuugcaucauggugggcgccaaugcuucugaccgcaugggcauggggaccacauaucuggcccucauggcgacguucaagaugagaccuauguuugcugucggacugcuguuccggcgccugaccagcagagaggugcuucugcucacaauuggccugucccugguggccucugucgaacuucccaacagccuggaggaacucggggauggacuggccaugggcaucaugauccucaaacugcuuaccgacuuucaaucccaccagcugugggcuacacuccugagccugaccuucauuaagacgacauuuucucuucauuacgccuggaaaaccauggcuaugguucuguccaucgugagccucuucccccugugucucucuaccacaucccagaagaccacauggcugccugugcuucuggggagccugggaugcaagccgcucacgauguuucugauugccgagaauaaaaucuggggccggaagucuuggccccuuaacgaaggcauuauggcggucgggaucguguccauccugcucagcucccugcucaaaaacgauguuccucuggccggaccccuuauugcuggcgggaugcugaucgccuguuaugugauuagcggaucuagcgcugaccugucccucgagaaggccgccgaggucucuugggaagaggaagcugagcacagcggcgcgucccauaauauccugguggaaguucaggaugacgggaccaugaaaauuaaggaugaggagcgcgacgauacacuuaccauccugcucaaagccacacugcucgcugugucuggagucuacccucugagcauccccgccacccuuuucgugugguauuucuggcaaaagaagaaacagagauccggcguccugugggacacgccuucucccccggaaguggagcgggccguucuggaugacggcauuuaccgcaucaugcagagagggcuccugggacggagccaggugggcgucgggguguuucaagaaaaccuuuuccacaccauguggcacguuacacgcggagcugugcugauguaucagggcaagagacucgagccuuccugggccagcgucaaaaaggaccugauuucuuacgggggaggcuggcggcuccagggcuccuggaauaccggggaggaaguccaggugaucgcgguugagcccggcaagaauccuaagaauguccaaacagcucccggcaccuuuaagacaccggaaggggaggugggagccauugcccuggauuucaaaccuggcacgagcgggucucccaucgugaacagagaaggaaagauugucggccuuuacggcaauggggugguuaccacauccggaaccuaugugagcgcuaucgcccaggcgaaggcuucccaggagggcccucugcccgagaucgaagacgaggucuuucgcaagcggaaccugaccauuauggaucuccaucccgggucuggaaaaacaagacgcuaccugccugccaucgugcgggaagccauuaagagaaaacuucgcacgcugauccucgcuccgacccggguuguggccagcgagauggcugaagcccugaaaggcaugcccauuagauaucaaacaaccgcggucaaguccgagcacacagggaaagagaucguggaccugaugugccaugccaccuucacgaugcgccuccuuagcccuguucgggugcccaauuacaacaugaucauuauggaugaagcucacuuuacagacccuucuuccaucgccgcuagaggcuauauuagcacccgggucggaaugggcgaggccgccgcuaucuucaugaccgcgacacccccugggucuguggaagccuuuccgcagagcaaugcugugauucaggaugaggaacgcgacauccccgagagauccuggaaccugggauacgaguggaucaccgauuucccuggcaagacagucugguuuguucccucuauuaaaagcgggaaugacaucgccaacugucugcggaagaauggaaagcgcgugauucagcucuccagaaaaaccuucgauacggaauaucaaaagaccaagaacaacgacugggacuacguggucaccacagauaucucugagaugggcgccaauuuccgggcugacagagugauugauccucgccggugccugaagcccguuauccuuaaagacgggccggaaagagugauucuggccggcccuaugcccgucaccguggcgagcgcugcccagcgccggggaagaguuggccgcaaccauaauaaggagggggaucaguacaucuauaugggacagccccucaacaaugacgaggaucacgcccacuggacggaagcuaagaugcugcuggacaacaucaauaccccugagggcauuauccccgcccucuuugaaccugagcgggaaaaauccgcggccauugauggggaguacagacuucgcggagaggcuagaaagacauucguggaacugaugcggcgcggcgaccugccggucuggcucagcuauaaaguggccucugagggguuucaauacuccgauagacgguggugcuucgacggcgaacgcaacaaucagguccuggaggaaaacauggauguggagaucuggaccaaggagggagaacgcaagaaacuucggcccagauggcuggacgcucgcacauauagcgacccucucgcccugcgggaguuuaaagaguucgcugccggcagacgcuccguuucuggggaucugauucucgagaucggaaaacuuccccagcaucugacccagcgggcgcaaaaugcccuggacaaccucgugaugcugcacaauagcgaacagggcgggagagcuuaccggcaugccauggaggagcuuccugaaacaaucgagacccugaugcuccuggcucugauugccgugcucacgggaggcgucacacucuuuuuccuguccggccgcgggcugggaaagaccucuaucggccuccuguguguuauggccagcuccgugcuucuguggauggcuagcguggaaccccacuggauugcggccucuaucauucucgaguuuuuccugaugguccugcucaucccggagccugauagacagcggacaccccaggacaaccaacuugcuuaugugguuaucgggcugcuguuuaugauucucacaguggccgccaaugaaaugggacugcuugagaccaccaagaaggaucugggcaucgggcacgucgcuguggaaaaccaucaccaugccgcgaugcucgacgucgaucugcacccugccuccgcuuggacgcuguacgccguggcuaccacaauuaucacccccaugaugcgccauacaauugagaacaccacggccaauaucagccucaccgcgauugccaaccaggcugccauccuuaugggacuggacaaaggcuggccuaucucuaagauggauauuggcguuccccugcucgcucuggggugcuacucccaggugaauccgcuuacacugaccgccgcuguccucaugcugguggcccacuaugcgaucauuggaccuggccugcaagccaaagcuacaagagaagcccagaagcggaccgcugccgggaucaugaagaaccccacgguugacggaauuguggccaucgaucucgaccccgucguguacgaugcgaaauucgagaagcagcuuggccagaucaugcugcugauucucuguacaagccaaauccugcuuaugcgcaccacaugggcucugugcgagucuauuacccucgccaccgggccucugacaacgcugugggaaggaagcccgggcaaauuuuggaauaccacaaucgcuguguccauggccaacauuuucagaggcucuuaucucgccggggcuggacuugccuucagccugaugaagucccugggcgggggacggcgcggcaccggggcgcagggagagacacucggcgaaaaauggaagagacagcugaaucagcuuagcaaguccgaguuuaacaccuacaaacggucuggcaucauggaaguugacagaagcgaggccaaggaggggcugaaacgcggagaaacgacaaagcacgcugucucccggggcaccgccaaacucagaugguucguggagcgcaaucuggugaagcccgaagggaaggucaucgaccugggauguggcagagggggauggucuuauuacugcgcuggccucaaaaagguuaccgaggugaaaggcuauacaaaagggggaccuggccaugaggaacccauuccuauggccaccuacggguggaaccuugugaaacugcacagcggaaaggaugucuuuuucauucccccugagaaaugugacacacugcucugcgauaucggcgaauccucuccgaaucccacgaucgaggaagggagaacccugcgcgugcuuaagaugguugagccuuggcugcggggaaaccaauuuuguauuaagauccucaaucccuacaugccuagcguggucgagacacuggaacagaugcagagaaaacauggcggcaugcuggugcgcaacccccucucccggaauagcacccacgagauguauuggguuucuugcgggacaggaaacauuguguccgcggucaauaugaccagcagaaugcugcuuaaccgcuucacgauggcccaccggaagccgaccuacgaaagagacguggaucugggcgcugggacacgccauguggccgucgagccugaaguugcuaaccucgacaucaucggacagagaauugagaauaucaaacacgagcauaagucuaccuggcacuaugaugaagacaaccccuacaaaacaugggccuaucauggcuccuacgaggugaagcccagcgggucugcuuccagcauggugaauggagucgugaagcugcuuaccaaaccuugggauguuauucccauggugacacaaaucgccaugaccgacacgacaccuuuuggccagcagcgggucuucaaggaaaaaguggauacccgcaccccgaaggcgaaaagaggcacaacgcaaauuauggagguuaccgcccgguggcuguggggguuucucuccagaaacaagaagccccggaucuguacacgcgaagaguucaccagaaaagugcggagcaaugcugccaucggagcugucuuuguggacgagaaccaguggaacucugccaaggaagccguugaggacgaacgcuucugggagcuggugcacagagaacgggagcugcacaaacagggcaagugcgcgacaugcgucuauaacaugauggggaaacgcgagaagaagcucggagaauuuggcaaagcuaaggggagcagagccauuugguacauguggcugggcgcccgguuccuugaguucgaagcucugggauuuaugaaugaggaucauugguucucccgcgagaacucucucagcggcguggaaggggagggacugcacaaacuuggcuacauccugagagacauuuccaagaucccugggggaaauauguaugccgaugacaccgcuggcugggauacacggauuaccgaagacgaucuccagaacgaggccaaaaucacggacaucauggaacccgagcaugcgcugcuggccaaggcuauuuuuaaacucaccuaccaaaauaaggucgugcgcguucagagaccugccaagaacgggacagugauggaugucaucucucggcgcgaccagagaggcagcggacaggugggcaccuaugggcugaauacauucaccaacauggaggcucaacuuauucggcagauggaauccgagggaaucuuuucucccagcgaacuggagacgccgaaccucgccgaaagagugcuggauuggcuugagaaauacggcguugagcgccugaagcggauggcgauuuccggggacgauuguguggucaaaccuaucgacgacagauucgccacagcucucaccgcccugaaugauaugggaaaggugcgcaaagacaucccccagugggaaccuagcaagggcuggaacgauuggcagcaaguucccuuuugcucucaccacuuccaucagcugauuaugaaggacgggcgggagaucguggucccuuguagaaaucaggaugaacucgugggccgcgcucgggucucccagggagccggcuggagccugagagagacagcuugccuugggaaaucuuaugcccaaauguggcagcugauguacuuucaccgccgggaccucagacuggcggccaacgcuauuuguuccgccgugcccguugauugggugccgaccagccgcacgaccugguccauccaugcccaccaucaguggaugacaaccgaagacaugcuuucugucuggaaucggguguggauugaggagaacccuuggauggaagauaagacacacaucagcuccugggaggacguucccuaucugggaaaaagagaagaucaauggugcggcagccucauugggcugaccgcucgggccacaugggcgaccaauauccagguggcuaucaaccaggucagacgccugauuggaaaugagaacuaccucgacuacaugacgucuaugaagcgguucaaaaaugaguccgaccccgaaggcgcccugugguga

SEQ ID NO: 19423 - RNA, 9879 nt, Artificial Sequence
  derived and/or modified CDS sequence (opt5) from DENV-1__KC762621__SS-prME
agcgugacaaugcugcucaugcugaugcccacagcccuugcuuuccaccugacgacccggggaggggaaccucauaugaucgucuccaagcaggaacggggaaaaucucuccuguuuaagacaagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuacaucucaacauaauuaucgccccggguacuucacccagacggcgggaccuuggcaccugggcaaacuugagcuggauuuugaccucugcgaagggaccacagugguuguggaugagcacugcggaaaccggggccccagccugagaaccacaaccgucacgggcaagauuauccaugaaugguguugccgguccuguacacugccuccccuucgcuucagaggggaggacggaugcugguacggcauggagauccggccggugaaagaaaaggaggaaaaucucguuaagagcauggugucugcuggguccggagaggucgacagcuuuucccugggccugcucuguauuucuaucaugauugaagaggugaugagaagccgcuggucccggaaaaugcugaugaccgggacacuugccguuuucuuucugcucaucaugggacagcugaccuggaacgaucugauuagacuuugcaucauggugggcgccaaugcuucugaccgcaugggcauggggaccacauaucuggcccucauggcgacguucaagaugagaccuauguuugcugucggacugcuguuccggcgccugaccagcagagaggugcuucugcucacaauuggccugucccugguggccucugucgaacuucccaacagccuggaggaacucggggauggacuggccaugggcaucaugauccucaaacugcuuaccgacuuucaaucccaccagcugugggcuacacuccugagccugaccuucauuaagacgacauuuucucuucauuacgccuggaaaaccauggcuaugguucuguccaucgugagccucuucccccugugucucucuaccacaucccagaagaccacauggcugccugugcuucuggggagccugggaugcaagccgcucacgauguuucugauugccgagaauaaaaucuggggccggaagucuuggccccuuaacgaaggcauuauggcggucgggaucguguccauccugcucagcucccugcucaaaaacgauguuccucuggccggaccccuuauugcuggcgggaugcugaucgccuguuaugugauuagcggaucuagcgcugaccugucccucgagaaggccgccgaggucucuugggaagaggaagcugagcacagcggcgcgucccauaauauccugguggaaguucaggaugacgggaccaugaaaauuaaggaugaggagcgcgacgauacacuuaccauccugcucaaagccacacugcucgcugugucuggagucuacccucugagcauccccgccacccuuuucgugugguauuucuggcaaaagaagaaacagagauccggcguccugugggacacgccuucucccccggaaguggagcgggccguucuggaugacggcauuuaccgcaucaugcagagagggcuccugggacggagccaggugggcgucgggguguuucaagaaaacguuuuccacaccauguggcacgugacacgcggagcuguccuuauguaucagggcaagagacuggagccuuccugggccagcgugaaaaaggaccucauuucuuacgggggaggcuggcggcugcagggcuccuggaauaccggggaggaagugcagguuaucgcggucgagcccggcaagaacccuaagaaugugcaaacagcucccggcaccuuuaagacaccggaaggggaggugggagccauugcccucgauuucaaaccuggcacgagcgggucucccaucgucaacagagaaggaaagauugugggccuguacggcaaugggguugugaccacauccggaaccuaugucagcgcuaucgcccaggcgaaggcuucccaggagggcccucuucccgagaucgaagacgagguguuucgcaagcggaaccugaccauuauggaucugcaucccgggucuggaaaaacaagacgcuaccucccugccaucguucgggaagccauuaagagaaagcugcgcacgcuuauccuggcuccgacccggguggucgccagcgagauggcugaagcccucaaaggcaugcccauuagauaucaaacaaccgcggugaaguccgagcacacagggaaagagaucguugaccugaugugccaugccaccuucacgaugcgccugcucagcccugugcggguccccaauuacaacaugaucauuauggaugaagcucacuuuacagacccuucuuccaucgccgcuagaggcuauauuagcacccgggugggaaugggcgaggccgccgcuaucuucaugaccgcgacacccccugggucuguggaagccuuuccgcagagcaaugcugucauucaggaugaggaacgcgacauccccgagagauccuggaacucuggauacgaguggaucaccgauuucccuggcaagacaguuugguuugugcccagcauuaaauccgggaaugacaucgccaacugucuucggaagaauggaaagcgcgugauucagcugucuagaaaaaccuucgauacggaauaucaaaagaccaagaacaacgacugggacuacgucgugaccacagauaucagcgagaugggcgccaauuuccgggcugacagaguuauugauccucgccggugccugaagcccgugauccucaaagacgggccggaaagagucauucuggccggcccuaugcccgugaccguugcguccgcugcccagcgccggggaagagugggccgcaaccauaauaaggagggggaucaguacaucuauaugggacagccccuuaacaaugacgaggaucacgcccacuggacggaagcuaagaugcugcucgacaacaucaauaccccugagggcauuauccccgcccuguuugaaccugagcgggagaaaagcgcggccauugauggggaguacagacugcgcggagaggcuagaaagacauucgucgaacucaugcggcgcggcgaccuuccgguguggcugucuuauaaagucgccuccgagggguuucaauacagcgauagacgguggugcuucgacggcgaacgcaacaaucaggugcuggaggaaaacauggauguugagaucuggaccaaggagggagaacgcaaaaagcuccggcccagauggcuggacgcucgcacauauuccgacccucuugcccugcgggaguuuaaagaguucgcugccggcagacgcucugugagcggggaucucauucuggagaucggaaagcugccccagcaucucacccagcgggcgcaaaaugcccuugacaaccuggugaugcugcacaauuccgaacagggcgggagagcuuaccggcaugccauggaggagcucccugauacaaucgaaacccugaugcuucuggcucucauugccguccugacgggaggcguuacacuguuuuuccucucuggccgcgggcuuggaaagaccagcaucggccugcugugugugauggccuccagcgugcuccuguggauggcuucugucgagccccacuggauugcggccuccaucauucuugaauuuuuccugauggugcuccugaucccggagccugacagacagcggacaccccaggauaaccaacuggcuuauguugugaucgggcuccuuuuuaugauucugacagucgccgccaaugagaugggacugcucgaaaccaccaaaaaggaccugggcaucggguacguggcugucgagaaccaccaucacgccgcgaugcuugauguggaccugcauccugccagcgcuuggacgcucuacgccguugcuaccacaauuaucacccccaugaugcgccacacaauugaaaacaccacggccaauaucucucugaccgcgauugccaaccaggcugccauccugaugggacucgauaaaggcuggccuaucuccaagauggacauuggcgugccccuucuggcucuggggugcuauagccaggucaauccgcucacacugaccgccgcugugcuuaugcugguugcccauuacgcgaucauuggaccuggccuccaagccaaagcuacaagagaggcccagaagcggaccgcugccgggaucaugaagaaccccacgguggauggaauugucgccaucgaccuggaucccgugguguaugacgcgaaauucgaaaagcagcugggccagaucaugcuccuuauucuguguacaucucaaauccugcucaugcgcaccacaugggcucugugcgagagcauuacccuugccaccgggccucugacaacgcucugggagggauccccgggcaaauuuuggaauaccacaaucgcuguuucuauggccaacauuuucagaggcagcuaccuggccggggcuggacuggccuucucccucaugaaaagccuuggcgggggacggcgcggcaccggggcgcagggagaaacacugggcgagaaauggaagagacagcugaaucagcucuccaagucugaauuuaacaccuauaaacggagcggcaucauggaggucgacagauccgaagccaaggaggggcugaaacgcggagagacgacaaagcacgcugugucucggggcaccgccaaacuuagaugguucguggaacgcaaucuggucaagcccgaggggaagguuaucgaucucggauguggcagagggggauggagcuacuauugcgcuggccugaaaaaggugaccgaagugaaaggcuacacaaaagggggaccuggccacgaggaacccauuccuauggccaccuacggguggaaccuggucaaacuccauuccggaaaggacguguuuuucauucccccugagaaaugugauacacuucugugcgacaucggcgagucuagcccgaaucccacgaucgaagaggggagaacccugcgcguucucaagaugguggaaccuuggcugcggggaaaccaauuuuguauuaagauccuuaaucccuauaugccuuccgucguggagacacuggagcagaugcagagaaaacacggcggcaugcucguucgcaacccccugagcagaaauucuacccaugaaauguacuggguguccugcgggacaggaaacauugucagcgcggugaauaugaccucuagaaugcugcucaaccgcuucacgauggcccaccggaagccgaccuaugagagagauguggaccugggcgcugggacacgccacgucgccguugaaccugagguggcuaaccuugauaucaucggacagagaauugaaaauaucaaacaugagcacaaguccaccuggcauuacgacgaggauaaccccuauaaaacaugggccuaccacggcagcuaugaagugaagcccucuggguccgcuagcuccauggucaauggagugguuaagcugcucaccaaaccuugggacgugauucccauggucacacaaaucgccaugaccgauacgacaccuuuuggccagcagcggguguucaaggagaaaguugacacccgcaccccgaaggcgaaaagaggcacaacgcaaauuauggaagugaccgcccgguggcuguggggguuucuuagcagaaacaagaagccccggaucuguacacgcgaggaguucaccagaaaaguccggucuaaugcugccaucggagcuguguuuguugacgagaaccaguggaauagcgccaaggaggccguggaagaugagcgcuucugggaccugguccauagagaacgggagcuccacaaacagggcaagugcgcgacaugcguguacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcgucgagggggagggacugcauaaacucggcuauauccugagagacauuucuaagaucccugggggaaauauguacgccgaugacaccgcuggcugggauacacggauuaccgaagacgaucuucagaacgaggccaaaaucacggacaucauggaacccgagcacgcgcugcucgccaaggcuauuuuuaaacugaccuaucaaaauaaggugguucgcgugcagagaccugccaagaacgggacagucauggaugugaucagccggcgcgaccagagaggcuccggacaggugggcaccuacgggcugaauacauucaccaacauggaagcucaacucauucggcagauggagucugagggaaucuuuagccccuccgaacuggagacgccgaaccuugccgaaagaguucuggauuggcucgagaaauauggcguggaacgccugaagcggauggcgauuagcggggacgacugugucgugaaaccuaucgaugacagauucgccacagcucuuaccgcccugaaugauaugggaaagguucgcaaagacaucccccagugggagccuucuaagggcuggaacgauuggcagcaagugcccuuuugcucccaucacuuccaccagcucauuaugaaggacgggcgggagaucgucgugccuuguagaaaucaggaugaacuggucggccgcgcucgggugagccagggagccggcuggucucugagagagacagcuugccucgggaaauccuacgcccaaauguggcagcugauguauuuucaucgccgggaccuuagacuggcggccaacgcuauuuguagcgccguucccguggauugggucccgaccucccgcacgaccuggucuauccacgcccaucaccaguggaugacaaccgaagacaugcucagcguguggaaucggguuuggauugaggaaaacccuuggauggaggauaagacacauguguccagcugggaggacguccccuaccugggaaaaagagaagaccaauggugcggcucucuuaucgggcugaccgcucgggccacaugggcgaccaauauucagguggcuaucaaccaggugagacgccucaucggaaaugagaacuaccuggauuauaugacguccaugaagcgguucaaaaaugaaagcgaccccgagggcgcccugugguga

SEQ ID NO: 19424 - RNA, 9879 nt, Artificial Sequence
  derived and/or modified CDS sequence (opt5) from DENV-1__KC762643__SS-prME
agcgugaccaugcugcugaugcugaugcccacagcccuugcuuuccaccugacgacccggggaggggaaccucauaugaucgucuccaagcaggaacggggaaaaucucuccuguuuaagacaagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucuguugcccuggcuccucauguggggcucggacuggagacaagaaccgaaacguggaugagcuccgagggcgccuggaaacagauucagcggguugaaacaugggcucuuagacaccccggcuucaccgugauggcccuguuucucgcgcaugccaucgggacaucuauuacccagaagggaaucaucuucauucugcuuaugcuggucaccccuagcauggcuaugagaugcgugggcaucgggucccgggauuuuguugagggacucagcggcgccacauggguggacgucgugcuggagcacgggucuugugugacgaccauggcuaaggauaaacccacacuggacauugaacuccugaagaccgaggucacaaacccugccguucuucgcaaacugugcaucgaagcgaagauuuccaauaccacgacagauagcagauguccgacccaaggagaggccacccucguggaagaacaggacgcuaacuucgugugccggcgcacauuugucgauagaggcuggggcaauggguguggacuguucggcaaagggucucuuaucacaugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguucucacaagcgucggcaaacuggugcaucagaucuuugggaccgcuuacggagugcuuuucuccggcgucagcuggacgaugaagauugggaucggcgugcugcucaccuggcugggacucaauucuagauccacaagccuuucuaugaccuguauugccguuggccucgugacacuguaccugggggucauggugcaggcugauuccggaugcguuaucaacuggaaaggccgcgaacucaagugugggagcggaauuuuugugaccaaugagguccacacauggaccgaacaauauaaguuccaggccgacuccccuaaacggcugucugcggccaucggcaaggcuugggaggagggggugugcggcauuagaagcgccacgcgccuugaaaacaucauguggaaacagaucuccaacgagcugaaucauauucuccuggaaaacgacaugaaguuuacaguuguggucggagauguggcuggcauccuggcccaggggaaaaagaugauucggccgcaacccauggagcacaaauacucuuggaaaagcuggggaaaggccaagaucauuggcgcugacgugcagaauaccaccuucaucaucgaugggccuaacacacccgaauguccugacgaucagagagcguggaauauuugggaggucgaggacuauggauuuggcaucuucaccacgaacauuuggcuuaagcuccgcgauuccuacacacagguuugcgaccaccggcugaugagcgccgcuaucaaagauucuaaggccgugcaugccgacaugggcuauuggauugaauccgagaaaaaugaaaccuggaagcuggcuagagccagcuuuaucgaggugaagacauguaucuggcccaaaucucacacccucugguccaacgggguccuggaaagcgagaugauuaucccgaagauuuacggaggcccuacaucucaacauaauuaucgccccggguacuucacccagacggcgggaccuuggcaccuuggcaaacuggagcucgauuucgaccugugcgaagggaccacagugguuguggaugagcacugcggaaaccggggccccagccugagaaccacaaccgucacgggcaagaucauucaugaaugguguugccgguccuguacacuuccuccccuccgcuuuagaggggaggacggaugcugguacggcauggagauccggccggugaaagaaaaggaggaaaaucugguuaagagcauggugucugcuggguccggagaggucgacagcuucucccugggccuccuguguaucucuauuaugaucgaagaggugaugagaagccgcuggucccggaaaaugcuuaugaccgggacacuggccgucuuuuuccuccugauuaugggacagcugaccuggaacgaucuuaucagacugugcauuauggugggcgccaaugcuucugaccgcaugggcauggggaccacauaucucgcccugauggcgacguuuaagaugagaccuauguucgcugucggacuccuguuucggcgccuuaccagcagagaggugcugcuccugacaaucggccugucccuuguggccucugucgaacugcccaacagccucgaggaacugggggauggacucgccaugggcauuaugauccugaaacuucugaccgacuuccaaucccaccagcucugggcuacacugcugagccuuaccuuuaucaagacgacauucucucugcauuacgccuggaaaaccauggcuaugguucucuccauugugagccuguuuccccucugucugucuaccacaucccagaagaccacauggcuuccugugcugcuggggagccucggaugcaagccgcugacgauguuccuuaucgccgagaauaaaauuuggggccggaagucuuggccccugaacgaaggcaucauggcggucgggauuguguccauccuccugagcucccuccugaaaaacgauguuccucuugccggaccccugaucgcuggcgggaugcugauugccuguuaugugaucagcggaucuagcgcugaccucucccuggagaaggccgccgaggucucuugggaagaggaagcugagcacagcggcgcgucccauaauauucuuguggaaguucaggaugacgggaccaugaaaaucaaggaugaggagcgcgacgauacacugaccauucuccugaaagccacacuccuggcugugucuggagucuacccucuuagcauccccgccacccuguuugugugguauuucuggcaaaagaagaaacagagauccggcguccugugggacacgccuucucccccggaaguggagcgggccguucucgaugacggcaucuaccgcauuaugcagagagggcugcuuggacggagccaggugggcgucgggguguuccaagaaaacguuuuucacaccauguggcacgugacacgcggagcuguccugauguaucagggcaagagacucgagccuuccugggccagcgugaaaaaggaccugaucucuuacgggggaggcuggcggcuccagggcuccuggaauaccggggaggaagugcagguuauugcggucgagcccggcaagaacccuaagaaugugcaaacagcucccggcaccuucaagacaccggaaggggaggugggagccaucgcccuggauuuuaaaccuggcacgagcgggucucccauugucaacagagaaggaaagaucgugggccuuuacggcaaugggguugugaccacauccggaaccuaugucagcgcuauugcccaggcgaaggcuucccaggagggcccucugcccgagaucgaagacgagguguuccgcaagcggaaccugaccaucauggaucuccaucccgggucuggaaaaacaagacgcuaccugccugccauuguucgggaagccaucaagagaaaacuucgcacgcugauucucgcuccgacccggguggucgccagcgagauggcugaagcccugaaaggcaugcccaucagauaucaaacaaccgcggugaaguccgagcacacagggaaagagauuguugaccugaugugccaugccaccuuuacgaugcgccuccuuagcccugugcggguccccaauuacaacaugaucaucauggaugaagcucacuucacagacccuucuuccauugccgcuagaggcuauaucagcacccgggugggaaugggcgaggccgccgcuauuuuuaugaccgcgacacccccugggucuguggaagccuucccgcagagcaaugcugucauccaggaugaggaacgcgacauucccgagagauccuggaacucuggauacgaguggaucaccgauuuuccuggcaagacaguuugguucgugcccagcaucaaauccgggaaugacauugccaacugucugcggaagaauggaaagcgcgugauccagcugucuagaaaaaccuuugauacggaauaucaaaagaccaagaacaacgacugggacuacgucgugaccacagauauuagcgagaugggcgccaauuuccgggcugacagaguuaucgauccucgccggugccucaagcccgugauucugaaagacgggccggaaagagucauccuugccggcccuaugcccgugaccguugcguccgcugcccagcgccggggaagagugggccgcaaccauaauaaggagggggaucaguacauuuauaugggacagccccugaacaaugacgaggaucacgcccacuggacggaagcuaagaugcuccuggacaacaucaauaccccugagggcaucauucccgcccuguucgaaccugagcgggagaaaagcgcggccaucgauggggaguacagacuccgcggagaggcuagaaagacauuugucgaacuuaugcggcgcggcgaccugccgguguggcugucuuauaaagucgccuccgagggguuccaauacagcgauagacgguggugcuuugacggcgaacgcaacaaucaggugcucgaggaaaacauggauguugagauuuggaccaaggagggagaacgcaaaaagcugcggcccagauggcuugacgcucgcacauauuccgacccucuggcccuccgggaguucaaagaauuugcugccggcagacgcucugugagcggggaucugauccuggagauuggaaagcucccccagcaucuuacccagcgggcgcaaaaugcccuggacaaccuggugaugcuccacaauuccgaacagggcgggagagcuuaccggcaugccauggaggagcugccugauacaaucgaaacccuuaugcugcucgcucugaucgccguccugacgggaggcguuacacucuucuuucuuucuggccgcgggcugggaaagaccagcauuggccugcucugugugauggccuccagcgugcugcuuuggauggcuucugucgagccccacuggaucgcggccuccauuauccuggaguucuuucucauggugcugcugauuccggagccugacagacagcggacaccccaggauaaccaacucgcuuauguugugaucgggcuucuguucaugauccugacagucgccgccaaugagaugggacuccuggaaaccaccaaaaaggaccuuggcauugggcacguggcugucgagaaccaucaccaugccgcgaugcuggauguggaccuccacccugccagcgcuuggacgcuguacgccguugcuaccacaaucauuacccccaugaugcgccauacaaucgaaaacaccacggccaauauuucucugaccgcgaucgccaaccaggcugccauucucaugggacuugauaaaggcuggccuaucuccaagauggacaucggcgugccccugcuggcucucgggugcuacagccaggucaauccgcugacacuuaccgccgcugugcugaugcucguugcccacuaugcgauuaucggaccuggccugcaagccaaagcuacaagagaggcccagaagcggaccgcugccgggauuaugaagaaccccacgguggauggaaucgucgccauugaccuggaucccgugguguacgacgcgaaauuugaaaagcagcucggccagaucaugcuucugauccuguguacaucucaaauucuccugaugcgcaccacaugggcucuuugcgagagcaucacccuggccaccgggccucucacaacgcugugggagggauccccgggcaaauucuggaauaccacaauugcuguuucuauggccaacaucuuuagaggcagcuaucuggccggggcuggacucgccuucucccuuaugaaaagccugggcgggggacggcgcggcaccggggcgcagggagaaacacugggcgagaaauggaagagacagcucaaucagcuguccaagucugaguucaacaccuacaaacggagcggcauuauggaggucgacagauccgaagccaaggaggggcuuaaacgcggagagacgacaaagcacgcugugucucggggcaccgccaaacugagaugguuuguggaacgcaaucucgucaagcccgaggggaagguuaucgaucugggauguggcagagggggauggagcuauuacugcgcuggccugaaaaaggugaccgaagugaaaggcuauacaaaagggggaccuggccaugaggaacccaucccuauggccaccuacggguggaaccucgucaaacuucacuccggaaaggacguguucuuuauucccccugagaaaugugauacacugcugugcgacaucggcgagucuagcccgaaucccacgauugaagaggggagaacccuccgcguucugaagaugguggaaccuuggcuucggggaaaccaauucuguaucaagauucugaaucccuacaugccuuccgucguggagacacucgagcagaugcagagaaaacauggcggcaugcugguucgcaacccccugagcagaaauucuacccacgaaauguauuggguguccugcgggacaggaaacaucgucagcgcggugaauaugaccucuagaaugcuccugaaccgcuuuacgauggcccaccggaagccgaccuacgagagagauguggaccuuggcgcugggacacgccaugucgccguugaaccugagguggcuaaccuggauauuaucggacagagaaucgaaaauauuaaacacgagcauaaguccaccuggcacuaugacgaggauaaccccuacaaaacaugggccuaucauggcagcuacgaagugaagcccucuggguccgcuagcuccauggucaauggagugguuaagcuccugaccaaaccuugggacgugauccccauggucacacaaauugccaugaccgauacgacaccuuucggccagcagcggguguuuaaggagaaaguugacacccgcaccccgaaggcgaaaagaggcacaacgcaaaucauggaagugaccgcccgguggcuuuggggguuccugagcagaaacaagaagccccggauuuguacacgcgaggaauuuaucagaaaaguccggucuaaugcugccaucggagcuguguucguugacgagaaccaguggaauagcgccaaggaggccguggaagaugagcgcuuuugggaccucguccacagagaacgggagcugcacaaacagggcaagugcgcgaccugcguguauaacaugauggggaaacgcgaaaagaagcugggagaguucggcaaagcuaagggguccagagccauuugguacauguggcucggcgcccgguuucuggaguucgaagcucuuggauucaugaaugaggaucauugguuuucucgcgaaaacagccuguccggcgucgagggggagggacuccacaaacugggcuacauccuuagagacauuucuaagaucccugggggaaauauguaugccgaugacacagcuggcugggauacccggauuacagaagacgaucugcagaacgaggccaaaaucaccgacaucauggaacccgagcaugcgcuccuggccaaggcuauuuucaaacugacguaccaaaauaaggugguucgcgugcagagaccugccaagaacgggaccgucauggaugugaucagccggcgcgaccagagaggcuccggacaggugggcacauaugggcucaauaccuuuacaaacauggaagcucaacugauucggcagauggagucugagggaaucuucagccccuccgaacuugagaccccgaaccuggccgaaagaguucucgauuggcuggagaaauacggcguggaacgccuuaagcggauggcgauuagcggggacgacugugucgugaaaccuaucgaugacagauuugccacggcucugacagcccucaaugauaugggaaagguucgcaaagacaucccccagugggagccuucuaagggcuggaacgauuggcagcaagugcccuucugcucccaccacuuucaucagcugauuaugaaggacgggcgggagaucgucgugccuuguagaaaucaggaugaacuggucggccgcgcucgggugagccagggagccggcuggucucucagagagaccgcuugccuggggaaauccuaugcccaaauguggcagcuuauguacuuccaccgccgggaccugagacucgcggccaacgcuauuuguagcgccguucccguggauugggucccgacaucccgcaccacguggucuauccaugcccaccaucaguggaugaccacagaagacaugcugagcguguggaaucggguuuggauugaggaaaacccuuggauggaggauaaggcucacguguccagcugggaggacguccccuaucuuggaaaaagagaagaccaauggugcggcucucugaucgggcucaccgcccgggcgacaugggcuaccaauauucagguggccaucaaccaggugagacgccugaucggaaaugagaacuaccuggauuacaugacauccaugaagcgguuuaaaaaugaaagcgaccccgagggcgcccucugguga

SEQ ID NO: 19425 - RNA, 9879 nt, Artificial Sequence
  derived and/or modified CDS sequence (opt5) from DENV-1__KC762651__SS-prME
agcgugaccaugcuguucaugcuccugcccaccgcccuugcuuuucaccugacgaccagaggcggggaaccucauaugaucguguccaagcaggaacgggggaagucucuccuguucaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggagaccugggugacauauggaaccuguucccaaacaggcgagcacagacgggauaagcgcucugucgcccuggccccucauguggggcugggacucgaaaccagaacggagacauggaugagcuccgaaggcgcuuggaaacagauucagaagguugagaccugggcccugcggcaccccggcuuuacagugaucgcucuuuuccuggcccaugcgauugggaccucuaucacccagaagggaaucauuuuuauccuccugaugcuugucacaccuagcauggccaugcgcugcgugggcauugggaacagagacuucguugagggacuguccggcgcuacguggguggaugucgugcucgaacacgggagcugugugaccacaauggccaaagacaagcccacccuggauaucgagcugcucaaaacagaagucaccaauccugcuguucugcggaaacuuugcauugaggccaaaaucucuaacacgacaaccgacucccgcuguccgacccaaggagaagcgacacugguggaggagcaggauaccaauuuugugugcagacggacauucgucgaccgcggcuggggcaacggguguggacucuuuggcaaggggagccugauuacgugcgccaaguucaaaugcgugaccaaacuugaaggaaaaaucguucaguacgagaaucugaaguauucugugaucgucacagugcacaccggcgaucagcaucaaguugggaacgaaacaaccgagcacggaacgaccgcuacaauuacaccccaggccccuacauccgaaauccagcucaccgacuacggcgcucugacgcuggacuguagccccagaacaggccucgauuuuaaugagauggugcugcuuaccaugaaagagaagucuuggcugguccauaaacagugguuccucgaccugccucuucccuggacauccggggccagcaccucccaagaaaccuggaaccggcaggaucugcucgugacauuuaagacggcccacgcuaagaaacaggaggucgugguucugggaucucaagaaggcgcgaugcacaccgcccugacaggggcuaccgagauucagacaagcggaaccacgacaaucuucgccggccaucucaagugccgccugaaaauggacaaacuuacccugaaagggguguccuaugucauguguaccggcagcuucaagcucgaaaaggagguggccgagacacagcacggaaccguucuggugcaggucaaauacgaaggcacagaugcuccgugcaagauuccuuuuucuucccaagacgagagaggggugauccagaauggacggcugaucacggccaaccccauugugaccgauaaagaaaagccuguuaauaucgaggcggagccgcccuucggcgaaagcuauauugucgugggggcuggagagaaagcccuuaagcucucuugguuuaagaaaggcagcuccaucgggaagauguucgaagccacagcuagaggcgcccgccggauggcuauucugggagacaccgccugggauuuuggcucuaucgggggaguguucacaagcgucggcaaacuggugcaucagaucuuugggaccgcguacggaguucucuucuccggcgugagcuggacgaugaagauugggaucggcauucugcuuaccuggcugggacucaacucuagauccacaagccugucuaugaccuguaucgccgucggcauggugacacuguaccuugggguuauggugcaggcugacuccggaugcgucauuaauuggaaaggccgcgagcucaagugugggagcggaaucuuugugaccaacgaaguucacacauggaccgagcaauauaaguuccaggccgauuccccuaaacggcugucugcugccauuggcaaggcgugggaggaaggggugugcggcaucagaagcgccacgcgccuggagaacaucauguggaaacagauuuccaaugaacucaaccauauccugcuugagaaugacaugaaguuuacagucguggugggagacgucucuggcauucuggcucaggggaaaaagaugauccggccgcaacccauggaacacaaauacagcuggaaguccuggggaaaggccaaaauuaucggcgcugauguucagaacaccaccuucaucauugacgggccuaauacacccgaguguccugauaaccagagagccuggaauaucugggagguggaagacuauggauuuggcguguucaccacgaacauuuggcucaagcugcgcgauagcuacacacaggucugcgaccaccggcugaugucugccgcuaucaaagauuccaaggcggugcaugccgacaugggcuauuggauugagagcgagaagaaugagaccuggaaacuugaaagagcuucuuucaucgagguuaagacauguaucuggccccgcucccacacccucuggagcaacggggugcuggagucugaaaugauuaucccgaaaacauacggaggcccugucagccaacauaauuaucggcccggguacuuuacccagacggccggaccuuggcaccugggcaagcucgagcuggauuucaaccuuugcgaagggaccacagugguuguggacgagaauugcggaaacagaggccccucccugcggaccacaaccgucacgggcaaaauuauccacgagugguguugccgcagcuguacacucccuccccugagauuuaagggggaagauggaugcugguacggcauggagauucggccggugaaagaaaaggaggaaaaucugguuaagucuaugguguccgccgggagcggagaggucgacuccuucucucuuggccuccuguguaucagcaucaugauugaggaagugaugagaucccgcuggucugggaaaaugcugaugaccggaacacucgcuguguuucugcuucugaccaugggccagcucaccuggaacgaucugauccggcugugcauuauggucggcgccaacgcgagcgacaugauggggaugggaacaacguaucuugcucugauggccaccuucagaaugcgcccuauguuugccguuggccuccuguucagacggcucacaucccgcgaggugcugcuucugaccguggggcucucucuggucgcuagcguggaacugcccaauucccuugaggaacugggagacggccucgccauggggaucaugaugcugaagcuccugacagauuuucaaagccaucagcuuugggcgacccugcucucucugacguucguuaaaacagcuuuuucccugcacuacgccuggaagaccauggccaugauucuuagcaucgugucucuguucccccucugucuguccaccacaagccagaaaaccacauggcucccuguccugcuuggaucucugggcugcaagccgcugacgaugcuccugauuaccgagaacaagaucuggggcagacgguccuggccccuuaaugaggggaucauggcuauuggaaucgugagcauucugcucuccagccugcucaaaaacgacguuccucuggccggcccccuuaucgcugggggaaugcugauugccuguuaugugaucucuggcagcuccgcggaucugucucucgaaaaggccgcugaggucagcugggaagacgaggccgaacauuccggggcuucucacaauauccugguggagguccaggaugacggaacaaugaaaauuaaggaugaggaacgcgacgauacccuuacaauccugcucaaagccacccugcucgccauuagcggcguguacccuauguccauccccgcuacgcuguuuguuugguauuucuggcaaaagaaaaagcagagaucuggcgugcuuugggacaccccuagcccucccgaggucgaacgggcggugcuggaugacgggauuuaccgcauccugcagagaggacuccugggccggucccagguuggggugggagucuuccaagagggcguguuucauacaauguggcacgugacccgcggggccguucuuauguaucagggaaagagacuggagcccagcugggcuucugucaaaaaggaucucaucuccuacggcggcggguggcgguuccagggaagcuggaacacaggcgaagagguccaggugauugccgucgaacccgggaaaaauccuaagaacgugcaaaccacacccggaacguuuaaaaccucugagggcgaaguuggggccaucgcucuggacuucaagccgggaacauccggcagcccuauugugaauagagagggcaagaucgucgggcucuacggaaacggcgugguuaccaccuccgggacauaugugucugccauugcgcaggcuaaagccagccaggagggaccccugccugaaaucgaggacgaagucuuucgcaagcggaaucuuacgauuauggaucugcaccccggcuccgggaaaaccagacgcuaccugcccgccauccuccgggaggcuaucaagagaaaacugcgcacacuugugcuggccccuacccggguuguggcgagcgaaauggcugaggcccucaagggcaugccgauuagauaucaaacaaccgccgucaagucugagcauacgggaaaagaaaucguggaccugaugugccacgcuacauucaccaugcgccugcucucccccgugcgggucccuaacuacaauaugauuaucauggaugaggcccauuuuaccgaccccgcuagcauugccgcgagaggcuauaucucuacacggguugggaugggagaagccgcugccaucuucaugaccgcuacaccucccggcagcguggaggccuuuccucaguccaacgccgugauucaggaugaagaaagagacaucccggagagaucuuggaauagcggguacgauuggauuaccgacuuccccggaaagacggucugguuugugccuuccaucaaaucuggcaacgauauugcuaacugucuucggaagaaugggaaacgcguugugcagcugagcagaaagacauucgacaccgaauaucaaaagaccaagaauaaugauugggacuacgucgugaccacggacaucuccgagaugggcgcgaacuuccgggccgauagaguuaucgacccccgccggugccugaagccugugauucucaaagauggacccgaaagagucauccuggcuggcccgaugccugugaccgucgccagcgccgcucagcgccgggggagaauuggacgcaaucccaacaaggagggcgaccaguacguguauauggggcagccccuuaauaacgaugaggaccacgcccauuggacagaagcgaaaaugcugcucgauaauaucaacaccccugagggaauuauccccgcucuguuugaaccugagcgggaaaagucugccgccauugacggcgaguacagacugcgcggggaggcuagaaagacauucguugaacucaugcggcgcggcgaucuuccgguguggcuguccuauaaaguggccagcgagggauuucaauacuccgacagacgguggugcuucgauggcgaacgcaauaaccagguccuggaggaaaauauggacguugagaucuggaccaaggagggggaacgcaagaagcuccggcccagauggcuggaugcgcgcacauauucugacccucuugcccugcgggaguuuaaagaguucgcugccggaagacgcagcguguccggcgaccucauccuggagauugggaagcugccccagcaccucacccagaaagcucaaaacgcccuugauaaucuggugaugcugcacaacucugaacagggaggcaaggcuuaccggcaugccauggaggagcucccugacacgaucgaaacacugaugcuucuggcgcucauugccguccugaccggcggggugacccuguuuuuccucagcggaagaggccuugggaagacauccaucggacugcuguguguuauggcuagcucugcccuccuguggauggcuuccguggagccccacuggauugccgccagcaucauccuugaauuuuuccugaugguccuccugauuccggagccugaucggcagcgcacaccccaggacaaccaacuggcuuauguggucaucggccuccuuuuuaugauucugacaguggcggccaaugagauggggcugcucgaaacgaccaaaaaggaucugggaaucggccaugcugccgccgagaaccaccaccaugcugccaugcuugacguugaucugcacccugcgucugccuggacacucuacgcuguggccaccacaauuaucacccccaugaugagacauacgaucgaaaauaccacagcuaacauuucccugaccgccaucgcgaaucaggccgcuauucugaugggccucgacaaaggguggccuaucagcaagauggauauuggagucccccuucuggcccugggcugcuacucucaggugaacccgcucacacugaccgcugccguucuuaugcugguggcucacuaugccaucauugggccuggacuccaagcgaaagccacgcgggaggcucagaagcgcacagccgcuggcaucaugaagaaucccaccgucgacgggaucguggccauugaucuggaccccgugguuuacgaugccaaauucgaaaagcagcugggacagaucaugcuccuuauucuguguacaagccaaauccugcucaugagaaccaccugggcgcugugcgaguccauuacacuugcuacgggcccucugaccacacucugggagggcucuccggggaaauuuuggaacaccacaaucgccgucagcauggcuaauaucuuccggggauccuaucuggccggcgccgggcuggcuuucagccucaugaagucccuuggaggcgggcgcagaggaaccggcgcccagggcgaaacgcugggggagaaauggaagcggcagcugaaccagcucucuaagagcgaauuuaauauuuacaaacgcuccggaaucauggagguggacagaucugaagcgaaggagggccugaaaagaggggaaacaaccaagcaugccgugagccggggaaccgcuaaacuucgcugguucgucgaacggaaccugguuaagcccgagggcaaggugauugaccucggguguggaagaggcggcugguccuauuacugcgccgggcugaaaaaggugacagaagucaaaggauauaccaagggcgggccuggacacgaggaacccgugccuauggcuacauacggcuggaaucugguuaaacuccacucugggaaggauguguuuuucacgcccccugagaaaugugacacccuucugugcgauaucggagagagcuccccgaaccccacaauugaagagggccgcacccugcggguccucaagaugguggaaccuuggcugagaggcaaucaauuuuguaucaagauccuuaaccccuacaugccuagcguuguggagacacuggagcagaugcagcgcaaacaugggggaaugcucguccggaauccccugucuagaaacuccacccacgaaauguauugggugagcugcggcacggggaacauugugucugccgucaauaugaccucccgcaugcugcucaaccgguucacaauggcgcauagaaagccgaccuacgagcgcgacguugaucugggagccggcacacggcacguggcuguggaaccugaggucgccaaucuugacaucauugggcagagaaucgaaaacauuaaaaaugagcacaagagcaccuggcauuaugaugaggacaaccccuacaaaacaugggcuuaucacggaucuuacgaagugaagcccuccggcagcgccuccagcaugguuaauggcgugguccgccugcucaccaagccuugggaugugauccccaugguuacgcaaauugcuaugacagacaccaccccuuuugggcagcagagaguguucaaagagaaggucgauacacggacgccgaaagccaagcgcggaaccgcgcaaaucauggaagugacagccaaauggcuguggggcuuucuuucuagaaacaagaagccccggaucuguaccagagaggaguucacacggaaaguucgcagcaaugcugccauuggggcuguguuugucgacgagaaccaguggaacuccgccaaggaggccguggaagacgagagauucugggaucugguccaucgggaacgcgagcuccacaaacagggaaagugcgcgaccugcguguauaacaugaugggcaaaagagaaaagaagcugggggaguuuggcaaagcuaagggaucucgggccaucugguacauguggcugggcgcccgcuuccucgaguucgaagcucugggguuuaugaaugaggaccauugguucagcagagaaaacucccuuucuggaguugagggcgaggggcugcacaaacucggauacauucugcgggauaucagcaagauuccuggcgggaaucuuuaugccgacgauacagcuggcugggacacccgcaucacggaagaugaccugcagaacgaggccaaaaucaccgauauuauggaacccgagcacgcgcuccuggccacauccaucuuuaagcugaccuaccaaaacaaaguggucagagugcagcggccugcuaagaauggaacagugauggacguuauuucucgcagagaucagcggggcagcggacaggugggaaccuauggccucaacacguucacaaauauggaagcccaacugauccgccagauggaguccgaggggauuuuuagccccucugaacuugagaccccgaaccuggcuaagagaguccucgacuggcuggaaaaacauggaaucgagcggcuuaagagaauggccaucuccggcgaugacugugugguuaaaccuauugacgaucgcuucgcgacagcccugaccgcucucaaugacauggggaaggugcggaaagauaucccccagugggaaccuagcaagggcuggaacgacuggcagcaaguccccuuuugcucucaccauuuccaccagcugauuaugaaggauggaagagagaucguggucccuugucgcaaucaggacgagcugauuggccgggccagagugucccagggggcuggauggagccuccgcgaaacggccugccugggcaaauccuacgcucaaauguggcagcuuauguauuuucaccggagagaucugcgccucgccgcgaacgccaucuguucugcuguucccguggacugggucccgaccagccggacaaccugguccauccaugcccaccaucaguggaugacaaccgaggauaugcugagcguguggaauagaguuuggauugaagagaacccuuggauggaagacaagacacacgugucuuccugggaggauguccccuaccuugggaaacgcgaggaccaauggugcggaagccugaucggccucaccgcccgggcuacgugggccucuaauauucagguggcgaucaaccaggugagacggcugauugggaaugaaaacuaucuggacuacaugacaagcaugaagagauucaaaaaugaguccgaucccgaaggcgcucucugguga

SEQ ID NO: 19426 - RNA, 9879 nt, Artificial Sequence
  derived and/or modified CDS sequence (opt5) from DENV-1__KC762653__SS-prME
uccgugaccaugcugcucaugcugcuucccacagcccuggcuuuccaccuuacgaccagaggcggggagccucauaugaucgucuccaagcaggaacggggaaagucucugcuuuuuaagaccagcgccggcguuaacaugugcacccugauugccauggaccucggggagcugugugaagauacaaugaccuacaagugcccgcgcaucacagagaccgaacccgacgauguggacuguuggugcaaugcuacggagaccugggugacauauggaaccuguuaccagacaggcgagcacagacgggauaagcgcuccgucgcccuggccccucauguggggcucggacuggaaaccagaacggagacauggaugucuagcgaaggcgcuuggcggcagauucagaagguugagaccugggcccuucgccaccccggcuucacagugaucgcucuguuucucgcccaugcgauugggaccuccaucacccagaagggaaucauuuucauccugcuuaugcuggucacaccuucuauggccaugagaugcgugggcauugggaaccgggacuuuguugagggacucagcggcgcuacguggguggaugucgugcuggaacacggguccugugugaccacaauggccaaggacaaacccacccuggauaucgagcuccugaagacagaagucaccaauccugcuguucuucgcaaacugugcauugaggccaagaucagcaacacgacaaccgacucuagauguccgacccaaggagaagcgacacucguggaggagcaggauaccaauuucgugugccggcgcacauuugucgacagaggcuggggcaacggguguggacuguucggcaaagggucccuuauuacgugcgccaaguuuaagugcgugaccaaacuggaaggaaagaucguucaguaugagaaucucaaauacagcgugaucgucacagugcacaccggcgaucagcaucaaguugggaacgaaacaaccgagcacggaacgaccgcuacaauuacaccccaagccccuaccucugaaauccagcugaccgacuauggcgcucugacgcucgacuguagcccccggacaggccuggauuucaaugagauggugcuucugaccaugaaggagaaaagcuggcucguccauaagcagugguuucuggaccuuccucugcccuggacaucuggggccuccaccagccaagaaaccuggaaccgccaggaucuccuggugacauucaaaacggcccacgcuaagaagcaggaggucgugguucugggaucccaagaaggcgcgaugcacaccgcccucacaggggcuaccgagauucagacaucuggaaccacgacaaucuuugccggccaucugaaaugcagacuuaagauggacaaacugacccucaaggggaugagcuacgugauguguaccggcuccuucaaacuggaaaaggaggucgccgagacacagcacggaaccgugcugguucaggugaaguaugaaggcacagaugcuccgugcaaaauuccuuucagcucucaagacgagaagggggucacgcagaauggacggcuuaucaccgccaaccccaucgugacagauaaagaaaagccugugaauauugaggcggagccgcccuuuggcgaauccuaccucguugucggggcuggagagaaagcccugaagcugagcugguucaagaaaggcucuagcaucgggaagauguuugaagccaccgcuagaggcgcccgccggauggcuauucucggagacacagccugggauuucggcuccaucgggggaguguuuaccucugugggcaaacugauucaucagaucuucgggacggcguacggaguccuuuuuagcggcguguccuggaccaugaagaucgggauuggcauccugcucacauggcugggacugaacagcagaucuaccucccuuagcaugacauguauugccguuggcaugaucacccucuaucugggggugaugguccaggcugacucuggaugcgugauuaauuggaaaggccgcgagcugaaguguggguccggaaucuucguuacaaacgaagugcacaccuggacggagcaauacaaguuucaggccgauagcccuaaacggcucuccgcugccauuggcaaggcgugggaggaaggggucugcggcaucagaucugccacacgccuggagaacaucauguggaaacagauuagcaaugaacuuaaccauauccugcucgagaaugacaugaaguucaccgugguugugggagaagucaacggcauucuggcucaggggaaaaagaugauccggccgcaacccauggagcacaaauauuccuggaagucuuggggaaaggccaaagugauuggcgcugacgugcagaauaccacauuuaucaucgaugggccuaacacccccgaguguccugacaaucagagagccuggaacauuugggaagucgaggauuacggauucggcaucuuuacgacaaauauuuggcugaaacuucgcgacagcuauacccagguuugcgaucaccggcucauguccgccgcuaucaaagacagcaaggcggugcaugccgauaugggcuacuggauugaaucugagaaaaacgaaacauggaagcuggcuagagccuccuucaucgaggugaagaccuguaucuggcccaaaagccacacacuguggucuaaugggguccucgaguccgaaaugauuaucccgaagauuuauggaggcccuaucagccaacauaacuaccgccccggguacuucacccagacggccggaccuuggcaccugggcaaacuugagcuggacuuugaacucugcgaggggaccacagugguuguggaugagcacugcggaaaucggggccccucucugagaaccacaaccgucacgggcaagauuauccaugaaugguguugccggagcuguacacugccuccccuucgcuucaaaggggaggacggaugcugguauggcauggaaaucagaccggugaaggagaaggaagagaaccucguuaaauccauggugagcgcugggucuggagaggucgauuccuuuagccugggccugcucuguauuuccaucaugauugaagaggugaugcggucuagauggagccgcaagaugcugaugaccgggacacuugccguuuuccugcuccugaccaugggacagcugaccuggaaugaccuuauccggcugugcauuauggugggcgcgaacgcuuccgauaaaaugggcauggggacaacguaccucgcccugauggccaccuuuagaaugcgcccuaugcucgcugucggacugcuuuucagacggcugacaucucgcgaagugcuccugcugaccgugggccuuagccuggucgccuccguugagcuccccaacucucuggaggaacugggggacggacuggcgaugggcaucaugaugcuuaagcugcucacagacuuucaaagccaccagcugugggcugcccugcuuucccugaccuucgugaaaacgacacucagccugcauuaugccuggaagaccauggcuaugauucucucuaucgugucccuguuuccccuuugucugagcaccacaucucagaagaccacauggcugccuguccuccuggggucccuuggaugcaaaccgcugacgauguuccucaucaccgagaauaagauuuggggcagaaaaagcuggccccugaacgaaggcaucauggccguggggauuguuucuauccuccuguccagccuucugaagaaugaugugccucuggcuggaccccucauugccggcgggaugcugaucgcguguuacgucaucuccggaagcucugccgaccuuagccuggagaaagcugccgaaguguccugggaggaagaggcugagcacucuggcgccagccauaacauucucguugaagugcaggaugacgggacaaugaagaucaaagaugaggaacgggacgauacccugacaauucuccugaaggccacccuucuggcuaucuccggagucuauccuaugucuauucccgcgacgcuguuugugugguacuucuggcaaaagaaaaagcagcgcagcggcguccucugggacaccccuagcccucccgagguggagaaagccguucuggaugacggcaucuauagaauccuucagcgggggcugcucggaaagucucaggugggcgucgggguguuucaagaaggaguuuuccacacaauguggcacgugacccgcggcgcuguccugauguaccaggggaaaagacucgagcccagcugggccuccgugaagaaggaucugauuagcuacggaggcggcuggcgguuccaggggucuuggaauacaggagaagaggugcagguuaucgccgucgaacccggcaaaaacccuaagaaugugcaaaccgcucccgggacauuuaaaacgccggagggagaggugggcgccauugcgcuugacuucaagccugggaccuccggaagccccaucgucaaccgcgaaggcaaaauugugggccuguaugggaauggaguugugacaaccucuggcaccuacgucuccgcuaucgcccaggccaaggcuagccaggaggggccucugcccgaaauugaggaugaaguguuuagaaagcggaaccucacaaucauggaccugcaucccggauccggcaaaacgagacgcuaucuuccugccaucguucgggaggcgauuaagagaaaacugcgcacccucgugcuggcuccgacacgggucguggccucugagauggccgaagcucugaaggggaugcccaucagauaccaaaccacagccguuaaaagcgagcacaccggcaaggaaauuguggaccucaugugccaugcuacguucacaaugcgccuucuguccccuguccgggugcccaauuauaacaugaucauuauggaugaggcccacuuuaccgacccugcgagcaucgccgcuagaggauacaucucuacccgcgugggcaugggggaagccgcugccauuuucaugacagccacacccccuggauccauggaggcuuuuccgcagagcaaugcggccauccaggaugaggaacgggacauucccgagagaucuuggaacagcggcuaugauuggaucacagacuucccugggaagaccgucugguuuguucccuccauuaaaucuggaaaugauaucgcuaacugucugcggaagaacggcaaacgcgugauccagcucagcagaaagacguucgacacagaauaccagaagaccaagaauaacgauugggacuacguggucacaaccgauauuuccgagaugggggccaauuuucgggccgaccgcgugaucgacccuagacggugccugaagcccguuauucuuaaagauggcccggagagagugauccuggcuggaccuaugcccgucacgguggccucugcggcucagcgccggggcagaauugggcgcaaccagaauaaggaaggagaccaguauaucuacaugggccaaccccucaacaaugaugaggaccaugcccacuggaccgaagccaaaaugcugcuggauaacauuaauacaccugaggggaucauccccgcucucuucgaaccugagcgggaaaaguccgccgcgauugacggagaauauagacuucgcggcgaggcccggaaaaccuucguugaacugaugagacgcggggaucugccgguguggcucuccuacaaggucgcuagcgagggcuuucaguauucugacagacgguggugcuucgauggagaacgcaacaaucaggugcuggaggagaacauggacgucgaaaucuggacaaaagagggcgaaagaaagaaacuucggccccgcuggcuggaugccagaaccuacuccgacccucucgcucugcgggaguuuaaagaguucgccgcugggagacgcagcguguccggagaucugauucucgagaucggcaaacuuccccagcaccugacacaacgggcccagaaugcgcuggacaaccucguuaugcugcauaauucugagcaagggggaaaagccuauagacacgcuauggaggaacuuccugacaccauugaaacgcugaugcuccuggcccugaucgcugugcucacaggcggcgugacccucuuuuuccugagcgggcgcggacugggcaagaccuccaucgggcuccugugugucauggccucuagcgcccuucuguggauggcuuccguugagccccauuggauugcggccagcaucauucucgaguuuuuccugauggugcugcucaucccggaaccugaucggcagagaacaccccaagacaaccagcuugcuuacguggucauuggacugcuguuuaugauccucaccguggccgccaacgagaugggccugcuugaaacaacgaaaaaggaucuggggaucggacacgcugccgcggagaaucaccaucacgccgcuaugcucgacguugaucugcauccugccucugcuuggacccuguacgccguggcgacaaccauuaucacacccaugaugcggcacaccauugaaaacacgaccgccaauaucucccucacagcuauugccaaccaggcugccauccuuaugggccuggacaagggcuggccuauuagcaaaauggauaucggggucccccugcucgcucugggaugcuauucucaagugaauccgcuuacccugacagccgcgguccucaugcugguggcccauuacgcuaucauuggcccugggcugcaggccaaggcuacccgcgaggcccagaaaagaacggccgcgggaaucaugaagaaccccacaguugacggcauuguggcuaucgaucucgaccccgucguguaugaugccaaauucgagaagcagcuugggcaaauuaugcugcugauccucuguaccucccagauccugcuuaugcggacaaccugggcucugugcgaaagcauuacccucgccacaggaccucugacgacccugugggagggcucuccgggcaaguuuuggaauacaaccaucgccguuagcauggcuaacauuuuccgcggguccuaccucgccggagcgggccuugccuuuucucugaugaaaagccucgggggaggcagacgggggacaggagcucagggcgaaacccucggcgagaaguggaaacgccagcugaaucaacuuuccaagagcgaguucaacacguauaaaagauccgggaucauggagguggaccggucugaggccaaggaaggacugaagcgcggcgagacaaccaaacacgcugucagcagagggaccgccaagcuccggugguucguggaaagaaaucuggugaaacccgagggaaagguuauugaucugggcugugggcgcggaggcugguccuacuauugcgcgggccucaaaaaggucacagaagugaaaggguacaccaagggaggcccugggcacgaggagcccaucccuauggccacauacggauggaaccuugugaagcugcauucuggcaaagacgucuuuuucacgcccccugaaaagugugacacccugcucugcgauaucggggagagcuccccgaaucccacaauugaagagggacggacccugagaguucuuaaaaugguggagccuuggcugcgcggcaaccaguuuuguaucaaggugcucaaucccuauaugccuucugucauugaaacacuggagcagaugcagcggaaacacggcgggaugcuggugagaaacccccucagccgcaauuccacccaugaaauguacuggguuagcugcggaacgggcaacaucgugucugcugucaacaugaccucccggaugcugcuuaauagauucacaauggcccaccgcaagccgaccuaugagcgggacguggaucugggggcuggaacaagacacguugccguggaaccugaggucgcuaaccucgacauuaucggccaacgcauugagaauaucaagaacgaacauaaaagcaccuggcacuacgaugaggacaaucccuauaagacaugggccuaccaugggucuuaugaagugaaacccuccggaagcgcgucuuccauggugaacggcgucguucggcugcuuaccaagccuugggaugugauccccauggugacgcagauugccaugacagacaccaccccuuuuggccagcaaagagucuucaaagagaagguggauacacgcacgccgaaggcuaaaagagggaccgcccagaucauggaaguuacagcucgguggcuguggggauuucucagccgcaauaagaaacccagaauuuguacccgggaggaguucacaagaaaggugcgguccaacgccgccaucggcgcggucuuuguggacgaaaaucaguggaacagcgcuaaagaggccguugaagaugagcgcuucugggaccuggugcacagagaacgggagcugcauaagcaggggaagugcgcgaccugcgucuacaauaugaugggaaaacgcgagaagaaacucggcgaauuugggaaggcuaaaggcucuagagccauuugguacauguggcugggagcucgguuccuugaguuugaagcccugggcuucaugaacgaggaccacugguucagccgcgaaaauucccucucugggguggaaggagagggccugcacaaacuuggguauauccugagagauaucagcaaaauuccuggaggcaacauguacgcggacgauacagccgggugggacacccggaucacggaagaugaccuccaaaaugaggcuaagauuaccgauaucauggaacccgagcaugcccugcuggcuacauccauuuuuaagcucaccuaucagaacaaaguugugcgcguccagagaccugccaagaacggcacagugauggacgucaucucucggcgcgaucagagaggaagcggccaaguggggaccuacggacugaauacguucacaaacauggaggcgcagcuuauccggcagauggaauccgagggcauuuuuacccccucugaacuggagacaccgaaucucgccgaacgcguucuggacuggcuugagaaacacgggaucgagagacugaagcggauggcuauuagcggagaugacuguguggucaaaccuaucgaugacagauucgccaccgcucucacggcccugaacgacaugggcaaggugcgcaaggauauuccccagugggaaccuuccaaaggguggaaugacuggcaacaggugcccuuuugcagccaucacuuccaccagcugaucaugaaggauggccgggagaucguugugccuuguagaaaccaggacgaacucgucggacgcgcucgggugucucaaggcgccggguggucccugagagagaccgcgugccuuggaaaaagcuaugcccagauguggcagcugauguacuuucaucgccgggaucucagacuggcugccaaugccauuuguucugcuguucccguggacugggucccgacaucccgcaccacauggagcauccacgcccaucaccaauggaugaccacagaagauaugcuuuccguguggaaccgggucuggauugaggagaauccuuggauggaagacaagacccaugugucuagcugggaggauguucccuaucugggcaaaagagaagaccaguggugcgggucccucaucggacugacggcgcgcgcuacaugggccaccaacauucagguggccaucaaucagguccggagacugauuggcaacgagaauuaccucgauuacaugaccagcaugaagcgguucaagaacgagucugaccccgaaggggcucugugguga

SEQ ID NO: 19427 - RNA, 9879 nt, Artificial Sequence
  derived and/or modified CDS sequence (opt5) from DENV-1__KC762640__SS-prME
agcgugaccaugcugcugaugcugcuucccacagcccuggcuuuccaccuuacgaccagaggcggggaaccucauaugaucgucuccaagcaggaacggggaaagucucugcuuuuuaagaccagcgccggcguuaacaugugcacccugauugccauggaccucggggagcugugugaagauacaaugaccuacaagugcccccgcaucacagagaccgaacccgacgauguggacuguuggugcaaugcuacggagaccugggugacauauggaaccuguucccagacaggcgagcacagacgggauaagcgcucugucgcccuggccccucauguggggcucggacuggaaaccagaacggagacauggaugagcuccgaaggcgcuuggcggcagauucagaaaguugagaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggacuuuguugagggacucuccggcgcuacguggguggaugucgugcuggaacacgggagcugugugaccacaauggccaaggacaaacccacccuggauaucgagcuccugaagacagaagucaccaauccugcuguucuucgcaaacugugcauugaggccaagaucucuaacacgacaaccgacuccagauguccgacccaaggagaagcgacacucguggaggagcaggauaccaauuucgugugccggcgcacauuugucgacagaggcuggggcaacggguguggacuguucggcaaagggagccuuauuacgugcgccaaguuuaagugcgugaccaaacuggaaggaaagaucguucaguacgagaaucucaaauauucugugaucgucacagugcacaccggcgaucagcaucaaguugggaacgaaacaaccgagcacggaacgaccgcuacaauuacaccccaagccccuaccuccgaaauccagcugaccgacuacggcgcucugacgcucgacuguagcccccggacaggccuggauuucaaugagauggugcuucugaccaugaaggagaaaucuuggcucguccauaagcagugguuucuggaccuuccucugcccuggacauccggggccagcaccucccaagaaaccuggaaccgccaggaucuccuggugacauucaaaacggcccacgcuaagaagcaggaggucgugguucugggaucucaagaaggcgcgaugcacaccgcccucacaggggcuaccgagauucagacaagcggaaccacgacaaucuuugccggccaucugaaaugcagacuuaagauggacaaacugacccucaaggggguguccuaugucauguguaccggcagcuucaaacuggaaaaggagguggccgagacacagcacggaaccguucuggugcaggucaaguacgaaggcacagaugcuccgugcaaaauuccuuucucuucccaagacgagaagggggugacgcagaauggacggcuuaucaccgccaaccccaucgugacagauaaagaaaagccuguuaauauugaggcggagccgcccuuuggcgaaagcuaucucgucgugggggcuggagagaaagcccugaagcugucuugguucaagaaaggcagcuccaucgggaagauguuugaagccaccgcuagaggcgcccgccggauggcuauucucggagacacagccugggauuucggcucuaucgggggaguguuuaccagcgucggcaaacugauucaucagaucuucgggacggcguacggagugcucuuuuccggcguuagcuggaccaugaagaucgggauuggcauccugcucacauggcugggacugaacucuagauccaccagccuuucuaugacauguauugccgugggcauggucacccucuaccugggggugaugguucaggcugacuccggaugcgugaucaauuggaaaggccgcgagcugaagugugggagcggaauuuucgucacaaacgaagugcacaccuggacggagcaauauaaguuucaggccgauuccccuaaacggcucucugcugccaucggcaaggcgugggaggaagggguuugcggcauuagaagcgccacacgccuggagaacaucauguggaaacagaucuccaaugaacuuaaccauauucugcucgagaaugacaugaaguucaccguggucgugggagaagugaacggcauccuggcucaggggaaaaagaugauucggccgcaacccauggagcacaaauacucuuggaaaagcuggggaaaggccaaagucaucggcgcugacguucagaauaccacauuuauuaucgaugggccuaacacccccgaguguccugacaaucagagagccuggaacaucugggaaguggaggauuauggauucggcauuuuuacgacaaauaucuggcugaaacuucgcgacuccuacacccaggugugcgaucaccggcucaugagcgccgcuauuaaagacucuaaggcgguccaugccgauaugggcuauuggaucgaauccgagaaaaacgaaacauggaagcuggcuagagccagcuucauugaggugaagaccuguaucuggcccaaaucucacacacugugguccaaugggguucucgagagcgaaaugaucauuccgaagaucuacggaggcccuauuucucaacauaacuaucgccccggguacuucacccagacggccggaccuuggcaccugggcaaacuugagcuggacuuugaacucugcgaggggaccacaguggucguggaugagcacugcggaaaucggggccccagccugagaaccacaaccguuacgggcaagaucauucaugaaugguguugccgguccuguacacugccuccccuucgcuucaaaggggaggacggaugcugguacggcauggaaaucagaccggugaaggagaaggaagagaaccucgucaaaagcauggugucugcuggguccggagagguugauagcuuuucccugggccugcucuguaucucuauuaugaucgaagaggugaugcggagcagauggucccgcaagaugcugaugaccgggacacuugccgucuuccugcuccugaccaugggacagcugaccuggaaugaccuuauucggcugugcaucauggugggcgcgaacgcuucugauaaaaugggcauggggacaacguaucucgcccugauggccaccuuuagaaugcgcccuauguucgcugugggacuccuguuuagacggcuuacaagccgcgaaguccugcuccugaccguuggccugucccuuguggccucuguggagcugcccaacagccucgaagaacugggggacggacucgcgaugggcauuaugaugcugaaacuucugacagacuuccaaucccaccagcucugggcugcccugcugagccuuaccuuugucaaaacgacacugucucuccauuacgccuggaagaccauggcuaugauccuguccauugugagccucuucccccugugucuuucuaccacaucccagaagaccacauggcugccuguucugcucgggagccugggaugcaaaccgcuuacgauguuucugaucaccgagaauaagaucuggggcagaaaaucuuggccccucaacgaaggcauuauggccguggggaucgucuccauucugcucagcucccugcuuaagaaugaugugccucuggcuggaccccugaucgccggcgggaugcucauugcguguuauguuaucagcggaucuagcgccgaccugucccuugagaaagcugccgaagugucuugggaggaagaggcugagcacagcggcgccucccauaacauccuggucgaagugcaggaugacgggacaaugaagauuaaagaugaggaacgggacgauacccucacaauccugcucaaggccacccugcuugcuauuucuggagucuacccuaugagcauccccgcgacgcuguucgugugguauuuuuggcaaaagaaaaagcagcgcuccggcguucugugggacaccccuucucccccggagguggagaaagccguccucgaugacggcauuuacagaauccugcagcgggggcuucugggaaagagccaggugggcguugggguguuccaagaaggagucuuccacacaauguggcacgugacccgcggcgcugugcucauguaucaggggaaaagacuggagccuuccugggccagcguuaagaaggaucucaucucuuacggaggcggcuggcgguuucagggguccuggaauacaggagaagagguccaggugauugccguggaacccggcaaaaacccuaagaauguccaaaccgcucccgggacauucaaaacgccggagggagaggugggcgccaucgcgcuggacuuuaagccugggaccagcggaucucccauuguuaaccgcgaaggcaaaaucgugggccuuuacgggaauggagucgugacaaccuccggcaccuauguuagcgcuauugcccaggccaaggcuucccaggaggggccucugcccgaaaucgaggaugaaguguucagaaagcggaaccugacaauuauggaccuccaucccggaucuggcaaaacgagacgcuaccugccugccaucguccgggaggcgaucaagagaaaacuucgcacccuggugcucgcuccgacacggguuguggccagcgagauggccgaagcucugaaggggaugcccauuagauaucaaaccacagccgucaaauccgagcacaccggcaaggaaaucguggaccugaugugccaugcuacguuuacaaugcgccuccuuagcccugugcggguccccaauuacaacaugauuaucauggaugaggcccacuucaccgacccugcgucuauugccgcuagaggauauaucuccacccgcguuggcaugggggaagccgcugccaucuuuaugacagccacacccccuggaagcauggaggcuuucccgcagucuaaugcggccauucaggaugaggaacgggacauccccgagagaagcuggaacuccggcuacgauuggauuacagacuuuccugggaagaccgugugguucgugcccucuaucaaaagcggaaaugauauugcuaacugucugcggaagaacggcaaacgcgucauccagcuguccagaaagacguuugacacagaauaucagaagaccaagaauaacgauugggacuacgugguuacaaccgauaucucugagaugggggccaauuuccgggccgaccgcgugauugacccuagacggugccucaagcccgucauccugaaagauggcccggagagagugauucuugcuggaccuaugcccguuacgguggccagcgcggcucagcgccggggcagaaucgggcgcaaccagaauaaggaaggagaccaguacauuuauaugggccaaccccugaacaaugaugaggaccaugcccacuggaccgaagccaaaaugcuccuggauaacaucaauacaccugaggggauuauccccgcucuguucgaaccugagcgggagaaguccgccgcgaucgacggagaauacagacuccgcggcgaggcccggaaaaccuuugucgaacuuaugagacgcggggaucugccgguguggcugagcuauaaggucgcuucugagggcuuccaguacuccgacagacgguggugcuuugauggagaacgcaacaaucaggugcucgaggagaacauggacguugaaauuuggacaaaagagggcgaaagaaagaagcugcggccccgcuggcuugaugccagaaccuauagcgacccucuggcucuccgggaguucaaagaauuugccgcugggagacgcuccgugucuggagaucugauccuggagauuggcaagcucccccagcaccuuacacaacgggcccagaaugcgcuggacaaccuggugaugcuccauaauagcgagcaagggggaaaagccuacagacacgcuauggaagaacugccugacaccaucgaaacgcuuaugcugcucgcccugauugcuguccugacaggcggcguuacccucuucuuucuuuccgggcgcggacugggcaagaccucuaucgggcugcucugugugauggccagcuccgcccugcuuuggauggcuagcguggagccccauuggaucgcggccucuauuauccuggaguucuuucucaugguccugcugauuccggaaccugaucggcagagaacaccccaagacaaccagcucgcuuaugugguuaucggacuucuguucaugauucugaccguggccgccaacgagaugggccuccuggaaacaacgaaaaaggaucuugggaucggacacgcugccgcggagaaucaccaucacgccgcuaugcuggacgucgaucuccauccugccuccgcuuggacccuguacgccguggcgacaaccaucauuacacccaugaugcggcacaccaucgaaaacacgaccgccaauauuagccugacagcuaucgccaaccaggcugccauucucaugggccuugacaagggcuggccuaucucuaaaauggauauuggggucccccugcuggcucucggaugcuacucccaagugaauccgcugacccuuacagccgcgguucugaugcucguggcccauuaugcuaucaucggcccugggcugcaggccaaggcuacccgcgaggcccagaaaagaacggccgcgggaauuaugaagaaccccacagucgacggcaucguggcuauugaucuggaccccguuguguacgaugccaaauuugagaagcagcucgggcaaaucaugcuucugauucuguguaccagccagauccuccugaugcggacaaccugggcucuuugcgaaucuaucacccuggccacaggaccucucacgacccugugggagggcagcccgggcaaguucuggaauacaaccauugccgucuccauggcuaacaucuuucgcgggucuuaucuggccggagcgggccucgccuucagccuuaugaaaucccucgggggaggcagacgggggacaggagcucagggcgaaacccugggcgagaaguggaaacgccagcucaaucaacugagcaaguccgaguucaacacguacaaaagaucugggauuauggagguggaccggagcgaggccaaggaaggacuuaagcgcggcgagacaaccaaacacgcuguguccagagggaccgccaagcugcggugguuuguugaaagaaaucucgucaaacccgagggaaaggugaucgaucugggcugugggcgcggaggcuggucuuauuacugcgcgggccugaaaaaggugacagaagucaaaggguauaccaagggaggcccugggcacgaggagcccauuccuauggccacauacggauggaaccucguuaaacuuuacagcggcaaagacguguucuuuacgcccccugaaaagugugacacccugcugugcgauaucggggaguccucuccgaaucccacaaucgaagagggacggacccucagagugcugcgcauggucgagccuuggcuucggggcaaccaguucuguauuaaagugcugaaucccuauaugccuagcguuaucgaaacacucgagcagaugcagagaaagcauggcgggaugcuggugcgcaacccccugucccggaauagcacccacgaaauguacugggucucuugcggaacgggcaacauuguguccgcuguuaacaugaccagcagaaugcuccugaaucgcuuuacaauggcccaucggaaaccgaccuaugagagagacguggaucuuggggcuggaacacgccacgucgccguggaaccugagguggcuaaccuggagaucauuggccaacggaucgaaaauauuaagaacgagcacaagucuaccuggcauuacgacgaagauaaucccuauaaaacaugggccuaccacggguccuaugaggucaagcccagcggaucugcguccagcaugguuaacggcguggugagacuccugaccaaaccuugggacgucauccccauggugacgcagaucgccaugacagauaccaccccuuucggccagcaacgcguuuuuaaggaaaaaguggacacaagaacgccgaaggcuaagcgggggaccgcccagauuauggaggucacagcucgcuggcuuuggggauuccuguccagaaauaaaaagccccggaucuguaccagagaggaauuuacacggaaagugcgcagcaacgccgccauuggcgcgguuuucguggaugagaaucaguggaacucugcuaaggaagccgucgaggacgaaagauuuugggaucucgugcaucgggagcgcgagcugcacaaacaggggaagugcgcgaccugcguuuacaauaugaugggaaagagagagaagaagcugggcgaguucgggaaagcuaagggcagccgggccaucugguacauguggcucggagcucgcuuucuggaguucgaggcccuuggcuucaugaacgaggaccauugguuuuccagagaaaauucucugagcgggguggagggagaaggccuccacaaacugggguauauucuucgggacaucuccaagaucccuggaggcaacauguacgcggaugacacagccgggugggauacccgcauuacggaggacgaucugcaaaaugaagcuaaaaucaccgacauuauggagcccgagcacgcccuccuggcuacaucuaucuucaagcugaccuaucagaacaaggucgugagaguccagcggccugccaaaaacggcacagugauggauguuauuagccgcagagaccagcggggauccggccaaguggggaccuacggacucaauacguuuacaaacauggaagcgcagcugauccgccagauggagucugaaggcaucuucacccccagcgagcuugaaacaccgaaucuggccgagagaguccucgauuggcuggagaagcaugggauugaacggcuuaaaagaauggcuaucuccggagacgauuguguggugaagccuauugacgaucgcuuugccaccgcucugacggcccucaacgacaugggcaaaguucggaaggacaucccccagugggagccuagcaagggguggaaugauuggcaacaggugcccuucugcucucaccauuuucaccagcugauuaugaaagacggcagagaaaucgucgugccuugucgcaaccaggaugagcugguuggacgggcuagagugucccaaggcgccggguggagccuccgcgaaaccgcgugccugggaaagucuuaugcccagauguggcagcuuauguacuuccaccggagagaccugcgccucgcugccaaugccaucuguuccgcuguccccguggauugggucccgacaagccggaccacaugguccauucaugcccaccaucaauggaugaccacagaggacaugcugucuguguggaacagaguuuggaucgaggaaaauccuuggauggaggauaaaacccacgugagcuccugggaagacguccccuaucuuggcaagcgcgaggaucaguggugcgggagccugauuggacucacggcgcgggcuacaugggccaccaacauccagguggccauuaaucagguuagacggcugaucggcaacgagaauuaccuggacuacaugaccucuaugaaaagauuuaagaacgaauccgaucccgagggggcucucugguga

SEQ ID NO: 19428 - RNA, 9879 nt, Artificial Sequence
  derived and/or modified CDS sequence (opt5) from DENV-1__KC762645__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacacugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagcgcguugaaacaugggcucuuagacaccccggcuucaccgugaucgcccuguuucucgcgcaugccauugggacaucuaucacccagaaaggaaucauuuucauccugcuuaugcuggucaccccuagcauggcuaugcggugcgugggcauugggucccgcgauuuuguugagggacucagcggcgccacauggguggacgucgugcuggagcacgggucuugugugacgaccauggcuaaggauaagcccacacuggacaucgaacuccugaaaaccgaggucacaaacccugccguucuuagaaagcugugcauugaagcgaaaaucuccaauaccacgacagauagccgguguccgacccaaggagaggccacccucguggaagagcaggacgcuaacuucgugugccgcagaacauuugucgaucggggcuggggcaauggguguggacuguucggcaaggggucucuuauuaccugcgccaaauuuaagugcgugacaaagcuggagggaaaaaucguucaguacgaaaaccucaaguauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccgcaccggccuggacuucaacgaaauggugcuucugacgaugaaagagaaguccuggcucguccauaaacagugguuucuggaucuuccucugcccuggacaagcggggcuuccaccucucaagagacauggaauagacaggaccuccuggugaccuucaagaccgcgcacgccaaaaagcaggaagucgugguucugggaagccaagagggcgcuaugcacacagcccucacgggggccaccgaaauucagacauccggaaccacaaccaucuuugcuggccaucugaagugccggcuuaaaauggauaagcugacgcucaaagggaugagcuaugugauguguacaggcucuuucaagcuggagaaagaagucgccgagacccagcacggaaccgugcugguucagauuaaguacgagggcacagacgcgccgugcaagaucccuuucuccacccaagaugaaaaaggggugacacagaacggaagacuuaucacggcuaaucccauugucaccgacaaggagaaaccugugaacaucgaagccgagccccccuuuggcgagagcuauauugugaucggggccggagaaaaggcucucaaacugucuugguucaagaagggcagcuccauugggaaaauguuugaggccacagcucgcggcgcccggagaauggcgauccugggagauaccgccugggacuucggcucuaucgggggaguuuuuacaagcgucggcaagcucgugcaucagauuuucgggaccgcuuacggagugcuguuuuccggcgucagcuggacgaugaaaaucgggauuggcgugcuucugaccuggcucggacugaauucucgcuccacaagccugucuaugaccuguaucgccguuggccuugugacacucuaccugggggucauggugcaggcugauuccggaugcguuauuaacuggaagggccgggaacugaaaugugggagcggaaucuucgugaccaaugagguccacacauggaccgaacaauauaaguuucaggccgacuccccuaagagacucucugcggccauuggcaaagcuugggaggagggggugugcggcauccgcagcgccacgcggcuggaaaacaucauguggaagcagauuuccaacgagcuuaaucauauccugcucgaaaacgacaugaaauucacaguuguggucggagauguggcuggcauucuggcccaggggaagaaaaugaucagaccgcaacccauggagcacaaguacucuuggaaaagcuggggaaaggccaagauuaucggcgcugacgugcagaauaccaccuuuaucauugaugggccuaacacacccgaauguccugacgaucagcgcgcguggaauaucugggaggucgaggacuauggauucggcauuuuuaccacgaacaucuggcugaaacuucgggauuccuacacacagguuugcgaccacagacucaugagcgccgcuauuaaggauucuaaagccgugcaugccgacaugggcuauuggaucgaauccgagaagaaugaaaccuggaaacuggcucgcgccagcuucaucgaggugaagacauguauuuggcccaagucucacacccugugguccaacgggguccucgaaagcgagaugaucauuccgaaaaucuacggaggcccuauuucucaacauaauuaucggcccggguacuucacacagaccgcgggaccuuggcaccugggcaagcuugagcuggauuuuaaccucugcgaagggacgaccgugguuguggacgagcacugcggaaauagaggccccagccugcggacaaccacagucaccggcaaaaucauccaugaaugguguugccgcuccuguacgcugccuccccuuagauuccggggggaggauggaugcugguacggcauggagauuagaccggugaaggaaaaagaggaaaaccucguuaagagcauggugucugcuggguccggagaggucgacagcuuuucccugggccugcucuguaucucuauuaugaucgaagaggugaugcgcagccggugguccagaaagaugcugaugacagggacccuugccguuuucuuucugcucauuaugggacagcugacauggaaugaccugauccgccuuugcauuauggugggcgccaacgcuucugauagaaugggcauggggaccaccuaucuggcccucauggcgacauucaaaaugcggccuauguuugcugucggacugcucuuccgcagacugacgagccgggaggugcuucugcucaccaucggccugucccugguggccucugucgaacuucccaauagccuggaggaacucggggacggacuggccaugggcaucaugauucucaagcugcuuacagauuuucaaucccaccagcugugggcuacccuccugagccugacauucaucaaaaccacguuuucucuucauuacgccuggaagacaauggcuaugguucuguccauugugagccucuucccccugugucucucuaccaccucccagaaaacaaccuggcugccugugcuucuggggagccugggaugcaagccgcucacaauguuucugaucgccgagaacaagauuuggggccgcaaaucuuggccccuuaacgaaggcaucauggcggucgggaucguguccauucugcucagcucccugcucaagaaugacguuccucuggccggaccccuuaucgcuggcgggaugcugauugccuguuaugugaucagcggaucuagcgcugaucugucccucgagaaagccgccgaggucucuugggaagaggaagcugagcacagcggcgcgucccauaacauucugguggaaguucaggacgaugggacgaugaagaucaaagacgaggagagagaugacacccuuacaauccugcucaaggccacccugcucgcugugucuggagucuacccucugagcauucccgccacacuuuucgugugguauuucuggcaaaaaaagaagcagcgguccggcguccugugggauaccccuucucccccggaaguggagcgcgccguucuggacgauggcaucuacagaauuaugcagcgggggcuccugggacgcagccaggugggcgucgggguguuucaagaaaauguuuuccacacgauguggcacgugaccagaggagcuguccuuauguaucagggcaaacggcuggagccuuccugggccagcgugaagaaagaccucaucucuuacgggggaggcuggagacugcagggcuccuggaacacaggggaggaagugcagguuauugcggucgagcccggaaagaauccuaaaaacgugcaaaccgcucccggcacauuuaagaccccggaaggggaggugggagccaucgcccucgacuucaagccuggcacaagcgggucucccauugucaaucgcgaaggaaaaaucgugggccuguacggcaacgggguugugacgaccuccggaacauaugucagcgcuaucgcccaggcgaaggcuucccaggagggcccucuucccgagauugaagaugagguguuucggaaaagaaaucugaccaucauggaccugcaucccgggucuggaaagacccgccgguaccucccugccauuguuagagaagccaucaaacgcaagcugcggacacuuauucuggcuccgacgagaguggucgccagcgagauggcugaagcccucaagggcaugcccauccgcuaucaaaccacagcggugaaauccgagcacaccgggaaggagaucguugaucugaugugccaugccacauucaccaugcggcugcucagcccugugagaguccccaacuacaauaugauuaucauggacgaagcucacuuuacggauccuucuuccauugccgcucggggcuauaucagcacacgcgugggaaugggcgaggccgccgcuauuuucaugaccgcgacccccccugggucuguggaagccuuuccgcagagcaacgcugucauccaggacgaggaaagagauauccccgagcgguccuggaauucuggauacgaguggauuacagacuucccuggcaaaaccguuugguuugugcccagcaucaaguccgggaacgauauugccaauugucuucgcaaaaacggaaagagagugauccagcugucucggaagacauucgacaccgaauaucaaaaaacgaagaacaaugauugggacuacgucgugacaaccgacauuagcgagaugggcgccaacuucagagcugaucgcguuaucgacccucggagaugccugaaacccgugauucucaaggaugggccggaacgcgucauccuggccggcccuaugcccgugacaguugcguccgcugcccagcggagaggacgcgugggccggaaucauaacaaagagggggaccaguacaucuauaugggacagccccuuaauaacgaugaggaccacgcccacuggaccgaagcuaagaugcugcucgauaauauuaacacgccugagggcaucauucccgcccuguuugaaccugagagagaaaagagcgcggccaucgacggggaguaccgccugagaggagaggcucggaaaaccuucgucgaacucaugcgcagaggcgaucuuccgguguggcugucuuauaaggucgccuccgagggguuucaauacagcgaccggcgcuggugcuucgauggcgaaagaaauaaccaggugcuggaggaaaauauggacguugagauuuggacaaaagagggagaacggaagaaacucagaccccgcuggcuggaugcucggaccuauuccgacccucuugcccugagagaguuuaaggaauucgcugccggccgccggucugugagcggggaccucauccuggagaucggaaaacugccccagcaucucacacagagagcgcaaaacgcccuugauaaucuggugaugcugcacaacuccgaacagggcgggcgggcuuaccgccaugccauggaggagcucccugacaccauugaaacacugaugcuucuggcucucaucgccguccugaccggaggcguuacgcuguuuuuccucucuggcagagggcuuggaaagacaagcauuggccugcugugugugauggccuccagcgugcuccuguggauggcuucuguccagccccacuggaucgcggccuccauuauccuugaguuuuuccugauggugcuccugaucccggaaccugaucggcagcgcaccccccaagacaaucagcuggcuuauguugugauugggcuccuuuuuaugauccugaccgucgccgccaacgagaugggacugcucgagacaaccaagaaagaucugggcauugggcacguggcugucgaaaaccaucaccaugccgcgaugcuugacguggaucugcacccugccagcgcuuggacacucuacgccguugcuacgaccaucauuacacccaugaugagacauaccaucgagaauacaaccgccaacauuucucugacggcgaucgccaaucaggcugccauccugaugggacucgacaagggcuggccuauuuccaaaauggauaucggcgugccccuucuggcucuggggugcuacagccaagucaacccgcucacccugacagccgcugugcuuaugcugguugcccacuaugcgauuaucggaccuggccuccaggccaaggcuacccgggaagcccagaaacgcacagcugccgggauuaugaagaaucccaccguggacggaaucgucgccaucgaucuggaccccgugguguacgaugcgaaguucgagaaacagcugggccaaauuaugcuccuuauccuguguacgucucagauucugcucaugagaacaaccugggcucugugcgaaagcaucacacuugccaccgggccucugaccacacucugggagggauccccgggcaaguuuuggaacacgaccauugcuguuucuauggccaauaucuuccggggcagcuaucuggccggggcuggacuggccuucucccucaugaaaagccuuggcgggggacgcagaggcacaggggcgcagggagagacccugggcgaaaaguggaaacggcagcugaaccaacucuccaagucugaguuuaauacauacaagagaagcggcaucauggaagucgaccgcuccgaggccaaagaagggcugaagcggggagagaccacgaaacacgcugugucuagaggcacagccaagcuucgcugguucguggagcggaaccuggucaaacccgaagggaagguuauugaccucggauguggcagagggggauggagcuauuacugcgcuggccugaagaaagugaccgaggugaagggcuauaccaaagggggaccuggccaugaagagcccaucccuauggccacauacggguggaaucuggucaagcuccacuccggaaaagauguguuuuucauucccccugaaaagugugacacccuucugugcgauaucggcgagucuagcccgaaccccacaauugaggaagggcgcacgcugcggguucucaaaaugguggagccuuggcugagaggaaaucaguuuuguaucaagauucuuaaccccuacaugccuuccgucguggaaacccuggagcagaugcagcgcaagcauggcggcaugcucguucggaauccccugagcagaaacucuacacacgagauguauuggguguccugcgggaccggaaauaucgucagcgcggugaacaugacaucucgcaugcugcucaaccgguucaccauggcccacagaaaaccgacguacgaacgcgacguggaucugggcgcugggaccagacaugucgccguugagccugaaguggcuaaucuugacaucauuggacaacggaucgagaacauuaagcacgaacauaaauccacauggcacuaugaugaggacaaucccuacaagaccugggccuaucauggcagcuacgaggugaaacccucuggguccgcuagcuccauggucaacggagugguuaagcugcucacaaagccuugggaugugauccccauggucacccagauugccaugacagacaccacgccuuuuggccagcaacgcguguucaaagaaaagguugauacaagaaccccgaaagcgaagcggggcaccacacagaucauggaggugacggccagauggcuguggggguuucuuagccggaauaaaaagccccgcaucuguaccagagaagaguucacacggaagguccgcucuaacgcugccauuggagcuguguuuguugacgaaaaucaguggaacagcgccaaagaggccguggaggacgaaagauucugggaucugguccaccgggagcgcgaacuccacaagcagggcaaaugcgcgaccugcguguauaauaugauggggaagagagagaaaaagcugggagaauuuggcaaggcuaaagggucccgggccaucugguacauguggcugggcgcccgcuuccucgaguucgaggcucugggauuuaugaacgaagaccauugguucucuagagagaauagccuuuccggcgucgaaggggagggacugcacaagcucggcuacauucugcgggauaucucuaaaauuccugggggaaacauguaugccgacgauacagcuggcugggacacccgcaucacagaggaugaccuucaaaaugaagccaagaucaccgauauuauggagcccgaacaugcgcugcucgccaaagcuaucuuuaagcugacguaccagaacaaagugguuagagugcagcggccugccaagaaugggaccgucauggacgugauuagccgcagagaucagcggggcuccggacaagugggcacauaugggcugaacaccuucacaaacauggaggcucagcucaucagacagauggaaucugagggaauuuuuagccccuccgagcuggaaaccccgaaucuugccgagcgcguucuggacuggcucgaaaaguacggcguggagcggcugaaaagaauggcgaucagcggggaugacugugucgugaagccuaucgacgaucgcuucgccacggcucuuacagcccugaacgacaugggaaaaguucggaaggauauuccccagugggaaccuucuaaaggcuggaaugacuggcaacaggugcccuuuugcucccaccacuuccaucagcucaucaugaaggaugggagagagauugucgugccuugucgcaaccaggacgagcuggucggccgggcuagagugagccaaggagccggcuggucucugcgcgaaaccgcuugccucgggaaguccuaugcccagauguggcagcugauguacuuucaccggagagaucuucgccuggcggccaaugcuaucuguagcgccguucccguggacugggucccgacaucccggaccacguggucuauucaugcccaccaucaauggaugaccacagaggauaugcucagcguguggaacagaguuuggaucgaagagaauccuuggauggaagacaaaacccacauuuccagcugggaggaugugcccuaucugggaaagcgggaggaccaguggugcggcucucuuaucgggcugacagcuagagccaccugggcgacaaacauccaggucgcuauuaaucaggugcgccggcucaucggaaacgaaaauuaccuggacuacaugaccuccaugaaaagauucaagaacgagagcgaucccgaaggcgcccugugguga

SEQ ID NO: 19429 - RNA, 9879 nt, Artificial Sequence
  derived and/or modified CDS sequence (opt5) from DENV-1__KC762628__SS-prME
agcgugaccaugcugcugaugcugcuucccaccgcccuggcuuuccaccuuacgaccagaggaggggagccucauaugaucgucuccaagcaggaacggggaaagucucugcuuuuuaagacaagcgccggcguuaauaugugcacccugauugccauggaccucggggagcugugugaagauaccaugaccuacaagugcccgcgcaucacagagaccgaacccgacgauguggacuguuggugcaaugcuacggagaccugggugacauauggaaccuguucccagacaggcgagcacagacgggauaagcgcucugucgcccuggccccucauguggggcucggacuggaaaccagaacggagacauggaugagcuccgaaggcgcuuggcggcagauucagaagguugagaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggacuuuguugagggacucuccggcgcuacguggguggaugucgugcuggaacacgggagcugugugaccacaauggccaaggacaagcccacccuggauaucgagcuccugaagacagaagucaccaauccugcuguucuucgcaagcugugcauugaggccaagaucucuaacacgacaaccgacuccagauguccgacccaaggagaagcgacacucguggaggagcaggauaccaauuucgugugccggcgcacauuugucgacagaggcuggggcaacggguguggacuguucggcaaagggagccuuauuacgugcgccaaguuuaagugcgugaccaaacuggaaggaaagaucguucaguacgagaaucucaaauauucugugaucgucacagugcacaccggcgaucagcaucaaguugggaacgaaacaaccgagcacggaacgaccgcuacaauuacaccccaggccccuacauccgaaauccagcugaccgacuacggcgcucugacgcucgacuguagcccccggacaggccuggauuucaaugagauggugcuucugaccaugaaggagaaaucuuggcucguccauaagcagugguuucuggaccuuccucugcccuggacauccggggccagcaccucccaagaaaccuggaaccgccaggaucuccuggugacauucaaaacggcccacgcuaagaagcaggaggucgugguucugggaucucaagaaggcgcgaugcacaccgcccucacaggggcuaccgagauucagacaagcggaaccacgacaaucuuugccggccaucugaaaugcagacuuaagauggacaaacugacccucaaggggguguccuaugucauguguaccggcagcuucaaacuggaaaaggagguggccgagacacagcacggaaccguucuggugcaggucaaguacgaaggcacagaugcuccgugcaaaauuccuuucucuucccaagacgagaagggggugacgcagaauggacggcuuaucaccgccaaccccaucgugacagauaaagaaaagccuguuaauauugaggcggagccgcccuuuggcgaaagcuaucucgucgugggggcuggagagaaagcccugaagcugucuugguucaagaaaggcagcuccaucgggaagauguuugaagccaccgcuagaggcgcccgccggauggcuauucucggagacacagccugggauuucggcucuaucgggggaguguuuaccagcgucggcaaacugauucaucagaucuucgggacggcguacggagugcucuuuuccggcguuagcuggaccaugaagaucgggauuggcauccugcucacauggcugggacugaacucuagauccaccagccuuucuaugacauguauugccgugggcauggucacccucuaccugggggugaugguucaggcugacuccggaugcgugaucaauuggaaaggccgcgagcugaagugugggagcggaauuuucgucacaaacgaagugcacaccuggacggagcaauauaaguuucaggccgauuccccuaaacggcucucugcugccaucggcaaggcgugggaggaagggguuugcggcauuagaagcgccacacgccuggagaacaucauguggaaacagaucuccaaugaacuuaaccauauucugcucgagaaugacaugaaguucaccguggucgugggagaagugaacggcauccuggcucaggggaaaaagaugauucggccgcaacccauggagcacaaauacucuuggaaaagcuggggaaaggccaaagucaucggcgcugacguucagaauaccacauuuauuaucgaugggccuaacacccccgaguguccugacaaucagagagccuggaacaucugggaaguggaggauuauggauucggcauuuuuacgacaaauaucuggcugaaacuucgcgacuccuacacccaggugugcgaucaccggcucaugagcgccgcuauuaaagacucuaaggcgguccaugccgauaugggcuauuggaucgaauccgagaaaaacgaaacauggaagcuggcuagagccagcuucauugaggugaagaccuguaucuggcccaaaucucacacacugugguccaaugggguucucgagagcgaaaugaucauuccgaagaucuacggaggcccuauuucucaacauaacuaucgccccggguacuucacccagacggccggaccuuggcaccugggcaaacuugagcuggacuuugaacucugcgaggggaccacaguggucguggaugagcacugcggaagccggggccccucccugagaaccacaaccguuacgggcaagaucauucaugaaugguguugccggagcuguacacugccuccccuucgcuucaaaggggaggacggaugcugguacggcauggaaaucagaccggugaaggagaaggaagagaaucucgucaaaucuaugguguccgcugggagcggagagguugauuccuuuucucugggccugcucuguaugagcaucaugauugaagaggugaugcgguccagauggucucgcaagaugcugaugaccgggacacuugccgucuuccugcuccugaccaugggacagcugaccuggaacgaccuuauccggcugugcauuauggugggcgcgaaugcuagcgauaaaaugggcauggggacaacgcaccucgcccugauggccaccuuuagaaugcgcccuauguucgcugugggacuccuguuuagacggcuuacaucccgcgaaguccugcuccugaccguuggccugucucuuguggccagcguggagcugcccaacucccucgaagaacugggggacggacucgcgaugggcaucaugaugcugaaacuucugacagacuuccaaagccaucagcucugggcugcccugcugucucuuaccuuugucaaaacgacacugucccuccacuaugccuggaagaccauggcuaugauucugagcaucgugucucucuucccccugugucuuuccaccacaagccagaagaccacauggcugccuguucugcucgggucucugggaugcaaaccgcuuacgauguuucugauuaccgagaacaagaucuggggcagaaaauccuggccccucaaugaaggcaucauggccguggggauugucagcauccugcucuccagccugcuuaagaacgaugugccucuggcuggaccccugauugccggcgggaugcucaucgcguguuacguuauuucuggaagcuccgccgaccugucucuugagaaagcugccgaagugagcugggaggaagaggcugagcauuccggcgccucucacaauauccuggucgaagugcaggaugacgggacaaugaagaucaaagaugaggaacgggacgauacccucacaauucugcucaaggccacccugcuugcuaucagcggagucuauccuauguccauucccgcgacgcuguucgugugguacuuuuggcaaaagaaaaagcagcgcucuggcguucugugggacaccccuagcccucccgagguggagagagccguccucgaugacggcaucuaucggauucugcagcgcgggcuucugggaaaaucccaggugggcguugggguguuccaagaaggagucuuccacacaauguggcaugugaccagaggcgcugugcucauguaccaggggaagcggcuggagcccagcugggccucuguuaaaaaggaucucaucuccuauggaggcggcuggcgcuuucaggggagcuggaacacaggagaagagguccaggugaucgccguggaacccggcaagaauccuaaaaacguccaaaccgcucccgggacauucaagacgccggagggagaggugggcgccauugcgcuggacuuuaaaccugggaccucuggaucccccaucguuaauagagaaggcaagauugugggccuuuacgggaacggagucgugacaaccagcggcaccuacguuuccgcuaucgcccaggccaaggcuucucaggaggggccucugcccgaaauugaggaugaaguguuccggaagagaaaucugacaaucauggaccuccaccccggaagcggcaagacgcgccgguaucugccugccauugucagagaggcgaucaaacgcaaacuucggacccuggugcucgcuccgacaagaguuguggccuccgagauggccgaagcucugaaagggaugcccauccgcuaccaaaccacagccgucaagagcgagcauaccggcaaagaaauuguggaccugaugugccacgcuacguuuacaaugcggcuccuuucuccugugagaguccccaacuauaauaugaucauuauggaugaggcccauuucaccgacccugcguccaucgccgcucgcggauacauuagcacccggguuggcaugggggaagccgcugccaucuuuaugacagccacacccccuggaucuaucgaggcuuucccgcagagcaacgcggccauucaggaugaggaaagagacauccccgagcgguccuggaacucuggcuaugauuggauuacagacuuuccugggaagaccgugugguucgugcccagcaucaaguccggaaacgauauugcuaauugucugcgcaaaaacggcaagagagucauccagcugucucggaaaacguuugacacagaauaccaaaagaccaaaaacaaugauugggacuaugugguuacaaccgauaucagcgagaugggggccaacuuccgcgccgacagagugauugacccucggagaugccucaagcccgucauccugaaggauggcccggagcgcgugauucuugcuggaccuaugcccguuacgguggccuccgcggcucagcggagaggccgcaucgggcggaaucagaacaaagaaggagaccaguacauuuacaugggccaaccccugaauaacgaugaggaccacgcccacuggaccgaagccaagaugcuccuggauaauaucaacacaccugaggggauuauccccgcucuguucgaaccugagagagagaaaagcgccgcgaucgacggagaauaucgccuccggggcgaggccagaaagaccuuugucgaacuuaugcgcagaggggaucugccgguguggcugucuuacaaagucgcuuccgagggcuuccaguauagcgaccggcgcuggugcuuugauggagaaagaaauaaccaggugcucgaggagaauauggacguugaaauuuggacaaaggagggcgaacggaaaaagcugcgccccagauggcuugaugcccggaccuacuccgacccucuggcucucagagaguucaaggaauuugccgcugggcgccggucugugagcggagaucugauccuggagauuggcaaacucccccagcaucuuacacaaagagcccagaacgcgcuggacaaucuggugaugcuccacaacuccgagcaagggggaaaggccuaucgccaugcuauggaagaacugccugacaccaucgaaacgcuuaugcugcucgcccugauugcuguccugacaggcggcguuacccucuucuuucuuucugggcggggacugggcaaaaccagcaucgggcugcucugugugauggccuccagcgcccugcuuuggauggcuucuguggagccccacuggaucgcggccuccauuauccuggaguucuuucucaugguccugcugauuccggaaccugauagacagcggacaccccaagacaaucagcucgcuuacgugguuaucggacuucuguucaugauucugaccguggccgccaacgagaugggccuccuggaaacaacgaagaaagaucuugggaucggacacgcugccgcggagaaccaucaccaugccgcuaugcuggacgucgaucuccacccugccagcgcuuggacccuguaugccguggcgacaaccaucauuacacccaugaugcgccauaccaucgaaaauacgaccgccaacauuucucugacagcuaucgccaaucaggcugccauucucaugggccuugacaagggcuggccuaucuccaagauggauauuggggucccccugcuggcucucggaugcuacagccaagugaacccgcugacccuuacagccgcgguucugaugcucguggcccacuacgcuaucaucggcccugggcugcaggccaaagcuaccagagaggcccagaagcggacggccgcgggaauuaugaaaaaucccacagucgacggcaucguggcuauugaucuggaccccguuguguaugaugccaaguuugagaaacagcucgggcaaaucaugcuucugauucuguguaccucucagauccuccugaugcgcacaaccugggcucuuugcgaaagcaucacccuggccacaggaccucucacgacccugugggagggcuccccgggcaaguucuggaacacaaccauugccgucucuauggcuaauaucuuuagagggagcuaccuggccggagcgggccucgccuucucccuuaugaaaagccucgggggaggccggcgcgggacaggagcucagggcgaaacccugggcgagaaauggaagagacagcucaaccaacuguccaaaucugaguucaauacguauaagcggagcgggauuauggagguggaccgcuccgaggccaaagaaggacuuaagagaggcgagacaaccaagcacgcugugucucgggggaccgccaaacugagaugguuuguugaacgcaaccucgucaagcccgagggaaaagugaucgaucugggcugugggcggggaggcuggagcuacuauugcgcgggccugaagaaagugacagaagucaagggguacaccaaaggaggcccugggcaugaggagcccauuccuauggccacauauggauggaaucucguuaaacuucacuccggcaaggacguguucuuuacgcccccugaaaaaugugacacccugcugugcgauaucggggagucuagcccgaaccccacaaucgaagagggaagaacccuccgcgugcugcggauggucgagccuuggcuuagaggcaaucaguucuguauuaaggugcugaaccccuacaugccuuccguuaucgaaacacucgagcagaugcagcgcaaacauggcgggaugcuggugcggaauccccugagcagaaacucuacccacgaaauguacugggucuccugcggaacgggcaauauugugagcgcuguuaacaugaccucucgcaugcuccugaaccgguuuacaauggcccacagaaagccgaccuaugagcgcgacguggaucuuggggcuggaacacggcaugucgccguggaaccugagguggcuaaucuggacaucauuggccaaagaaucgagaacauuaaaaaugaacacaaguccaccuggcauuacgaugaggacaaccccuauaagacaugggccuaccacgggagcuaugaagucaaacccucuggauccgcgagcuccaugguuaauggcguggugcgccuccugaccaagccuugggaugucauccccauggugacgcagaucgccaugacagacaccaccccuuucggccagcaaagaguuuuuaaagagaagguggauacacggacgccgaaagcuaagcgcgggaccgcccagauuauggaagucacagcuagauggcuuuggggauuccugagccggaacaagaaacccagaaucuguacccgggaggaguuuacacgcaaggugagaucuaaugccgccauuggcgcgguuuucguggacgaaaaccaguggaauagcgcuaaagaggccgucgaagaugagcgguuuugggaccucgugcaucgcgaaagagagcugcacaagcaggggaaaugcgcgaccugcguuuacaacaugaugggaaagcgggagaagaaacugggcgaguucgggaaggcuaaaggcucccgcgccaucugguauauguggcucggagcuagauuucuggaguucgaagcccuuggcuucaugaaugaggaccacugguuuucucgggagaacagccuguccgggguggaaggagagggccuccauaagcugggguacauucuucgcgauaucucuaaaaucccuggaggcaauauguacgcggacgauacagccgggugggacaccagaauuacggaagaugaccugcaaaacgaggcuaagaucaccgauauuauggaacccgagcacgcccuccuggcuacaagcaucuucaaacugaccuaucagaauaaggucgugcggguccagcgcccugccaagaacggcacagugauggacguuauuuccagacgggaucagcgcggaucuggccaaguggggaccuacggacucaacacguuuacaaauauggaggcgcagcugaucagacagauggaaagcgagggcaucuucacccccuccgaacuugagacaccgaaccuggccgaacggguccucgacuggcuggagaaacaugggauugagagacuuaagcgcauggcuaucagcggagaugacuguguggugaaaccuauugaugaccgguuugccaccgcucugacggcccucaaugacaugggcaagguuagaaaagauaucccccagugggaaccuucuaagggguggaacgacuggcaacaggugcccuucugcucccaccacuuucaucagcugauuaugaaggauggccgcgagaucgucgugccuugucggaaucaggacgaacugguuggcagagcucgcgugagccaaggcgccggguggucucuccgggagaccgcgugccugggaaaauccuaugcccagauguggcagcuuauguacuuccacagacgcgaucugcggcucgcugccaacgccaucuguagcgcuguccccguggacugggucccgacauccagaaccacauggucuauucaugcccaccaucaauggaugaccacagaagauaugcugagcguguggaaucgcguuuggaucgaggagaacccuuggauggaagacaagacccacguguccagcugggaggauguccccuaucuuggcaaacgggaagaccaguggugcgggucucugauuggacucacggcgagagcuacaugggccaccaauauccagguggccauuaaccagguucggagacugaucggcaaugagaacuaccuggauuauaugaccuccaugaagcgcuuuaaaaaugagagcgaccccgaaggggcucucugguga

SEQ ID NO: 19430 - RNA, 9879 nt, Artificial Sequence
  derived and/or modified CDS sequence (opt5) from DENV-1__KC762624__SS-prME
agcgugacaaugcugcucaugcugaugcccacagcccuugcuuuccaccugacgacccggggaggggaaccucauaugaucgucuccaagcaggaacggggaaaaucucuccuguuuaagacaagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuacaucucaacauaauuaucgccccggguacuucacccagacggcgggaccuuggcaccugggcaaacuugagcuggauuuugaccucugcgaagggaccacagugguuguggaugagcacugcggaaaccggggccccagccugagaaccacaaccgucacgggcaagauuauccaugaaugguguugccgguccuguacacugccuccccuucgcuucagaggggaggacggaugcugguacggcauggagauccggccggugaaagaaaaggaggaaaaucucguuaagagcauggugucugcuggguccggagaggucgacagcuuuucccugggccugcucuguauuucuaucaugauugaagaggugaugagaagccgcuggucccggaaaaugcugaugaccgggacacuugccguuuucuuucugcucaucaugggacagcugaccuggaacgaucugauuagacuuugcaucauggugggcgccaaugcuucugaccgcaugggcauggggaccacauaucuggcccucauggcgacguucaagaugagaccuauguuugcugucggacugcuguuccggcgccugaccagcagagaggugcuucugcucacaauuggccugucccugguggccucugucgaacuucccaacagccuggaggaacucggggauggacuggccaugggcaucaugauccucaaacugcuuaccgacuuucaaucccaccagcugugggcuacacuccugagccugaccuucauuaagacgacauuuucucuucauuacgccuggaaaaccauggcuaugguucuguccaucgugagccucuucccccugugucucucuaccacaucccagaagaccacauggcugccugugcuucuggggagccugggaugcaagccgcucacgauguuucugauugccgagaauaaaaucuggggccggaagucuuggccccuuaacgaaggcauuauggcggucgggaucguguccauccugcucagcucccugcucaaaaacgauguuccucuggccggaccccuuauugcuggcgggaugcugaucgccuguuaugugauuagcggaucuagcgcugaccugucccucgagaaggccgccgaggucucuugggaagaggaagcugagcacagcggcgcgucccauaauauccugguggaaguucaggaugacgggaccaugaaaauuaaggaugaggagcgcgacgauacacuuaccauccugcucaaagccacacugcucgcugugucuggagucuacccucugagcauccccgccacccuuuucgugugguauuucuggcaaaagaagaaacagagauccggcguccugugggacacgccuucucccccggaaguggagcgggccguucuggaugacggcauuuaccgcaucaugcagagagggcuccugggacggagccaggugggcgucgggguguuucaagaaaacguuuuccacaccauguggcacgugacacgcggagcuguccuuauguaucagggcaagagacuggagccuuccugggccagcgugaaaaaggaccucauuucuuacgggggaggcuggcggcugcagggcuccuggaauaccggggaggaagugcagguuaucgcggucgagcccggcaagaacccuaagaaugugcaaacagcucccggcaccuuuaagacaccggaaggggaggugggagccauugcccucgauuucaaaccuggcacgagcgggucucccaucgucaacagagaaggaaagauugugggccuguacggcaaugggguugugaccacauccggaaccuaugucagcgcuaucgcccaggcgaaggcuucccaggagggcccucuucccgagaucgaagacgagguguuucgcaagcggaaccugaccauuauggaucugcaucccgggucuggaaaaacaagacgcuaccucccugccaucguucgggaagccauuaagagaaagcugcgcacgcuuauccuggcuccgacccggguggucgccagcgagauggcugaagcccucaaaggcaugcccauuagauaucaaacaaccgcggugaaguccgagcacacagggaaagagaucguugaccugaugugccaugccaccuucacgaugcgccugcucagcccugugcggguccccaauuacaacaugaucauuauggaugaagcucacuuuacagacccuucuuccaucgccgcuagaggcuauauuagcacccgggugggaaugggcgaggccgccgcuaucuucaugaccgcgacacccccugggucuguggaagccuuuccgcagagcaaugcugucauucaggaugaggaacgcgacauccccgagagauccuggaacucuggauacgaguggaucaccgauuucccuggcaagacaguuugguuugugcccagcauuaaauccgggaaugacaucgccaacugucuucggaagaauggaaagcgcgugauucagcugucuagaaaaaccuucgauacggaauaucaaaagaccaagaacaacgacugggacuacgucgugaccacagauaucagcgagaugggcgccaauuuccgggcugacagaguuauugauccucgccggugccugaagcccgugauccucaaagacgggccggaaagagucauucuggccggcccuaugcccgugaccguugcguccgcugcccagcgccggggaagagugggccgcaaccauaauaaggagggggaucaguacaucuauaugggacagccccuuaacaaugacgaggaucacgcccacuggacggaagcuaagaugcugcucgacaacaucaauaccccugagggcauuauccccgcccuguuugaaccugagcgggagaaaagcgcggccauugauggggaguacagacugcgcggagaggcuagaaagacauucgucgaacucaugcggcgcggcgaccuuccgguguggcugucuuauaaagucgccuccgagggguuucaauacagcgauagacgguggugcuucgacggcgaacgcaacaaucaggugcuggaggaaaacauggauguugagaucuggaccaaggagggagaacgcaaaaagcuccggcccagauggcuggacgcucgcacauauuccgacccucuugcccugcgggaguuuaaagaguucgcugccggcagacgcucugugagcggggaucucauucuggagaucggaaagcugccccagcaucucacccagcgggcgcaaaaugcccuugacaaccuggugaugcugcacaauuccgaacagggcgggagagcuuaccggcaugccauggaggagcucccugauacaaucgaaacccugaugcuucuggcucucauugccguccugacgggaggcguuacacuguuuuuccucucuggccgcgggcuuggaaagaccagcaucggccugcugugugugauggccuccagcgugcuccuguggauggcuucugucgagccccacuggauugcggccuccaucauucuugaauuuuuccugauggugcuccugaucccggagccugacagacagcggacaccccaggauaaccaacuggcuuauguugugaucgggcuccuuuuuaugauucugacagucgccgccaaugagaugggacugcucgaaaccaccaaaaaggaccugggcaucgggcacguggcugucgagaaccaucaccaugccgcgaugcuugauguggaccugcacccugccagcgcuuggacgcucuacgccguugcuaccacaauuaucacccccaugaugcgccauacaauugaaaacaccacggccaauaucucucugaccgcgauugccaaccaggcugccauccugaugggacucgauaaaggcuggccuaucuccaagauggacauuggcgugccccuucuggcucuggggugcuacagccaggucaauccgcucacacugaccgccgcugugcuuaugcugguugcccacuaugcgaucauuggaccuggccuccaagccaaagcuacaagagaggcccagaagcggaccgcugccgggaucaugaagaaccccacgguggauggaauugucgccaucgaccuggaucccgugguguacgacgcgaaauucgaaaagcagcugggccagaucaugcuccuuauucuguguacaucucaaauccugcucaugcgcaccacaugggcucugugcgagagcauuacccuugccaccgggccucugacaacgcucugggagggauccccgggcaaauuuuggaauaccacaaucgcuguuucuauggccaacauuuucagaggcagcuaucuggccggggcuggacuggccuucucccucaugaaaagccuuggcgggggacggcgcggcaccggggcgcagggagaaacacugggcgagaaauggaagagacagcugaaucagcucuccaagucugaauuuaacaccuacaaacggagcggcaucauggaggucgacagauccgaagccaaggaggggcugaaacgcggagagacgacaaagcacgcugugucucggggcaccgccaaacuuagaugguucguggaacgcaaucuggucaagcccgaggggaagguuaucgaucucggauguggcagagggggauggagcuauuacugcgcuggccugaaaaaggugaccgaagugaaaggcuauacaaaagggggaccuggccaugaggaacccauuccuauggccaccuacggguggaaccuggucaaacuccacuccggaaaggacguguuuuucauucccccugagaaaugugauacacuucugugcgacaucggcgagucuagcccgaaucccacgaucgaagaggggagaacccugcgcguucucaagaugguggaaccuuggcugcggggaaaccaauuuuguauuaagauccuuaaucccuacaugccuuccgucguggagacacuggagcagaugcagagaaaacauggcggcaugcucguucgcaacccccugagcagaaauucuacccacgaaauguauuggguguccugcgggacaggaaacauugucagcgcggugaauaugaccucuagaaugcugcucaaccgcuucacgauggcccaccggaagccgaccuacgagagagauguggaccugggcgcugggacacgccaugucgccguugaaccugagguggcuaaccuugauaucaucggacagagaauugaaaauaucaaacacgagcauaaguccaccuggcacuaugacgaggauaaccccuacaaaacaugggccuaucauggcagcuacgaagugaagcccucuggguccgcuagcuccauggucaauggagugguuaagcugcucaccaaaccuugggacgugauucccauggucacacaaaucgccaugaccgauacgacaccuuuuggccagcagcggguguucaaggagaaaguugacacccgcaccccgaaggcgaaaagaggcacaacgcaaauuauggaagugaccgcccgguggcuguggggguuucuuagcagaaacaagaagccccggaucuguacacgcgaggaguucaccagaaaaguccggucuaaugcugccaucggagcuguguuuguugacgagaaccaguggaauagcgccaaggaggccguggaagaugagcgcuucugggaccugguccacagagaacgggagcuccacaaacagggcaagugcgcgacaugcguguauaacaugauggggaaacgcgaaaagaagcugggagaguuuggcaaagcuaagggguccagagccauuugguacauguggcugggcgcccgguuccucgaguucgaagcucugggauuuaugaaugaggaucauugguucucucgcgaaaacagccuuuccggcgucgagggggagggacugcacaaacucggcuacauccugagagacauuucuaagaucccugggggaaauauguaugccgaugacaccgcuggcugggauacacggauuaccgaagacgaucuucagaacgaggccaaaaucacggacaucauggaacccgagcaugcgcugcucgccaaggcuauuuuuaaacugaccuaccaaaauaaggugguucgcgugcagagaccugccaagaacgggacagucauggaugugaucagccggcgcgaccagagaggcuccggacaggugggcaccuaugggcugaauacauucaccaacauggaagcucaacucauucggcagauggagucugagggaaucuuuagccccuccgaacuggagacgccgaaccuugccgaaagaguucuggauuggcucgagaaauacggcguggaacgccugaagcggauggcgauuagcggggacgacugugucgugaaaccuaucgaugacagauucgccacagcucuuaccgcccugaaugauaugggaaagguucgcaaagacaucccccagugggagccuucuaagggcuggaacgauuggcagcaagugcccuuuugcucccaccacuuccaucagcucauuaugaaggacgggcgggagaucgucgugccuuguagaaaucaggaugaacuggucggccgcgcucgggugagccagggagccggcuggucucugagagagacagcuugccucgggaaauccuaugcccaaauguggcagcugauguacuuucaccgccgggaccuuagacuggcggccaacgcuauuuguagcgccguucccguggauugggucccgaccucccgcacgaccuggucuauccaugcccaccaucaguggaugacaaccgaagacaugcucagcguguggaaucggguuuggauugaggaaaacccuuggauggaggauaagacacacguguccagcugggaggacguccccuaucugggaaaaagagaagaccaauggugcggcucucuuaucgggcugaccgcucgggccacaugggcgaccaauauucagguggcuaucaaccaggugagacgccucaucggaaaugagaacuaccuggauuacaugacguccaugaagcgguucaaaaaugaaagcgaccccgagggcgcccugugguga

SEQ ID NO: 19431 - RNA, 9879 nt, Artificial Sequence
  derived and/or modified CDS sequence (opt5) from DENV-1__KC762644__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccgugguuguggaugagcacugcggaaaccggggccccagccugagaacaaccacagucaccggcaagaucauccaugaaugguguugccgguccuguacgcugccuccccuucgcuucagaggggaggacggaugcugguacggcauggagauucggccggugaaagaaaaggaggaaaaucucguuaagagcauggugucugcuggguccggagaggucgacagcuuuucccugggccugcucuguaucucuauuaugaucgaagaggugaugagaagccgcuggucccggaaaaugcugaugacagggacccuugccguuuucuuucugcucauuaugggacagcugacauggaacgaucugaucagacuuugcauuauggugggcgccaaugcuucugaccgcaugggcauggggaccaccuaucuggcccucauggcgacauucaagaugagaccuauguuugcugucggacugcuguuccggcgccugacgagcagagaggugcuucugcucaccaucggccugucccugguggccucugucgaacuucccaacagccuggaggaacucggggauggacuggccaugggcaucaugauucucaaacugcuuacagacuuucaaucccaccagcugugggcuacccuccugagccugacauucaucaagaccacguuuucucuucauuacgccuggaaaacaauggcuaugguucuguccauugugagccucuucccccugugucucucuaccaccucccagaagacaaccuggcugccugugcuucuggggagccugggaugcaagccgcucacaauguuucugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuaugugaucagcggaucuagcgcugaccugucccucgagaaggccgccgaggucucuugggaagaggaagcugagcacagcggcgcgucccauaauauucugguggaaguucaggaugacgggacgaugaaaaucaaggaugaggagcgcgacgauacccuuacaauccugcucaaagccacccugcucgcugugucuggagucuacccucugagcauucccgccacacuuuucgugugguauuucuggcaaaagaagaaacagagauccggcguccugugggacaccccuucucccccggaaguggagcgggccguucuggaugacggcaucuaccgcauuaugcagagagggcuccugggacggagccaggugggcgucgggguguuucaagaaaacguuuuccacacgauguggcacgugacccgcggagcuguccuuauguaucagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauuuaagaccccggaaggggaggugggagccaucgcccucgauuucaaaccuggcacaagcgggucucccauugucaacagagaaggaaagaucgugggccuguacggcaaugggguugugacgaccuccggaacauaugucagcgcuaucgcccaggcgaaggcuucccaggagggcccucuucccgagauugaagacgagguguuucgcaagcggaaccugaccaucauggaucugcaucccgggucuggaaaaaccagacgcuaccucccugccauuguucgggaagccaucaagagaaagcugcgcacacuuauucuggcuccgacgcggguggucgccagcgagauggcugaagcccucaaaggcaugcccaucagauaucaaaccacagcggugaaguccgagcacaccgggaaagagaucguugaccugaugugccaugccacauucaccaugcgccugcucagcccugugcggguccccaauuacaacaugauuaucauggaugaagcucacuuuacggacccuucuuccauugccgcuagaggcuauaucagcacacgggugggaaugggcgaggccgccgcuauuuucaugaccgcgacacccccugggucuguggaagccuuuccgcagagcaaugcugucauccaggaugaggaacgcgacauccccgagagauccuggaacucuggauacgaguggauuacagauuucccuggcaagaccguuugguuugugcccagcaucaaauccgggaaugacauugccaacugucuucggaagaauggaaagcgcgugauccagcugucuagaaaaacauucgauaccgaauaucaaaagacgaaaaacaacgacugggacuacgucgugacaaccgauauuagcgagaugggcgccaauuuccgggcugacagaguuaucgauccucgccggugccugaagcccgugauucucaaagacgggccggaaagagucauccuggccggcccuaugcccgugacaguugcguccgcugcccagcgccggggaagagugggccgcaaccauaauaaggagggggaucaguacaucuauaugggacagccccuuaacaaugacgaggaucacgcccacuggaccgaagcuaagaugcugcucgacaacauuaauacgccugagggcaucauucccgcccuguuugaaccugagcgggaaaagagcgcggccaucgauggggaguacagacugcgcggagaggcuagaaagaccuucgucgagcucaugcggcgcggcgaccuuccgguguggcugucuuauaaagucgccuccgagggguuucaauacagcgauagacgguggugcuucgacggcgaacgcaacaaucaggugcuggaggaaaacauggauguugagauuuggacaaaggagggagaacgcaaaaagcuccggcccagauggcuggacgcucgcaccuauuccgacccucuugcccugcgggaguuuaaagaguucgcugccggcagacgcucugugagcggggaucucauccuggagaucggaaagcugccccagcaucucacacagcgggcgcaaaaugcccuugacaaccuggugaugcugcacaauuccgaacagggcgggagagcuuaccggcaugccauggaggagcucccugauaccauugaaacacugaugcuucuggcucucaucgccguccugaccggaggcguuacgcuguuuuuccucucuggccgcgggcuuggaaagacaagcauuggccugcugugugugauggccuccagcgugcuccuguggauggcuucugucgagccccacuggaucgcggccuccauuauccuugaauuuuuccugauggugcuccugaucccggagccugacagacagcggacaccccaggauaaccaacuggcuuauguugugauugggcuccuuuuuaugauccugaccgucgccgccaaugagaugggacugcucgaaacaaccaaaaaggaccugggcauugggcacguggcugucgagaaccaucaccaugccgcgaugcuugauguggaccugcacccugccagcgcuuggacacucuacgccguugcuacgaccaucauuacacccaugaugcgccauaccaucgaaaacacaaccgccaauauuucucugacggcgaucgccaaccaggcugccauccugaugggacucgauaaaggcuggccuauuuccaagauggacaucggcgugccccuucuggcucuggggugcuacagccaggucaauccgcucacccugacagccgcugugcuuaugcugguugcccacuaugcgauuaucggaccuggccuccaagccaaagcuaccagagaggcccagaagcggacagcugccgggauuaugaagaaccccaccguggauggaaucgucgccaucgaccuggaucccgugguguacgacgcgaaauucgaaaagcagcugggccagauuaugcuccuuauccuguguacgucucaaauucugcucaugcgcacaaccugggcucugugcgagagcaucacacuugccaccgggccucugaccacacucugggagggauccccgggcaaauuuuggaauacgaccauugcuguuucuauggccaacaucuucagaggcagcuaucuggccggggcuggacuggccuucucccucaugaaaagccuuggcgggggacggcgcggcacaggggcgcagggagaaacccugggcgagaaauggaagagacagcugaaucagcucuccaagucugaauuuaacacauacaaacggagcggcaucauggaggucgacagauccgaagccaaggaggggcugaaacgcggagagaccacgaagcacgcugugucucggggcacagccaaacuuagaugguucguggaacgcaaucuggucaagcccgaggggaagguuauugaucucggauguggcagagggggauggagcuauuacugcgcuggccugaaaaaggugaccgaagugaaaggcuauaccaaagggggaccuggccaugaggaacccaucccuauggccacauacggguggaaccuggucaaacuccacuccggaaaggacguguuuuucauucccccugagaaaugugauacccuucugugcgacaucggcgagucuagcccgaaucccacaauugaagaggggagaacgcugcgcguucucaagaugguggaaccuuggcugcggggaaaccaauuuuguaucaagauucuuaaucccuacaugccuuccgucguggagacccuggagcagaugcagagaaaacauggcggcaugcucguucgcaacccccugagcagaaauucuacacacgaaauguauuggguguccugcgggaccggaaacaucgucagcgcggugaauaugacaucuagaaugcugcucaaccgcuucaccauggcccaccggaagccgacguacgagagagauguggaccugggcgcugggacccgccaugucgccguugaaccugagguggcuaaccuugauaucauuggacagagaaucgaaaauauuaaacacgagcauaaguccacauggcacuaugacgaggauaaccccuacaaaaccugggccuaucauggcagcuacgaagugaagcccucuggguccgcuagcuccauggucaauggagugguuaagcugcucacaaaaccuugggacgugauccccauggucacccaaauugccaugacagauaccacgccuuuuggccagcagcggguguucaaggagaaaguugacacacgcaccccgaaggcgaaaagaggcaccacacaaaucauggaagugacggcccgguggcuguggggguuucuuagcagaaacaagaagccccggaucuguacccgcgaggaguucacaagaaaaguccggucuaaugcugccauuggagcuguguuuguugacgagaaccaguggaauagcgccaaggaggccguggaagaugagcgcuucugggaccugguccacagagaacgggagcuccacaaacagggcaagugcgcgaccugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcgucgagggggagggacugcacaaacucggcuacauucugagagacaucucuaagauuccugggggaaauauguaugccgaugacacagcuggcugggauacccggaucacagaagacgaucuucagaacgaggccaaaaucaccgacauuauggaacccgagcaugcgcugcucgccaaggcuaucuuugaacugacguaccaaaauaaagugguucgcgugcagagaccugccaagaacgggaccgucauggaugugauuagccggcgcgaccagagaggcuccggacaggugggcacauaugggcugaauaccuucacaaacauggaggcucaacucauccggcagauggagucugaaggaauuuuuagccccuccgagcuggaaaccccgaaccuugccgagagaguucuggauuggcucgaaaaguacggcguggagcgccugaaacggauggcgaucagcggggacgacugugucgugaagccuaucgaugacagauucgccacggcucuuacagcccugaaugauaugggaaaaguucgcaaggacauuccccagugggagccuucuaaaggcuggaacgauuggcagcaagugcccuuuugcucccaccacuuccaucagcucaucaugaaggacgggcgggaaauugucgugccuuguagaaaucaggaugagcuggucggccgcgcucgggugagccagggagccggcuggucucugagagaaaccgcuugccucgggaaguccuaugcccaaauguggcagcugauguacuuucaccgccgggaccuuagacuggcggccaacgcuaucuguagcgccguucccguggauugggucccgacaucccgcaccacguggucuauucaugcccaccaucaguggaugaccacagaggacaugcucagcguguggaaucggguuuggaucgaagagaacccuuggauggaggauaaaacccacauuuccagcugggaagacgugcccuaucugggaaagagagaggaccaauggugcggcucucuuaucgggcugacagcucgggccaccugggcgacaaauauccaggucgcuauuaaccaggugagacgccucaucggaaaugaaaacuaccuggauuacaugaccuccaugaaacgguucaagaaugagagcgaccccgagggcgcccugugguga

SEQ ID NO: 19432 - RNA, 9879 nt, Artificial Sequence
  derived and/or modified CDS sequence (opt5) from DENV-1__KC762630__SS-prME
agcgugaccguccuguucaugcuccugcccacagcccuugcuuuucaccugacgaccagaggcggggagccucauaugaucguuuccaagcaggaacggggaaaaucucuccuguucaagacaagcgccggcgugaacaugugcacccuuauugcgauggaccugggggagcucugugaagauacaaugaccuacaaaugcccgcgcaucacagagaccgaacccgacgauguggacuguuggugcaaugcuacggagaccugggucacauauggaaccuguucccaaacaggcgagcacagacgggauaagcgcucuguggcccuggccccucauguugggcugggacucgaaaccagaacggagacauggaugagcuccgaaggcgcuuggaaacagauucagaagguggagaccugggcccugcggcaccccggcuuuacagucaucgcucuuuuccuggcccaugcgauugggaccucuaucacccagaagggaaucauuuuuauccuccugaugcuugugacaccuagcauggccaugcgcugcguuggcauugggaacagagacuucguggagggacuguccggcgcuacgugggucgauguggugcucgaacacgggagcugugucaccacaauggccaaaaauaagcccacccuggacaucgagcugcucaaaacagaaguuaccaacccugcuauucugcggaagcuuugcaucgaggccaaaauuucuaauacgacaaccgauucccgcuguccgacccaaggagaagcgacacugguggaggagcaggacaccaacuuugugugcagacggacauucgucgaucgcggcuggggcaauggguguggacucuuuggcaaggggagccugaucacgugcgccaaguucaaaugcgugaccaagcuugaaggaaaaaucguucaguacgagaaccugaaguauucugugauugucacagugcacaccggcgaccagcaucaaguugggaaugaaacaaccgagcacggaacgaccgcuaucauuacaccccaggccccuaccuccgaaauccagcucacagauuacggcgcucugacccuggacuguagccccagaacgggccucgacuuuaacgagauggugcugcuuacaaugaaagagaagucuuggcugguccauaaacagugguuccucgaucugccucuucccuggaccuccggggccagcacaucccaagaaaccuggaaucggcaggaccugcucgugaccuuuaagacagcccacgcuaagaaacaggaggucgugguucugggaucucaagaaggcgcgaugcacacggcccugaccggggcuacagagauucagaccagcggaacaaccacgaucuucgccggccaucucaagugccgccugaaaauggauaagcuuacacugaaagggguguccuaugucauguguaccggcagcuucaagcucgaaaaggagguggccgagacccagcacggaacaguucuggugcaggucaaauacgaaggcaccgacgcuccgugcaagaucccuuuuucuucccaagaugagaaaggggugauucagaacggaagacugaucacagccaaucccauugugacggacaaggaaaaaccuguuaacaucgaggcggagccccccuucggcgaaagcuauauugucgugggggcuggagagaaggcccuuaagcucucuugguuuaaaaagggcagcuccaucgggaaaauguucgaagccaccgcucggggcgccagacgcauggcuauccugggagauacagccugggacuuuggcucuauugggggaguguucaccagcgucggcaagcuggugcaucagaucuuugggacagcguacggaguucucuucuccggcgugagcuggaccaugaaaauugggaucggcauucugcuuacguggcugggacucaauucucgguccaccagccugucuaugacauguaucgccgucggcauggugacccuguaccuugggguuauggugcaggcugauuccggaugcgucauuaacuggaagggcagagagcucaagugugggagcggaaucuuugugacaaacgaaguucacaccuggacagagcaauauaaauuccaggccgacuccccuaagcgccugucugcugccaucggcaaagcgugggaggaaggggugugcggcauucggagcgccaccagacuggagaauaucauguggaagcagauuuccaacgaacucaaucauauccugcuugagaacgauaugaaauuuacggucguggugggagacgucucuggcauucuggcucaggggaagaaaaugauccgcccgcaacccauggaacacaaguacagcuggaaguccuggggaaaagccaagaucauuggcgcugacguucagaauacaaccuucaucauugaugggccuaacacccccgaguguccugacaaucagcgggccuggaacaucugggagguggaagauuauggauuuggcauuuucacaaccaauaucuggcucaaacugagagacagcuacacgcaggugugcgaucaccgccugaugucugccgcuaucaaggacuccaaagcgguccaugccgauaugggcuauuggauugagagcgaaaagaacgagacauggaagcuugcucgggccucuuucaucgaagugaaaaccuguauuuggcccaagucccacacacucuggagcaaugggguucuggagucugagaugaucauuccgaaaaucuacggaggcccugugagccaacauaacuauagacccggguacuuuacccagacagccggaccuuggcaccugggcaagcucgaacuggacuucgaucuuugcgaggggaccacggucgugguugacgaaaauugcggaaaccgcggccccucccugcggaccacaaccgugacaggcaaaaccauccacgagugguguugcagaagcuguacgcucccuccccugcgguuuaagggggaggauggaugcugguacggcauggaaauucgcccggucaaggagaaagaagagaaucuggugaagucuaugguuuccgcugggagcggagaaguggacuccuucucucuuggccuccuguguaucagcauuaugaucgaggaggucaugagaucccgguggucuagaaaaaugcugaugacagggacccucgccguguuucugcuucugacaaugggacagcucaccuggaacgaucugauucgccugugcaucauggugggcgcgaacgcuagcgacaugaugggcauggggaccacauaucuugcccugauggccacguuccggaugagaccuauguuugcugucggacuccuguuccgcagacucaccucccgggaaauucugcuucugacaguuggccucucucugguggccagcguggagcugcccaauucccuugaagagcugggggacggacucgcgaugggcaucaugaugcugaagcuccugaccgauuuucaaccccaucagcuuugggcuacacugcucagccugaccuucgucaaaacgacacugucucuucacuacgccuggaagaccauggccaugauccuguccauugugagccuccugccucucugucugucuaccacaucccagaagaccacauggcuuccgguucugcuggggagccucggaugcaaaccccugacgauguuucuuaucaccgaaaacaagauuuggggccgcagaucuuggccucugaaugagggcaucauggcuauugggaucguguccauccuccugagcucccuccugaaaaacgacgucccccuugccggaccucugauugcuggcgggaugcugaucgccuguuaugugauuagcggaucuagcgcggaucucucccuggagaaggccgcugaaguuucuugggaggacgaagccgagcauagcggcgcuucccacaauauccuuguggaaguccaggaugacgggacaaugaaaauuaaggaugaggagcgggacgauacccugacaauccuccugaaagccacccuccuggugaucucuggagucuaccccaugagcgugccugccacgcuuuucguuugguauuuuuggcaaaagaagaaacagcgcuccggcgugcugugggacacccccucuccgccugaagucgagagagcugugcuggauaacggcauuuaccggauccuccagcgcgggcugcuuggaagaagccagguuggcgugggggucuuccaagaaggaguguuccauacaauguggcacgugacccggggcgcgguucugauguaucaggggaagcgccucgagcccuccugggccagcgucaaaaaggaccugauuucuuacggaggcggcuggagauuucagggguccuggaauacaggagaggaagugcaggugaucgcugucgagccuggcaaaaaccccaagaaugugcaaaccacaccggggacguucaagaccccugaaggagagauuggcgccaucgcccucgauuuuaaacccgggacaagcggaucuccuauuguuaaccgggaaggcaagaucgugggccuguacgggaauggagucgugaccaccuccggcacauauguuagcgcuaucgcccaggcgaaagugucccaggaggggccccuucccgagauugaagacgaggucuucagaaagcgcaaccugacgaucauggaccugcacccuggaucuggcaaaacccggagauaccucccggcuauugugcgcgaagccaucaagcggaagcugagaacacuuguucuggcccccacccgcguggucgcuagcgagauggccgaagcgcucaaagggaugccuauucgguaucaaacaaccgcugugaaguccgagcauacgggcaaagagaucguggaucugaugugccacgccacauuuaccaugagacugcucagccccguccgcguuccuaauuacaacaugaucauuauggacgaagcccauuucaccgaucccgcuucuaucgccgcucggggauauauuuccacaagagugggcaugggggaggccgcggccaucuuuaugaccgcuacaccuccgggaagcguggaagccuucccccagucuaaugcugucauucaggacgaggaacgggauaucccugagcgcagcuggaacuccggcuacgaguggaucaccgacuuucccgggaagacggugugguucguuccuucuauuaaaagcggaaacgauaucgccaauugucuuagaaagaacggcaagcgggugguccagcugucccgcaaaacauuugacaccgaauaucaaaagacaaaaaauaacgauugggacuacgugguuaccacggauauuucugagaugggggccaauuucagagcugaccgggugaucgaccccagacgcugccugaagccggucauucucaaagauggcccugaacgggugauccuggcgggacccaugcccgucaccguggccagcgcugcccagagacgcggccggauugggagaaacccuaauaaggagggagaccaguacguuuauaugggccagccccuuaacaaugaugaggaccacgcccauuggacagaagcuaagaugcugcucgauaacaucaauaccccugaggggaucauuccggcccuguucgaacccgagcgcgaaaaauccgcggcuaucgacggagaguaccggcugagaggcgaggcccgcaagacauuuguggaacucaugagacggggggaucuuccuguguggcugagcuauaaagucgccucugagggcuuccaauacuccgaccgcagauggugcuuugauggagaacggaacaaucagguucuggaggaaaacauggacguggagauuuggaccaaggagggcgaacgcaaaaagcucagaccccgguggcuggaugcuagaacauauagcgacccucuugcccugcgcgaguucaaagaauuugcggccgggcggagauccgugucuggagaucucauccuggagauuggcaagcugccccagcaccucacccuuaaggcucagaaugcccuggacaaccuggucaugcuccacaacagcgaacaagggggaaaagcuuaccgccaugccauggaggagcugccggacacgaucgaaacacuuaugcugcucgcucugaucgccgugcugaccggcggcguuacccucuucuuucuuuccgggcggggacugggcaagacaucuauugggcugcucugugugauggcgagcuccgcccugcuuuggauggcuagcgucgagccucacuggaucgccgcuucuauuauccuggaauucuuucucauggugcugcugauucccgagccugauagacagcggaccccccaggacaaucagcucgccuaugucgugaucggacuucuguucaugauccugacaguugccgcuaacgagaugggccuccuggaaacgaccaaaaaggaucuugggauuggacaugcggccgcugagaaucaccaccaugccgccaugcuggacguggaucuccacccugcuuccgccuggacacuguacgcggucgccaccacaaucauuacccccaugaugcgccauacgaucgaaaacaccacagcuaauauuagccugaccgccaucgcuaaccaagccgcgauucucaugggccuugacaaaggcuggccgaucucuaagauggauaucggggugccucugcuggcccucggaugcuacucccagguuaauccccugacacuuaccgcugccgugcugaugcucgucgcucacuaugccauuaucggccccgggcugcaggcuaaggccacgagagaggcgcaaaaacggacagccgcuggaauuaugaagaacccuaccguggacggcaucguggccauugaucuggacccgguuaucuacgaugcuaaauuugaaaagcagcucgggcagaucaugcuucugauucuguguacaagccagauccuccugaugcgcaccaccugggcccuuugcgagucuauuacacuggccacgggaccccucaccacacugugggagggcagcccuggcaaauucuggaauaccacaaucgcggucuccauggcuaacauuuuuagagggucuuaucuggccggagcuggccucgccuucagccuuaugaagucccuggggggaggccggcgcgggaccggagcccaaggcgaaacgcugggcgagaaguggaaaagacagcucaaucagcugagcaaguccgaauucaacaucuacaaacggucugggaucauugagguggaccgcagcgaagcuaaggagggacuuaaaagaggcgagacaaccaagcaugccgugucccgggggaccgcgaagcugagaugguuugucgaacgcaaucucguuaaacccgagggaaaggugaucgaucugggcugugggcggggaggcuggucuuauuacugcgccggccugaaaaaggugacagaagucaaaggguauaccaagggaggcccugggcacgaggaacccauuccuauggcuacauacggauggaaccucgugaaacuucacagcggcaaggacguuuucuuuacgccgcccgagaagugugacacccugcugugcgauaucggggaguccucuccuaaucccacaauugaagagggaagaacccuccgcgugcugaaaauggucgaaccuuggcuucggggcaaccaguucuguaucaagauucugaaucccuacaugccgagcgugguugagacacucgagcaaaugcagagaaaacauggcgggaugcuggugcgcaacccucugucccggaacagcacccacgaaauguauugggucucuugcggaacgggcaauaucguguccgccgugaacaugaccagcagaaugcuccugaaucgcuuuacaauggcucaucggaagcccaccuacgagagagacgucgaucuuggggccggaacacgccacguugcgguggaacccgagguggccaaccuggacaucauuggccagcggaucgaaaauauuaaaaacgagcacaagucuaccuggcauuaugaugaggacaauccuuacaagacaugggcuuaucacggguccuacgaagucaaacccagcggaucugccuccagcauggugaacggcguugugagacuccugaccaagccuugggaugucaucccgauggugacgcagauugcuaugacagacaccacccccuucggccaacagcgcguuuuuaaagagaagguggauacaagaacgccuaaagccaagcgggggaccgcucagaucauggaagucacagcccgcuggcuuuggggauuccuguccagaaauaagaaaccccggaucuguaccagagaggaauuuacacggaaggugcgcagcaacgcggccauuggcgcuguuuucguggacgagaaucaauggaacucugccaaagaggcugucgaagaugagagauuuugggaccucgugcaucgggaacgcgagcugcacaagcaggggaaaugcgccaccugcgucuauaauaugaugggaaagagagaaaagaaacugggcgaguucgggaaggccaaaggcagccgggcgaucugguacauguggcucggagcucgcuuucuggaguucgaagcccuuggcuucaugaacgaggaccauugguuuuccagagaaaauucucugagcgggguggagggagagggccuccacaagcugggguacauucuucgggauaucuccaaaauuccuggaggcaacauguaugccgacgauacagcugggugggacacccgcaucacggaagaugaccugcagaacgaggccaagaucaccgauauuauggaacccgagcacgcucuccuggccacaucuaucuucaaacugaccuaccagaauaagguugugagaguccaacggccgggcaagaacggaacagugauggacgugauuagccgcagagaucagcggggcuccgggcagguuggaaccuauggccucaauacguuuacaaacauggaagcgcagcugauccgccaaauggagucugaggggauuuucagcccuuccgaacuugagacccccaaucuggccgaaagaguguuugacuggcucgagaaacauggaaucgaacggcugaagagaauggcuaucagcggcgaugacugugucgugaaaccuauugaugaccgcuucgccacagcucuuaccgcccugaacgacauggggaagguucggaaagauaucccccagugggagccuucuaagggcuggaaugacuggcagcaggugcccuuuugcucccaccauuuccaccaacucauuaugaaggauggaagagagaucgucgugccgugucgcaaccaggacgaacuggucggccgggcgagagugagccagggggccggauggucucugcgcgagacggcuugccucggcaaauccuacgcccagauguggcaacugauguauuuucaccggagagaucuucgccuggcugccaaugcuauuuguagcgccguuccuguggacuggguccccaccucccggacaaccuggucuauccaugcgcaccaucaguggaugacaaccgaagauaugcucagcguguggaacagaguuuggauugaggaaaaucccuggauggaggacaagacacacguguccagcugggaggaugucccuuaccuggggaaacgcgaagaccaguggugcggaucucuuaucggccugaccgcccgggcuacgugggccacaaacauccaaguggccauuaaucaggugagacggcucaucgggaacgagaauuaucuggauuacaugaccuccaugaagagauucaaaaacgaaagcgacccggagggcgcucugugguga

SEQ ID NO: 19433 - RNA, 9879 nt, Artificial Sequence
  derived and/or modified CDS sequence (opt5) from DENV-1__KC762641__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccgugguuguggaugagcacugcggaaaccggggccccagccugagaacaaccacagucaccggcaagaucauccaugaaugguguugccgguccuguacgcugccuccccuucgcuucagaggggaggacggaugcugguacggcauggagauucggccggugaaagaaaaggaggaaaaucucguuaagagcauggugucugcuggguccggagaggucgacagcuuuucccugggccugcucuguaucucuauuaugaucgaagaggugaugagaagccgcuggucccggaaaaugcugaugacagggacccuugccguuuucuuucugcucauuaugggacagcugacauggaacgaucugaucagacuuugcauuauggugggcgccaaugcuucugaccgcaugggcauggggaccaccuaucuggcccucauggcgacauucaagaugagaccuauguuugcugucggacugcuguuccggcgccugacgagcagagaggugcuucugcucaccaucggccugucccugguggccucugucgaacuucccaacagccuggaggaacucggggauggacuggccaugggcaucaugauucucaaacugcuuacagacuuucaaucccaccagcugugggcuacccuccugagccugacauucaucaagaccacguuuucucuucauuacgccuggaaaacaauggcuaugguucuguccauugugagccucuucccccugugucucucuaccaccucccagaagacaaccuggcugccugugcuucuggggagccugggaugcaagccgcucacaauguuucugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuaugugaucagcggaucuagcgcugaccugucccucgagaaggccgccgaggucucuugggaagaggaagcugagcacagcggcgcgucccauaauauucugguggaaguucaggaugacgggacgaugaaaaucaaggaugaggagcgcgacgauacccuuacaauccugcucaaagccacccugcucgcugugucuggagucuacccucugagcauucccgccacacuuuucgugugguauuucuggcaaaagaagaaacagagauccggcguccugugggacaccccuucucccccggaaguggagcgggccguucuggaugacggcaucuaccgcauuaugcagagagggcuccugggacggagccaggugggcgucgggguguuucaagaaaacguuuuccacacgauguggcacgugacccgcggagcuguccuuauguaucagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauuuaagaccccggaaggggaggugggagccaucgcccucgauuucaaaccuggcacaagcgggucucccauugucaacagagaaggaaagaucgugggccuguacggcaaugggguugugacgaccuccggaacauaugucagcgcuaucgcccaggcgaaggcuucccaggagggcccucuucccgagauugaagacgagguguuucgcaagcggaaccugaccaucauggaucugcaucccgggucuggaaaaaccagacgcuaccucccugccauuguucgggaagccaucaagagaaagcugcgcacacuuauucuggcuccgacgcggguggucgccagcgagauggcugaagcccucaaaggcaugcccaucagauaucaaaccacagcggugaaguccgagcacaccgggaaagagaucguugaccugaugugccaugccacauucaccaugcgccugcucagcccugugcggguccccaauuacaacaugauuaucauggaugaagcucacuuuacggacccuucuuccauugccgcuagaggcuauaucagcacacgggugggaaugggcgaggccgccgcuauuuucaugaccgcgacacccccugggucuguggaagccuuuccgcagagcaaugcugucauccaggaugaggaacgcgacauccccgagagauccuggaacucuggauacgaguggauuacagauuucccuggcaagaccguuugguuugugcccagcaucaaauccgggaaugacauugccaacugucuucggaagaauggaaagcgcgugauccagcugucuagaaaaacauucgauaccgaauaucaaaagacgaaaaacaacgacugggacuacgucgugacaaccgauauuagcgagaugggcgccaauuuccgggcugacagaguuaucgauccucgccggugccugaagcccgugauucucaaagacgggccggaaagagucauccuggccggcccuaugcccgugacaguugcguccgcugcccagcgccggggaagagugggccgcaaccauaauaaggagggggaucaguacaucuauaugggacagccccuuaacaaugacgaggaucacgcccacuggaccgaagcuaagaugcugcucgacaacauuaauacgccugagggcaucauucccgcccuguuugaaccugagcgggaaaagagcgcggccaucgauggggaguacagacugcgcggagaggcuagaaagaccuucgucgagcucaugcggcgcggcgaccuuccgguguggcugucuuauaaagucgccuccgagggguuucaauacagcgauagacgguggugcuucgacggcgaacgcaacaaucaggugcuggaggaaaacauggauguugagauuuggacaaaggagggagaacgcaaaaagcuccggcccagauggcuggacgcucgcaccuauuccgacccucuugcccugcgggaguuuaaagaguucgcugccggcagacgcucugugagcggggaucucauccuggagaucggaaagcugccccagcaucucacacagcgggcgcaaaaugcccuugacaaccuggugaugcugcacaauuccgaacagggcgggagagcuuaccggcaugccauggaggagcucccugauaccauugaaacacugaugcuucuggcucucaucgccguccugaccggaggcguuacgcuguuuuuccucucuggccgcgggcuuggaaagacaagcauuggccugcugugugugauggccuccagcgugcuccuguggauggcuucugucgagccccacuggaucgcggccuccauuauccuugaauuuuuccugauggugcuccugaucccggagccugacagacagcggacaccccaggauaaccaacuggcuuauguugugauugggcuccuuuuuaugauccugaccgucacagccaaugagaugggacugcucgaaaccaccaaaaaggaccugggcauugggcacguggccgucgagaaccaucaccaugcugccaugcuugauguggaccugcacccugcgagcgccuggacgcucuacgcuguugccaccacaaucauuacccccaugaugcgccauacaaucgaaaacaccacggcuaauauuucucugaccgccaucgcgaaccaggccgcuauccugaugggacucgauaaaggcuggccuauuuccaagauggacaucggcgugccccuucuggcccuggggugcuacagccaggucaauccgcucacacugaccgcugccgugcuuaugcugguugcucacuaugccauuaucggaccuggccuccaagcgaaagccacaagagaggcucagaagcggaccgccgcugggauuaugaagaaccccacgguggauggaaucgucgccaucgaccuggaucccgugguguacgacgccaaauucgaaaagcagcugggccagauuaugcuccuuauccuguguacaucucaaauucugcucaugcgcaccacaugggcgcugugcgagagcaucacccuugcuaccgggccucugacaacgcucugggagggauccccgggcaaauuuuggaauaccacaauugccguuucuauggcuaacaucuucagaggcagcuaucuggccggggccggacuggcuuucucccucaugaaaagccuuggcgggggacggcgcggcaccggggcccagggagaaacacugggcgagaaauggaagagacagcugaaucagcucuccaagucugaauuuaacaccuacaaacggagcggcaucauggaggucgacagauccgaagcgaaggaggggcugaaacgcggagagacgacaaagcacgccgugucucggggcaccgcuaaacuuagaugguucguggaacgcaaucuggucaagcccgaggggaagguuauugaucucggauguggcagagggggauggagcuauuacugcgccggccugaaaaaggugaccgaagugaaaggcuauacaaaagggggaccuggccaugaggaacccaucccuauggcuaccuacggguggaaccuggucaaacuccacuccggaaaggacguguuuuucauucccccugagaaaugugauacacuucugugcgacaucggcgagucuagcccgaaucccacgauugaagaggggagaacccugcgcguucucaagaugguggaaccuuggcugcggggaaaccaauuuuguaucaagauucuuaaucccuacaugccuuccgucguggagacacuggagcagaugcagagaaaacauggcggcaugcucguucgcaacccccugagcagaaauucuacccacgaaauguauuggguguccugcgggacaggaaacaucgucagcgccgugaauaugaccucuagaaugcugcucaaccgcuucacgauggcgcaccggaagccgaccuacgagagagauguggaccugggcgccgggacacgccaugucgcuguugaaccugagguggccaaccuugauaucauuggacagagaaucgaaaauauuaaacacgagcauaaguccaccuggcacuaugacgaggauaaccccuacaaaacaugggcuuaucauggcagcuacgaagugaagcccucuggguccgccagcuccauggucaauggagugguuaagcugcucaccaaaccuugggacgugauccccauggucacacaaauugcuaugaccgauacgacaccuuuuggccagcagcggguguucaaggagaaaguugacacccgcaccccgaaggccaaaagaggcacaacgcaaaucauggaagugaccgcgcgguggcuguggggguuucuuagcagaaacaagaagccccggaucuguacacgcgaggaguucaccagaaaaguccggucuaaugccgcuauuggagccguguuuguugacgagaaccaguggaauagcgcuaaggaggccguggaagaugagcgcuucugggaccugguccacagagaacgggagcuccacaaacagggcaagugcgccacaugcguguauaacaugauggggaaacgcgaaaagaagcugggagaguuuggcaaagcgaagggguccagagcuaucugguacauguggcugggcgcccgguuccucgaguucgaagcccugggauuuaugaaugaggaucauugguucucucgcgaaaacagccuuuccggcgucgagggggagggacugcacaaacucggcuacauucugagagacaucucuaagauuccugggggaaauauguaugcugaugacaccgccggcugggauacacggaucaccgaagacgaucuucagaacgaggcuaaaaucacggacauuauggaacccgagcaugcccugcucgcgaaggccaucuuuaaacugaccuaccaaaauaaggugguucgcgugcagagaccugcuaagaacgggacagucauggaugugauuagccggcgcgaccagagaggcuccggacaggugggcaccuaugggcugaauacauucaccaacauggaagcccaacucauccggcagauggagucugagggaauuuuuagccccuccgaacuggagacgccgaaccuugcugaaagaguucuggauuggcucgagaaauacggcguggaacgccugaagcggauggccaucagcggggacgacugugucgugaaaccuaucgaugacagauucgcgacagcccuuaccgcucugaaugauaugggaaagguucgcaaagacauuccccagugggagccuucuaagggcuggaacgauuggcagcaagugcccuuuugcucccaccacuuccaucagcucaucaugaaggacgggcgggagauugucgugccuuguagaaaucaggaugaacuggucggccgcgcccgggugagccagggagcuggcuggucucugagagagacagccugccucgggaaauccuaugcucaaauguggcagcugauguacuuucaccgccgggaccuuagacuggccgcgaacgccaucuguagcgcuguucccguggauugggucccgaccucccgcacgaccuggucuauucaugcccaccaucaguggaugacaaccgaagacaugcucagcguguggaaucggguuuggaucgaggaaaacccuuggauggaggauaagacacacauuuccagcugggaggacgugcccuaucugggaaaaagagaagaccaauggugcggcucucuuaucgggcugaccgcccgggcuacaugggccaccaauauccaggucgcgauuaaccaggugagacgccucaucggaaaugagaacuaccuggauuacaugacguccaugaagcgguucaaaaaugaaagcgaccccgagggcgcucugugguga

SEQ ID NO: 19434 - RNA, 9879 nt, Artificial Sequence
  derived and/or modified CDS sequence (opt5) from DENV-1__KC762648__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucgugcaucagauuuucgggaccgcuuacggagugcuguuuuccggcgucagcuggacgaugaagaucgggauuggcgugcuucugaccuggcucggacucaauucuagauccacaagccugucuaugaccuguaucgccguuggccuugugacacucuaccugggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacgacaugaaguucacaguuguggucggagauguggcuggcauucuggcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaaacuucgcgauuccuacacacagguuugcgaccaccggcucaugagcgccgcuauuaaagauucuaaggccgugcaugccgacaugggcuauuggaucgaauccgagaaaaaugaaaccuggaagcuggcuagagccagcuucaucgaggugaagacauguauuuggcccaaaucucacacccugugguccaacgggguccucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccgugguuguggaugagcacugcggaaaccggggccccagccugagaacaaccacagucaccggcaagaucauccaugaaugguguugccgguccuguacgcugccuccccuucgcuucagaggggaggacggaugcugguacggcauggagauucggccggugaaagaaaaggaggaaaaucucguuaagagcauggugucugcuggguccggagaggucgacagcuuuucccugggccugcucuguaucucuauuaugaucgaagaggugaugagaagccgcuggucccggaaaaugcugaugacagggacccuugccguuuucuuucugcucauuaugggacagcugacauggaacgaucugaucagacuuugcauuauggugggcgccaaugcuucugaccgcaugggcauggggaccaccuaucuggcccucauggcgacauucaagaugagaccuauguuugcugucggacugcuguuccggcgccugacgagcagagaggugcuucugcucaccaucggccugucccugguggccucugucgaacuucccaacagccuggaggaacucggggauggacuggccaugggcaucaugauucucaaacugcuuacagacuuucaaucccaccagcugugggcuacccuccugagccugacauucaucaagaccacguuuucucuucauuacgccuggaaaacaauggcuaugguucuguccauugugagccucuucccccugugucucucuaccaccucccagaagacaaccuggcugccugugcuucuggggagccugggaugcaagccgcucacaauguuucugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuaugugaucagcggaucuagcgcugaccugucccucgagaaggccgccgaggucucuugggaagaggaagcugagcacagcggcgcgucccauaauauucugguggaaguucaggaugacgggacgaugaaaaucaaggaugaggagcgcgacgauacccuuacaauccugcucaaagccacccugcucgcugugucuggagucuacccucugagcauucccgccacacuuuucgugugguauuucuggcaaaagaagaaacagagauccggcguccugugggacaccccuucucccccggaaguggagcgggccguucuggaugacggcaucuaccgcauuaugcagagagggcuccugggacggagccaggugggcgucgggguguuucaagaaaacguuuuccacacgauguggcacgugacccgcggagcuguccuuauguaucagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauuuaagaccccggaaggggaggugggagccaucgcccucgauuucaaaccuggcacaagcgggucucccauugucaacagagaaggaaagaucgugggccuguacggcaaugggguugugacgaccuccggaacauaugucagcgcuaucgcccaggcgaaggcuucccaggagggcccucuucccgagauugaagacgagguguuucgcaagcggaaccugaccaucauggaucugcaucccgggucuggaaaaaccagacgcuaccucccugccauuguucgggaagccaucaagagaaagcugcgcacacuuauucuggcuccgacgcggguggucgccagcgagauggcugaagcccucaaaggcaugcccaucagauaucaaaccacagcggugaaguccgagcacaccgggaaagagaucguugaccugaugugccaugccacauucaccaugcgccugcucagcccugugcggguccccaauuacaacaugauuaucauggaugaagcucacuuuacggacccuucuuccauugccgcuagaggcuauaucagcacacgggugggaaugggcgaggccgccgcuauuuucaugaccgcgacacccccugggucuguggaagccuuuccgcagagcaaugcugucauccaggaugaggaacgcgacauccccgagagauccuggaacucuggauacgaguggauuacagauuucccuggcaagaccguuugguuugugcccagcaucaaauccgggaaugacauugccaacugucuucggaagaauggaaagcgcgugauccagcugucuagaaaaacauucgauaccgaauaucaaaagacgaaaaacaacgacugggacuacgucgugacaaccgauauuagcgagaugggcgccaauuuccgggcugacagaguuaucgauccucgccggugccugaagcccgugauucucaaagacgggccggaaagagucauccuggccggcccuaugcccgugacaguugcguccgcugcccagcgccggggaagagugggccgcaaccauaauaaggagggggaucaguacaucuauaugggacagccccuuaacaaugacgaggaucacgcccacuggaccgaagcuaagaugcugcucgacaacauuaauacgccugagggcaucauucccgcccuguuugaaccugagcgggaaaagagcgcggccaucgauggggaguacagacugcgcggagaggcuagaaagaccuucgucgagcucaugcggcgcggcgaccuuccgguguggcugucuuauaaagucgccuccgagggguuucaauacagcgauagacgguggugcuucgacggcgaacgcaacaaucaggugcuggaggaaaacauggauguugagauuuggacaaaggagggagaacgcaaaaagcuccggcccagauggcuggacgcucgcaccuauuccgacccucuugcccugcgggaguuuaaagaguucgcugccggcagacgcucugugagcggggaucucauccuggagaucggaaagcugccccagcaucucacacagcgggcgcaaaaugcccuugacaaccuggugaugcugcacaauuccgaacagggcgggagagcuuaccggcaugccauggaggagcucccugauaccauugaaacacugaugcuucuggcucucaucgccguccugaccggaggcguuacgcuguuuuuccucucuggccgcgggcuuggaaagacaagcauuggccugcugugugugauggccuccagcgcucuccuguggauggcgucuguggagccccacuggaucgccgcuuccauuauccuugaauuuuuccugaugguccuccugaucccggagccugacagacagcggacaccccaggauaaccaacuggccuaugugguuauugggcuccuuuuuaugauccugaccguggccgcuaaugagaugggacugcucgaaacaaccaaaaaggaccugggcauugggcacgucgccguggagaaccaucaccaugcggccaugcuugaugucgaccugcacccugcuagcgccuggacacucuacgcuguggccacgaccaucauuacacccaugaugcgccauaccaucgaaaacacaaccgcgaauauuucucugacggccaucgcuaaccaggccgcuauccugaugggacucgauaaaggcuggccuauuuccaagauggacaucggcguuccccuucuggcccuggggugcuacagccaggugaauccgcucacccugacagcugccguccuuaugcugguggcgcacuaugccauuaucggaccuggccuccaagcuaaagccaccagagaggcucagaagcggacagccgccgggauuaugaagaaccccaccguugauggaaucguggcgaucgaccuggaucccgucguguacgacgcuaaauucgaaaagcagcugggccagauuaugcuccuuauccuguguacgucucaaauucugcucaugcgcacaaccugggcccugugcgagagcaucacacuugcuaccgggccucugaccacacucugggagggauccccgggcaaauuuuggaauacgaccauugccgugucuauggccaacaucuucagaggcagcuaucuggcuggggccggacuggcguucucccucaugaaaagccuuggcgggggacggcgcggcacaggggcccagggagaaacccugggcgagaaauggaagagacagcugaaucagcucuccaagucugaauuuaacacauacaaacggagcggcaucauggagguugacagauccgaagcuaaggaggggcugaaacgcggagagaccacgaagcacgccgucucucggggcacagcuaaacuuagaugguucguggaacgcaaucuggugaagcccgaggggaaggucauugaucucggauguggcagagggggauggagcuauuacugcgccggccugaaaaagguuaccgaagugaaaggcuauaccaaagggggaccuggccaugaggaacccaucccuauggcgacauacggguggaaccuggugaaacuccacuccggaaaggacgucuuuuucauucccccugagaaaugugauacccuucugugcgacaucggcgagucuagcccgaaucccacaauugaagaggggagaacgcugcgcgugcucaagaugguugaaccuuggcugcggggaaaccaauuuuguaucaagauucuuaaucccuacaugccuuccguggucgagacccuggagcagaugcagagaaaacauggcggcaugcucgugcgcaacccccugagcagaaauucuacacacgaaauguauuggguuuccugcgggaccggaaacaucgugagcgccgucaauaugacaucuagaaugcugcucaaccgcuucaccauggcucaccggaagccgacguacgagagagauguggaccugggcgccgggacccgccauguggcugucgaaccugagguugccaaccuugauaucauuggacagagaaucgaaaauauuaaacacgagcauaaguccacauggcacuaugacgaggauaaccccuacaaaaccugggcuuaucauggcagcuacgaagugaagcccucuggguccgccagcuccauggugaauggagucgugaagcugcucacaaaaccuugggacguuauccccauggugacccaaauugcgaugacagauaccacgccuuuuggccagcagcgggucuucaaggagaaaguggacacacgcaccccgaaggccaaaagaggcaccacacaaaucauggaaguuacggcucgguggcuguggggguuucuuagcagaaacaagaagccccggaucuguacccgcgaggaguucacaagaaaagugcggucuaaugccgcuauuggagccgucuuuguggacgagaaccaguggaauagcgccaaggaggcgguugaagaugagcgcuucugggaccuggugcacagagaacgggagcuccacaaacagggcaagugcgcuaccugcgucuauaacaugauggggaaacgcgaaaagaagcugggagaguuuggcaaagccaagggguccagagccaucugguacauguggcugggcgcucgguuccucgaguucgaagcccugggauuuaugaaugaggaucauugguucucucgcgaaaacagccuuuccggcguggagggggagggacugcacaaacucggcuacauucugagagacaucucuaagauuccugggggaaauauguaugcugaugacacagccggcugggauacccggaucacagaagacgaucuucagaacgaggcgaaaaucaccgacauuauggaacccgagcaugcccugcucgcuaaggccaucuuuaaacugacguaccaaaauaaggucgugcgcguucagagaccugcuaagaacgggaccgugauggaugucauuagccggcgcgaccagagaggcuccggacaggugggcacauaugggcugaauaccuucacaaacauggaagcccaacucauccggcagauggagucugaggaaauuuuuagccccuccgagcuggaaaccccgaaccuugcggagagagugcuggauuggcucgaaaaauacggaguugagcgccugaagcggauggccaucagcggcgacgacuguguggucaaaccuaucgaugacagauucgcuacggcccuuacagcucugaaugauauggggaaggugcgcaaagacauuccccagugggagccuucuaagggauggaacgauuggcagcaaguucccuuuugcucccaccacuuccaucagcucaucaugaaggacggccgggaaauuguggucccuuguagaaaucaggaugagcugguggggcgcgcccgggucagccagggcgcuggauggucucugagagaaaccgccugccucggcaaauccuaugcgcaaauguggcagcugauguacuuucaccgccgggaccuuagacuggccgcuaacgccaucuguagcgccgugcccguugauugggugccgacaucccgcaccacguggucuauucaugcucaccaucaguggaugaccacagaggacaugcucagcgucuggaaucggguguggaucgaagagaacccuuggauggaggauaagacccacauuuccagcugggaagacguucccuaucuggggaaaagagaggaccaauggugcggaucucuuaucggccugacagcccgggcgaccugggcuacaaauauccagguggccauuaaccaggucagacgccucaucgggaaugaaaacuaccuggauuacaugaccuccaugaagcgguucaaaaaugagagcgaccccgagggagcccugugguga

SEQ ID NO: 19435 - RNA, 9879 nt, Artificial Sequence
  derived and/or modified CDS sequence (opt5) from DENV-1__KC762622__SS-prME
agcgugaccaugcugcucaugcugaugcccacagcccuugcuuuccaccugacgacccggggaggggaaccucauaugaucgucuccaagcaggaacggggaaaaucucuccuguuuaagacaagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugauggcccuguuucucgcgcaugccaucgggacaucuauuacccagaagggaaucaucuucauucugcuuaugcuggucaccccuagcauggcuaugagaugcgugggcaucgggucccgggauuuuguugagggacucagcggcgccacauggguggacgucgugcuggagcacgggucuugugugacgaccauggcuaaggauaaacccacacuggacauugaacuccugaagaccgaggucacaaacccugccguucuucgcaaacugugcaucgaagcgaagauuuccaauaccacgacagauagcagauguccgacccaaggagaggccacccucguggaagaacaggacgcuaacuucgugugccggcgcacauuugucgauagaggcuggggcaauggguguggacuguucggcaaagggucucuuaucacaugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggagcacaaauacucuuggaaaagcuggggaaaggccaagaucauuggcgcugacgugcagaauaccaccuuuaucaucgaugggccuaacacacccgaauguccugacgaucagagagcguggaauauuugggaggucgaggacuauggauucggcaucuuuaccacgaacauuuggcugaaacuucgcgauuccuacacacagguuugcgaccaccggcucaugagcgccgcuaucaaagauucuaaggccgugcaugccgacaugggcuauuggauugaauccgagaaaaaugaaaccuggaagcuggcuagagccagcuucaucgaggugaagacauguaucuggcccaaaucucacacccugugguccaacgggguccucgaaagcgagaugauuaucccgaagauuuacggaggcccuacaucucaacauaauuaucgccccggguacuucacccagacggcgggaccuuggcaccugggcaaacuugagcuggauuuugaccucugcgaagggaccacagugguuguggaugagcacugcggaaaccggggccccagccugagaaccacaaccgucacgggcaagaucauucaugaaugguguugccgguccuguacacugccuccccuucgcuucagaggggaggacggaugcugguacggcauggagauccggccggugaaagaaaaggaggaaaaucucguuaagagcauggugucugcuggguccggagaggucgacagcuuuucccugggccugcucuguaucucuauuaugaucgaagaggugaugagaagccgcuggucccggaaaaugcugaugaccgggacacuugccguuuucuuucugcucauuaugggacagcugaccuggaacgaucugaucagacuuugcauuauggugggcgccaaugcuucugaccgcaugggcauggggaccacauaucuggcccucauggcgacguucaagaugagaccuauguuugcugucggacugcuguuccggcgccugaccagcagagaggugcuucugcucacaaucggccugucccugguggccucugucgaacuucccaacagccuggaggaacucggggauggacuggccaugggcauuaugauccucaaacugcuuaccgacuuucaaucccaccagcugugggcuacacuccugagccugaccuucaucaagacgacauuuucucuucauuacgccuggaaaaccauggcuaugguucuguccauugugagccucuucccccugugucucucuaccacaucccagaagaccacauggcugccugugcuucuggggagccugggaugcaagccgcucacgauguuucugaucgccgagaauaaaauuuggggccggaagucuuggccccuuaacgaaggcaucauggcggucgggauuguguccauccugcucagcucccugcucaaaaacgauguuccucuggccggaccccuuaucgcuggcgggaugcugauugccuguuaugugaucagcggaucuagcgcugaccugucccucgagaaggccgccgaggucucuugggaagaggaagcugagcacagcggcgcgucccauaauauucugguggaaguucaggaugacgggaccaugaaaaucaaggaugaggagcgcgacgauacacuuaccauucugcucaaagccacacugcucgcugugucuggagucuacccucugagcauccccgccacccuuuucgugugguauuucuggcaaaagaagaaacagagauccggcguccugugggacacgccuucucccccggaaguggagcgggccguucuggaugacggcaucuaccgcauuaugcagagagggcuccugggacggagccaggugggcgucgggguguuucaagaaaacguuuuccacaccauguggcacgugacacgcggagcuguccuuauguaucagggcaagagacuggagccuuccugggccagcgugaaaaaggaccucaucucuuacgggggaggcuggcggcugcagggcuccuggaauaccggggaggaagugcagguuauugcggucgagcccggcaagaacccuaagaaugugcaaacagcucccggcaccuuuaagacaccggaaggggaggugggagccaucgcccucgauuucaaaccuggcacgagcgggucucccauugucaacagagaaggaaagaucgugggccuguacggcaaugggguugugaccacauccggaaccuaugucagcgcuauugcccaggcgaaggcuucccaggagggcccucuucccgagaucgaagacgagguguuucgcaagcggaaccugaccaucauggaucugcaucccgggucuggaaaaacaagacgcuaccucccugccauuguucgggaagccaucaagagaaagcugcgcacgcuuauucuggcuccgacccggguggucgccagcgagauggcugaagcccucaaaggcaugcccaucagauaucaaacaaccgcggugaaguccgagcacacagggaaagagauuguugaccugaugugccaugccaccuucacgaugcgccugcucagcccugugcggguccccaauuacaacaugaucaucauggaugaagcucacuuuacagacccuucuuccauugccgcuagaggcuauaucagcacccgggugggaaugggcgaggccgccgcuauuuucaugaccgcgacacccccugggucuguggaagccuuuccgcagagcaaugcugucauccaggaugaggaacgcgacauucccgagagauccuggaacucuggauacgaguggaucaccgauuucccuggcaagacaguuugguuugugcccagcaucaaauccgggaaugacauugccaacugucuucggaagaauggaaagcgcgugauccagcugucuagaaaaaccuucgauacggaauaucaaaagaccaagaacaacgacugggacuacgucgugaccacagauauuagcgagaugggcgccaauuuccgggcugacagaguuaucgauccucgccggugccugaagcccgugauucucaaagacgggccggaaagagucauccuggccggcccuaugcccgugaccguugcguccgcugcccagcgccggggaagagugggccgcaaccauaauaaggagggggaucaguacauuuauaugggacagccccuuaacaaugacgaggaucacgcccacuggacggaagcuaagaugcugcucgacaacaucaauaccccugagggcaucauucccgcccuguuugaaccugagcgggagaaaagcgcggccaucgauggggaguacagacugcgcggagaggcuagaaagacauucgucgaacucaugcggcgcggcgaccuuccgguguggcugucuuauaaagucgccuccgagggguuucaauacagcgauagacgguggugcuucgacggcgaacgcaacaaucaggugcuggaggaaaacauggauguugagauuuggaccaaggagggagaacgcaaaaagcuccggcccagauggcuggacgcucgcacauauuccgacccucuugcccugcgggaguuuaaagaguucgcugccggcagacgcucugugagcggggaucucauccuggagauuggaaagcugccccagcaucucacccagcgggcgcaaaaugcccuugacaaccuggugaugcugcacaauuccgaacagggcgggagagcuuaccggcaugccauggaggagcucccugauacaaucgaaacccugaugcuucuggcucucaucgccguccugacgggaggcguuacacuguuuuuccucucuggccgcgggcuuggaaagaccagcauuggccugcugugugugauggccuccagcgugcuccuguggauggcuucugucgagccccacuggaucgcggccuccauuauccuugaauuuuuccugauggugcuccugauuccggagccugacagacagcggacaccccaggauaaccaacuggcuuauguugugaucgggcuccuuuuuaugauccugacagucgccgccaaugagaugggacugcucgaaaccaccaaaaaggaccugggcauugggcacguggcugucgagaaccaucaccaugccgcgaugcuugauguggaccugcacccugccagcgcuuggacgcucuacgccguugcuaccacaaucauuacccccaugaugcgccauacaaucgaaaacaccacggccaauauuucucugaccgcgaucgccaaccaggcugccauucugaugggacucgauaaaggcuggccuaucuccaagauggacaucggcgugccccuucuggcucuggggugcuacagccaggucaauccgcucacacugaccgccgcugugcuuaugcugguugcccacuaugcgauuaucggaccuggccuccaagccaaagcuacaagagaggcccagaagcggaccgcugccgggauuaugaagaaccccacgguggauggaaucgucgccauugaccuggaucccgugguguacgacgcgaaauucgaaaagcagcugggccagaucaugcuccuuauccuguguacaucucaaauucugcucaugcgcaccacaugggcucugugcgagagcaucacccuugccaccgggccucugacaacgcucugggagggauccccgggcaaauuuuggaauaccacaauugcuguuucuauggccaacaucuucagaggcagcuaucuggccggggcuggacuggccuucucccucaugaaaagccuuggcgggggacggcgcggcaccggggcgcagggagaaacacugggcgagaaauggaagagacagcugaaucagcucuccaagucugaauuuaacaccuacaaacggagcggcauuauggaggucgacagauccgaagccaaggaggggcugaaacgcggagagacgacaaagcacgcugugucucggggcaccgccaaacuuagaugguucguggaacgcaaucuggucaagcccgaggggaagguuaucgaucucggauguggcagagggggauggagcuauuacugcgcuggccugaaaaaggugaccgaagugaaaggcuauacaaaagggggaccuggccaugaggaacccaucccuauggccaccuacggguggaaccuggucaaacuccacuccggaaaggacguguuuuucauucccccugagaaaugugauacacuucugugcgacaucggcgagucuagcccgaaucccacgauugaagaggggagaacccugcgcguucucaagaugguggaaccuuggcugcggggaaaccaauuuuguaucaagauucuuaaucccuacaugccuuccgucguggagacacuggagcagaugcagagaaaacauggcggcaugcucguucgcaacccccugagcagaaauucuacccacgaaauguauuggguguccugcgggacaggaaacaucgucagcgcggugaauaugaccucuagaaugcugcucaaccgcuucacgauggcccaccggaagccgaccuacgagagagauguggaccugggcgcugggacacgccaugucgccguugaaccugagguggcuaaccuugauauuaucggacagagaaucgaaaauauuaaacacgagcauaaguccaccuggcacuaugacgaggauaaccccuacaaaacaugggccuaucauggcagcuacgaagugaagcccucuggguccgcuagcuccauggucaauggagugguuaagcugcucaccaaaccuugggacgugauccccauggucacacaaauugccaugaccgauacgacaccuuuuggccagcagcggguguucaaggagaaaguugacacccgcaccccgaaggcgaaaagaggcacaacgcaaaucauggaagugaccgcccgguggcuguggggguuucuuagcagaaacaagaagccccggauuuguacacgcgaggaguucaucagaaaaguccggucuaaugcugccaucggagcuguguuuguugacgagaaccaguggaauagcgccaaggaggccguggaagaugagcgcuucugggaccugguccacagagaacgggagcuccacaaacagggcaagugcgcgaccugcguguauaacaugauggggaaacgcgaaaagaagcugggagaguuuggcaaagcuaagggguccagagccauuugguacauguggcugggcgcccgguuccucgaguucgaagcucugggauuuaugaaugaggaucauugguucucucgcgaaaacagccuuuccggcgucgagggggagggacugcacaaacucggcuacauccugagagacauuucuaagaucccugggggaaauauguaugccgaugacacagcuggcugggauacccggauuacagaagacgaucuucagaacgaggccaaaaucaccgacaucauggaacccgagcaugcgcugcucgccaaggcuauuuuuaaacugacguaccaaaauaaggugguucgcgugcagagaccugccaagaacgggaccgucauggaugugaucagccggcgcgaccagagaggcuccggacaggugggcacauaugggcugaauaccuucacaaacauggaagcucaacucauucggcagauggagucugagggaaucuuuagccccuccgaacuggagaccccgaaccuugccgaaagaguucuggauuggcucgagaaauacggcguggaacgccugaagcggauggcgauuagcggggacgacugugucgugaaaccuaucgaugacagauucgccacggcucuuacagcccugaaugauaugggaaagguucgcaaagacaucccccagugggagccuucuaagggcuggaacgauuggcagcaagugcccuuuugcucccaccacuuccaucagcucauuaugaaggacgggcgggagaucgucgugccuuguagaaaucaggaugaacuggucggccgcgcucgggugagccagggagccggcuggucucugagagagaccgcuugccucgggaaauccuaugcccaaauguggcagcugauguacuuucaccgccgggaccuuagacuggcggccaacgcuauuuguagcgccguucccguggauugggucccgacaucccgcaccacguggucuauccaugcccaccaucaguggaugaccacagaagacaugcucagcguguggaaucggguuuggauugaggaaaacccuuggauggaggauaaggcucacguguccagcugggaggacguccccuaucugggaaaaagagaagaccaauggugcggcucucuuaucgggcugaccgcccgggcgacaugggcuaccaauauucagguggccaucaaccaggugagacgccucaucggaaaugagaacuaccuggauuacaugacauccaugaagcgguucaaaaaugaaagcgaccccgagggcgcccugugguga

SEQ ID NO: 19436 - RNA, 9879 nt, Artificial Sequence
  derived and/or modified CDS sequence (opt5) from DENV-1__KC762629__SS-prME
agcgugaccaugcugcucaugcugaugcccacagcccuugcuuuccaccugacgaccagaggcggggaaccucauauggugguuuccaagcaggaacggggaaaaucucuccuguuuaagacaagcgccggcgugaauaugugcacccuuaucgcgauggaccugggggagcucugugaagauacacugaccuacaaaugcccccgcaucacagaggcugaacccgacgauguggacuguuggugcaaugccaccgauacguggguuaccuauggaacauguucccaaaccggcgagcacagacgggacaagcgcucuguggcccuggcuccucauguugggcucggacuggagacaagaaccgaaacguggaugagcuccgagggcgccuggcggcagauccagcgcguggaaacaugggcucuuagacaccccggcuucaccgucaucgcccuguuucucgcgcaugccaucgggacaucuauuacccagaaaggaaucaucuucauucugcuuaugcuggugaccccuagcauggcuaugcggugcguuggcaucgggucccgcgauuuuguggagggacucagcggcgccacaugggucgacguggugcuggagcacgggucuugugucacgaccauggcuaaggauaagcccacacuggacauugaacuccugaaaaccgagguuacaaacccugccgugcuuagaaagcugugcaucgaagcgaaaauuuccaauaccacgacagauagccgguguccgacccaaggagaggccacccucguggaagaacaagacgcuaacuucgucugccgcagaacauuuguggaucggggcuggggcaauggguguggacuguucggcaaggggucucuuauuaccugcgccaaauuuaagugcguuacaaagcuggagggaaaaauugugcaguacgaaaaccucaaguauuccgucaucgugacgguucacaccggcgaccagcaucaaguggggaaugagagcacagaacacggaaccacagcuaccaucacgccccaggccccuaccacagagauucagcugaccgacuacggcgcccugacacucgauuguucuccccgcaccggccuggacuucaacgaaaugguccuucugacgaugaaagagaaguccuggcucgugcauaaacagugguuucuggaucuuccucugcccuggacaagcggggcuuccaccucucaagagacauggaauagacaggaccuccuggucaccuucaagaccgcgcacgccaaaaagcaggaagugguugugcugggaagccaagagggcgcuaugcacacagcccucacgggggccaccgaaauccagacauccggaaccacaaccauuuuugcuggccaucugaagugccggcuuaaaauggauaagcugacgcucaaagggaugagcuaugucauguguacaggcucuuucaagcuggagaaagaaguggccgagacccagcacggaaccguucuggugcagaucaaguacgagggcacagacgcgccgugcaagauuccuuucuccacccaagaugaaaaaggggucacacagaacggaagacuuaucacggcuaaucccaucgugaccgacaaggagaaaccugugaacauugaagccgagccgcccuuuggcgagagcuauaucguuauuggggccggagaaaagacacucaaacugucuugguucaagaagggcagcuccaucgggaaaauguuugaggcuaccgcccgcggcgcucggagaauggccauucugggagauacagcgugggacuucggcucuaucgggggagucuuuaccagcgugggcaagcucgugcaucagaucuucgggacggccuacggaguccuguuuuccggcgugagcuggaccaugaaaauugggaucggcguucuucugacauggcucggacucaauucucgcuccaccagccugucuaugacauguauugcugugggccuugucacccucuaccugggggugaugguucaggccgauuccggaugcgugaucaacuggaagggccgggaacugaaaugugggagcggaauuuucgucacaaaugaggugcacaccuggacggaacaauauaaguuucaggcugacuccccuaagagacucucugccgcgaucggcaaagccugggaggaggggguuugcggcauucgcagcgcuacacggcuggaaaacaucauguggaagcagaucuccaacgagcuuaaucauauucugcucgaaaacgacaugaaauucaccguggucgugggagauguggccggcauccuggcucaggggaagaaaaugauuagaccgcaacccauggagcacaaguacucuuggaaaagcuggggaaaggccaagaucauuggcgccgacguccagaauaccacauuuaucaucgaugggccuaacacccccgaauguccugacgaucagcgcgcuuggaauauuugggagguugaggacuauggauucggcaucuuuacgacaaacauuuggcugaaacuucgggauuccuacacccaggugugcgaccacagacucaugagcgcggccaucaaggauucuaaagcugugcaugccgacaugggcuauuggauugaauccgagaagaaugaaacauggaaacuggcccgcgcuagcuucaucgaggucaagaccuguaucuggcccaagucucacacacugugguccaacggggugcucgaaagcgagaugauuaucccgaaaauuuacggaggcccuaucucucaacauaauuaucggcccggguacuucacccagacggccggaccuuggcaccugggcaaacuugagcuggauuuuaaccucugcgaagggaccacaguuguggucgacgagcacugcggaaauagaggccccagccugcggaccacaaccgugacgggcaaaauuauccaugaaugguguugccgcuccuguacacugccuccccuuagauucagaggggaagauggaugcugguacggcauggagauccggccgguuaaggaaaaagaggaaaaccucgucaagagcauggucucugcgggguccggagagguggacagcuuuucccugggccugcucuguauuucuaucaugauugaagagguuaugcgcagccggugguccagaaagaugcugaugaccgggacacuugcuguguucuuucugcucaucaugggacagcugaccuggaaugaccugauucgccuuugcaucauggucggcgccaacgccucugauagaaugggcauggggaccacauaucuggcucucauggccacguucaaaaugcggccuauguuugcggugggacugcuguuccgcagacugaccagccgggaggugcuucugcucacaauuggccugucccuggucgcuucuguugaacuucccaauagccuggaggaacucggggacggacuggccaugggcaucaugauccucaagcugcuuaccgauuuucaaucccaccagcugugggccacacuccugagccugaccuucauuaaaacgacauuuucucuucauuacgcuuggaagaccauggccauggugcuguccaucgugagccucuucccccugugucucucuaccacaucccagaaaaccacauggcugccuguccuucuggggagccugggaugcaagccgcucacgauguuucugauugcugagaacaagaucuggggccgcaaaucuuggccccuuaacgaaggcauuauggccguggggaucguuuccauccugcucagcucccugcucaagaaugacgugccucuggcgggaccccuuauugccggcgggaugcugaucgcuuguuaugucauuagcggaucuagcgccgaucugucccucgagaaagcugccgaggugucuugggaagaggaagccgagcacagcggcgcuucccauaacauccugguugaagugcaggacgaugggaccaugaagauuaaagacgaggagagagaugacacacuuaccauccugcucaaggcgacacugcucgccgucucuggaguguacccucugagcauccccgcuacccuuuucgucugguauuucuggcagaagaagaagcagcgguccggcgugcugugggauacgccuucucccccggaaguugagcgcgccgugcuggacgauggcauuuacagaaucaugcagcgggggcuccugggacgcagccaggucggcguggggguuuuucaagaaaauguguuccacaccauguggcacgucacaagaggagccgugcuuauguaucagggcaaacggcuggagccuuccugggcuagcgugaagaaagaccucauuucuuacgggggaggcuggagacugcagggcuccuggaacaccggggaggaaguucaggucaucgccguggagcccggaaagaauccuaaaaacgugcaaacagcgcccggcaccuuuaagacaccggaaggggaggucggagcuauugcccucgacuucaagccuggcacgagcgggucucccaucgugaaucgcgaaggaaaaauuguuggccuguacggcaacgggguggucaccacauccggaaccuaugugagcgccaucgcucaggccaaggcgucccaggagggcccucuucccgagaucgaagaugagguuuuucggaaaagaaaucugaccauuauggaccugcaucccgggucuggaaagacacgccgguaccucccugcuaucgugagagaagccauuaaacgcaagcugcggacgcuuauccuggccccgaccagagucguggcuagcgagauggccgaagcucucaagggcaugcccauucgcuaucaaacaaccgccguuaaauccgagcacacagggaaggagaucguggaucugaugugccaugcgaccuucacgaugcggcugcucagcccugucagagugcccaacuacaauaugaucauuauggacgaagcccacuuuacagauccuucuuccaucgcugcccggggcuauauuagcacccgcgugggaaugggcgaggcugccgccaucuucaugaccgcuacacccccugggucugucgaagcguuuccgcagagcaacgccguuauucaggacgaggaaagagauauccccgagcgguccuggaacucuggauacgaguggaucaccgacuucccuggcaaaacagugugguuugugcccagcauuaaguccgggaacgauaucgcuaauugucuucgcaaaaacggaaagagagucauucagcugucucggaagaccuucgacacggaauaucagaagacaaagaacaaugauugggacuacgugguuaccacagacaucagcgagaugggcgccaacuucagagccgaucgcgugauugacccucggagaugccugaaacccgucauccucaaggaugggccggaacgcgugauucuggcuggcccuaugcccguuaccguggccuccgcggcucagcggagaggacgcgucggccggaaucauaacaaagagggggaccaguacaucuauaugggacagccccuuaauaacgaugaggaccacgcccacuggacggaagccaagaugcugcucgauaauaucaacaccccugagggcauuauccccgcucuguuugaaccugagagagaaaagagcgccgcgauugacggggaguaccgccugagaggagaggcccggaaaacauucguggaacucaugcgcagaggcgaucuuccggucuggcugucuuauaagguggcuuccgagggguuucaauacagcgaccggcgcuggugcuucgauggcgaaagaaauaaccagguucuggaggaaaauauggacguggagaucuggaccaaagagggagaacggaagaaacucagaccccgcuggcuggaugcccggacauauuccgacccucuugcucugagagaguuuaaggaguucgccgcuggccgccggucugugagcggggaccucauucuggagaucggaaaacugccccagcaucucacccagagagcccaaaacgcgcuugauaaucuggucaugcugcacaacuccgaacagggcgggcgggccuaccgccaugcuauggaggagcucccugacacaaucgaaacccugaugcuucuggcccucauugcuguucugacgggaggcgugacacuguuuuuccucucuggcagagggcuuggaaagaccagcaucggccugcugugugugauggccuccagcguccuccuguggauggccucuguggagccccacuggauugcugcguccaucauucuugaauuuuuccugaugguucuccugaucccggagccugaucggcagcgcacaccccaagacaaucaacuggccuauguggucaucgggcuccuuuuuaugauucugaccguggcugccaacgagaugggacugcucgaaaccacaaagaaagaucugggcaucgggcacgucgccguggagaaccaucaccaugcugccaugcuugacguugaucugcacccugcgagcgccuggacgcucuacgcuguggccaccacaauuaucacccccaugaugagacauacaauugaaaauaccacggcuaacaucucucugaccgccauugcgaaucaggccgcuauccugaugggacucgacaagggcuggccuaucuccaaaauggauauuggcgucccccuucuggcccuggggugcuacagccaggugaacccgcucacacugaccgcugccguucuuaugcugguggcucacuaugccaucauuggaccuggccuccaagcgaaggccacacgggaggcucagaaacgcaccgccgcugggaucaugaagaaucccacggucgacggaauuguggccaucgaucuggaccccgugguuuacgaugccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaacaccacaaucgccgucucuauggcuaauauuuuccggggcagcuaucuggccggggccggacuggcuuucucccucaugaaaagccuuggcgggggacgcagaggcaccggggcccagggagaaacacugggcgagaaguggaaacggcagcugaaccagcucuccaagucugaauuuaauaccuacaagagaagcggcaucauggagguggaccgcuccgaagcgaaagaggggcugaagcggggagagacgacaaaacacgccgugucuagaggcaccgcuaaacuucgcugguucgucgaacggaaccugguuaaacccgaggggaaggugaucgaccucggauguggcagagggggauggagcuauuacugcgccggccugaagaaagugaccgaagucaagggcuauacaaaagggggaccuggccaugaggaacccauuccuauggcuaccuacggguggaaucuggugaagcuccacuccggaaaagaugucuuuuucauucccccugagaagugugacacacuucugugcgauauuggcgagucuagcccgaaccccacgaucgaagaggggcgcacccugcgggugcucaaaauggucgaaccuuggcugagaggaaaucaauuuuguauuaagauccuuaaccccuacaugccuuccgugguugagacacuggagcagaugcagcgcaagcauggcggcaugcucgugcggaauccccugagcagaaacucuacccacgaaauguauugggucuccugcgggacaggaaauauugugagcgccgugaacaugaccucucgcaugcugcucaaccgguucacgauggcgcacagaaaaccgaccuacgagcgcgacgucgaucugggcgccgggacaagacauguugcuguggaaccugagguggccaaucuugacaucaucggacagcggauugaaaacaucaagcacgagcauaaauccaccuggcacuaugaugaggacaaucccuacaagacaugggcuuaucauggcagcuacgaagucaaacccucuggguccgccagcuccauggugaacggaguugugaagcugcucaccaagccuugggaugucauucccauggugacacaaaucgcuaugaccgacacgacaccuuuuggccagcagcgcguuuucaaagagaagguggauaccagaaccccgaaagccaagcggggcacaacgcaaauuauggaagucaccgcgagauggcuguggggguuucuuagccggaauaaaaagccccgcaucuguacaagagaggaguucacccggaaggugcgcucuaacgccgcuaucggagccguuuuuguggacgagaaucaguggaacagcgcuaaagaggccgucgaagacgagagauucugggaucuggugcaccgggaacgcgagcuccacaagcagggcaaaugcgccacaugcgucuauaauaugauggggaagagagagaaaaagcugggagaguuuggcaaggcgaaagggucccgggcuauuugguacauguggcugggcgcccgcuuccucgaguucgaagcccugggauuuaugaacgaggaccauugguucucuagaggcaauagccuuuccgggguggaaggagagggccugcacaagcucggguacauccugcgggauauuucuaaaaucccuggaggcaacauguaugcugacgauaccgccgggugggacacacgcauuaccgaggaugaccuucagaaugaagcuaagaucacggauaucauggagcccgaacaugcccugcucgcgaaagccauuuuuaagcugaccuaccaaaacaaaguugugagaguccagcggccugcuaagaauggcacagugauggacgugaucagccgcagagaucagcggggauccggccagguugggaccuauggacugaacacauucaccaacauggaggcccaacucauuagacagauggaaucugagggcaucuuuagccccuccgagcuggaaacgccgaaucuugcugagcgcgugcuggacuggcucgaaaaguacggggucgagcggcugaaaagaauggccauuagcggagaugacugugugguuaagccuaucgacgaucgcuucgcgacagcccuuaccgcucugaacgacaugggcaaagugcggaaggauaucccccagugggaaccuucuaaaggguggaaugacuggcagcaaguccccuuuugcucccaccacuuccaucagcucauuaugaaggauggcagagagaucguggucccuugucgcaaccaggacgagcuggugggacgggccagaguuagccagggcgcuggguggucucugcgcgaaacagccugccucggaaaguccuaugcucaaauguggcagcugauguacuuucaccggagagaucuucgccuggccgcgaaugccauuuguagcgcugugcccgucgacugggugccgaccucccggacgaccuggucuauccaugcccaccaucaguggaugacaaccgaggauaugcucagcguuuggaacagaguguggauugaagagaauccuuggauggaagacaaaacacacaucuccagcugggaggauguccccuaucugggcaagcgggaggaccaauggugcgggucucuuauuggacugaccgccagagcuacaugggccaccaacauccagguggcgaucaaucaggugcgccggcucauuggcaacgaaaauuaccuggacuacaugacguccaugaaaagauucaagaacgagagcgaucccgaaggggcucugugguga

SEQ ID NO: 19437 - RNA, 9879 nt, Artificial Sequence
  derived and/or modified CDS sequence (opt5) from DENV-1__KC762627__SS-prME
agcgugaccaugcugcucaugcugaugcccaccgcccuugcuuuccaccugacgacccggggaggggaaccucauaugauuguguccaagcaggaacggggaaaaucucuccuguuuaagaccagcgccggcguuaacaugugcacccuuauugcgauggaccugggggaacucugugaagauacacugaccuacaaaugcccccgcaucacagaggcugaacccgacgauguggacuguuggugcaaugccaccgauacgugggugaccuauggaacauguucccaaaccggcgagcaccggcgggacaagcgcucuguggcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugugauguguacaggcucuuucaaacuggagaaggaagucgccgagacccagcacggaaccgugcugguucagauuaaguacgagggcacagacgcgccgugcaaaaucccuuucuccacccaagaugaaaagggggugacacagaacggacggcuuaucacggcuaaucccauugucaccgacaaagagaagccugugaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguuuuuacaagcgucggcaaacucauucaucagaucuucgggaccgcuuacggagugcuguuuuccggcgugagcuggacgaugaagauugggaucggcguccuucugaccuggcucggacucaauucuagauccacaagccugucuaugaccuguauugccgugggccuuguuacacucuaccugggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcucucugcggccaucggcaaggcuugggaggagggggucugcggcaucagaagcgccacgcgccuggaaaacauuauguggaaacagaucuccaacgagcuuaaucauauucugcucgaaaacgacaugaaguucacagugguugugggagaugucgcuggcauccuggcccaggggaaaaagaugauucggccgcaacccauggagcacaaauacucuuggaaaagcuggggaaaggccaagaucaucggcgcugacgugcagaauaccaccuuuauuaucgaugggccuaacacacccgaauguccugacgaucagagagcguggaauauuugggagguggaggacuauggauucggcaucuuuaccacgaacauuuggcugaaacuucgcgauuccuacacacaggucugcgaccaccggcucaugagcgccgcuaucaaagauucuaaggccguucaugccgacaugggcuauuggaucgaauccgagaaaaaugaaaccuggaagcuggcuagagccagcuucauugaggugaagacauguaucuggcccaaaucucacacccugugguccaacggggugcucgaaagcgagaugauuaucccgaagauuuacggaggcccuaucucucaacauaauuaucgccccggguacuucacacagaccgcgggaccuuggcaccugggcaaacuugagcuggauuuugaccucugcgaagggacgaccgucgugguugaugagcacugcggaaaccggggccccagccugagaacaaccacagugaccggcaagaucauucaugaaugguguugccgguccuguacgcugccuccccuucgcuucagaggggaggacggaugcugguacggcauggagauccggccggucaaagaaaaggaggaaaaucucgucaagagcaugguuucugcuggguccggagagguggacagcuuuucccugggccugcucuguauuucuaugaugaucgaagaggucaugagaagccgcuggucccggaaaaugcugaugacagggacccuugccguguucuuucugcucauuaugggacagcugacauggaacgaucugaucagacuuugcauuaugguuggcgccaaugcuucugaccgcaugggcauggggaccaccuaucuggcccucauggcgacauucaagaugagaccuauguuugcugugggacugcuguuccggcgccugacgagcagagagguccuucugcucaccaucggccugucccugguggccucuguggaacuucccaacagccuggaggaacucggggauggacuggccaugggcaucaugauucucaaacugcuuacagacuuucaaucccaccagcugugggcuacccuccugagccugacauucaucaagaccacguuuucucuucauuacgccuggaaaacaauggcuaugguccuguccauuguuagccucuucccccugugucucucuaccaccucccagaagacaaccuggcugccugugcuucuggggagccugggaugcaagccgcucacaauguuucugaucgccgagaauaaaauuuggggccggaagucuuggccccuuaacgaaggcaucauggcgguggggaucgucuccauucugcucagcucccugcucaaaaacgaugugccucuggccggaccccuuaucgcuggcgggaugcugauugccuguuauguuaucagcggaucuagcgcugaccugucccucgagaaggccgccgaggugucuugggaagaggaagcugagcacagcggcgcgucccauaauauucuggucgaagugcaggaugacgggacgaugaaaaucaaggaugaggagcgcgacgauacccuuacaauccugcucaaagccacccugcucgcuguuucuggaguguacccucugagcauucccgccacacuuuucgucugguauuucuggcaaaagaagaaacagagauccggcgugcugugggacaccccuucucccccggaagucgagcgggccgugcuggaugacggcaucuaccgcauuaugcagagagggcuccugggacggagccagguuggcgugggggucuuucaagaaaacguguuccacacgauguggcacguuacccgcggagcugugcuuauguaucagggcaagagacuggagccuuccugggccagcgucaaaaaggaccucaucucuuacgggggaggcuggcggcugcagggcuccuggaauacaggggaggaaguccaggugauugcgguugagcccggcaagaauccuaagaauguccaaaccgcucccggcacauuuaagaccccggaaggggaggugggagccaucgcccucgauuucaaaccuggcacaagcgggucucccauugugaacagagaaggaaagaucgucggccuguacggcaauggggugguuacgaccuccggaacauaugugagcgcuaucgcccaggcgaaggcuucccaggagggcccucuucccgagauugaagacgaggucuuucgcaagcggaaccugaccaucauggaucugcaucccgggucuggaaaaaccagacgcuaccucccugccauugugcgggaagccaucaagagaaagcugcgcacacuuauucuggcuccgacgcggguuguggccagcgagauggcugaagcccucaaaggcaugcccaucagauaucaaaccacagcggucaaguccgagcacaccgggaaagagaucguggaccugaugugccaugccacauucaccaugcgccugcucagcccuguucgggugcccaauuacaacaugauuaucauggaugaagcucacuuuacggacccuucuuccauugccgcuagaggcuauaucagcacacgggucggaaugggcgaggccgccgcuauuuucaugaccgcgacacccccugggucuguggaagccuuuccgcagagcaaugcugugauccaggaugaggaacgcgacauccccgagagauccuggaacucuggauacgaguggauuacagauuucccuggcaagaccgucugguuuguucccagcaucaaauccgggaaugacauugccaacugucuucggaagaauggaaagcgcgugauccagcugucuagaaaaacauucgauaccgaauaucaaaagacgaaaaacaacgacugggacuacguggucacaaccgauauuagcgagaugggcgccaauuuccgggcugacagagugaucgauccucgccggugccugaagcccguuauucucaaagacgggccggaaagagugauccuggccggcccuaugcccgucacaguggcguccgcugcccagcgccggggaagaguuggccgcaaccauaauaaggagggggaucaguacaucuauaugggacagccccuuaacaaugacgaggaucacgcccacuggaccgaagcuaagaugcugcucgacaacauuaauacgccugagggcaucauucccgcccuguuugaaccugagcgggaaaagagcgcggccaucgauggggaguacagacugcgcggagaggcuagaaagaccuucguggagcucaugcggcgcggcgaccuuccggucuggcugucuuauaaaguggccuccgagggguuucaauacagcgauagacgguggugcuucgacggcgaacgcaacaaucagguccuggaggaaaacauggauguggagauuuggacaaaggagggagaacgcaaaaagcuccggcccagauggcuggacgcucgcaccuauuccgacccucuugcccugcgggaguuuaaagaguucgcugccggcagacgcucuguuagcggggaucucauccuggagaucggaaagcugccccagcaucucacacagcgggcgcaaaaugcccuugacaaccuggugaugcugcacaauuccgaacagggcgggagagcuuaccggcaugccauggaggagcucccugauaccauugaaacacugaugcuucuggcucucaucgccgugcugaccggaggcgucacgcuguuuuuccucucuggccgcgggcuuggaaagacaagcauuggccugcuguguguuauggccuccagcgugcuccuguggauggcuucuguggagccccacuggaucgcggccuccauuauccuugaauuuuuccugaugguccuccugaucccggagccugacagacagcggacaccccaggauaaccaacuggcuuaugugguuauugggcuccuuuuuaugauccugaccguggccgccaaugagaugggacugcucgaaacaaccaaaaaggaccugggcauugggcacgucgcuguggagaaccaucaccaugccgcgaugcuugaugucgaccugcacccugccagcgcuuggacacucuacgccguggcuacgaccaucauuacacccaugaugcgccauaccaucgaaaacacaaccgccaauauuucucugacggcgaucgccaaccaggcugccauccugaugggacucgauaaaggcuggccuauuuccaagauggacaucggcguuccccuucuggcucuggggugcuacagccaggugaauccgcucacccugacagccgcuguccuuaugcugguggcccacuaugcgauuaucggaccuggccuccaagccaaagcuaccagagaggcccagaagcggacagcugccgggauuaugaagaaccccaccguugauggaaucguggccaucgaccuggaucccgucguguacgacgcgaaauucgaaaagcagcugggccagauuaugcuccuuauccuguguacgucucaaauucugcucaugcgcacaaccugggcucugugcgagagcaucacacuugccaccgggccucugaccacacucugggagggauccccgggcaaauuuuggaauacgaccauugcugugucuauggccaacaucuucagaggcagcuaucuggccggggcuggacuggccuucucccucaugaaaagccuuggcgggggacggcgcggcacaggggcgcagggagaaacccugggcgagaaauggaagagacagcugaaucagcucuccaagucugaauuuaacacauacaaacggagcggcaucauggagguugacagauccgaagccaaggaggggcugaaacgcggagagaccacgaagcacgcugucucucggggcacagccaaacuuagaugguucguggaacgcaaucuggugaagcccgaggggaaggucauugaucucggauguggcagagggggauggagcuauuacugcgcuggccugaaaaagguuaccgaagugaaaggcuauaccaaagggggaccuggccaugaggaacccaucccuauggccacauacggguggaaccuggugaaacuccacuccggaaaggacgucuuuuucauucccccugagaaaugugauacccuucugugcgacaucggcgagucuagcccgaaucccacaauugaagaggggagaacgcugcgcgugcucaagaugguugaaccuuggcugcggggaaaccaauuuuguaucaagauucuuaaucccuacaugccuuccguggucgagacccuggagcagaugcagagaaaacauggcggcaugcucgugcgcaacccccugagcagaaauucuacacacgaaauguauuggguuuccugcgggaccggaaacaucgugagcgcggucaauaugacaucuagaaugcugcucaaccgcuucaccauggcccaccggaagccgacguacgagagagauguggaccugggcgcugggacccgccauguggccgucgaaccugagguugcuaaccuugauaucauuggacagagaaucgaaaauauuaaacacgagcauaaguccacauggcacuaugacgaggauaaccccuacaaaaccugggccuaucauggcagcuacgaagugaagcccucuggguccgcuagcuccauggugaauggagucgugaagcugcucacaaaaccuugggacguuauccccauggugacccaaauugccaugacagauaccacgccuuuuggccagcagcgggucuucaaggagaaaguggacacacgcaccccgaaggcgaaaagaggcaccacacaaaucauggaaguuacggcccgguggcuguggagcuuucuuucuagaaacaagaagccccggaucuguacccgcgaggaguucacaagaaaagugcggagcaaugcugccauuggggcugucuuuguggacgagaaccaguggaacuccgccaaggaggccguugaagaugagcgcuucugggaccuggugcacagagaacgggagcuccacaaacagggaaagugcgcgaccugcgucuauaacaugaugggcaaacgcgaaaagaagcugggggaguuuggaaaagcuaagggcucuagagccaucugguacauguggcugggggcccgguuccucgaguucgaagcucugggcuuuaugaaugaggaucauugguucagccgcgaaaacucccuuucuggaguggagggcgaggggcugcacaaacucggauacauucugagagacaucagcaagauuccuggcgggaauauguaugccgaugacacagcuggaugggauacccggaucacagaagacgaucuucagaacgaggccaaaaucaccgacauuauggaacccgagcaugcgcugcucgccaaggcuaucuuuaaacugacguaccaaaauaaggucgugcgcguucagagaccugccaagaacggcaccgugauggaugucauuucccggcgcgaccagagagggucuggccaggugggaacauauggccugaauaccuucacaaacauggaagcucaacucauccggcagauggagagcgaggggaucuuuucccccagcgaacuggagaccucuaaccuugccgaaagagugcuggauuggcucgagaaauacggaguugaacgccugaagcggauggcgaucuccggcgacgacuguguggucaaaccgaucgaugacagauucgccacggcucuuacagcccugaaugauauggggaaggugcgcaaagacauuccucagugggagcccagcaagggauggaacgauuggcagcaaguuccuuuuugcucucaccacuuccaucagcucaucaugaaggacggccgggagauugugguccccuguagaaaucaggaugaacugguggggcgcgcucgggucucccagggcgccggauggagccugagagagaccgcuugccucggcaaauccuaugcccaaauguggcagcugauguacuuucaccgccgggaccuuagacuggcggccaacgcuaucuguucugccgugccuguugauugggugcccacaagccgcaccacgugguccauucaugcccaccaucaguggaugaccacagaagacaugcucagcgucuggaaucggguguggaucgaggaaaacccguggauggaggauaagacccacauuucuuccugggaggacguuccuuaucuggggaaaagagaagaccaauggugcggaagccuuaucggccugacagcucgggccaccugggcgacaaauauccagguggcuauuaaccaggucagacgccucaucgggaaugagaacuaccuggauuacaugaccucuaugaagcgguucaaaaaugaaagcgaccccgagggagcccugugguga

SEQ ID NO: 19438 - RNA, 9879 nt, Artificial Sequence
  derived and/or modified CDS sequence (opt5) from DENV-1__KC762647__SS-prME
agcgugaccaugcugcucaugcugacacccacggcucuugcuuuccaccugaccacacggggcggggagccucauaugaucguguccaagcaggaacggggaaagucucuccuguuuaagaccagcgccggcguuaacaugugcacacuuauugcgauggaccugggggagcucugugaagauacccugacauacaaaugcccccgcaucaccgaggcugaacccgacgauguggacuguuggugcaaugccacggauaccugggugacauauggaaccuguucccaaacaggcgagcaccggcgggacaagcgcucugucgcccuggcuccucauguggggcucggacuggagacccggacggaaacauggaugagcuccgagggcgccuggaaacagauucagcggguugaaaccugggcccuucgccaccccggcuucacagugaucgcccuguuucucgcgcaugccauugggaccucuaucacccagaagggaaucauuuucauccugcuuaugcuggucacaccuagcauggcuaugagaugcgugggcauugggucccgggauuuuguugagggacucagcggcgccacguggguggacgucgugcuggagcacgggucuugugugaccacaauggcuaaggauaaacccacccuggacaucgaacuccugaagacagaggucaccaacccugccguucuucgcaaacugugcauugaagcgaagaucuccaauacgacaaccgauagcagauguccgacccaaggagaggccacacucguggaagaacaagacgcuaacuucgugugccggcgcaccuuugucgauagaggcuggggcaauggguguggacuguucggcaaagggucucuuauuacaugcgccaaguuuaagugcgugacgaaacuggagggaaagaucguucaguacgaaaaccucaaauauuccgugaucgucaccgugcacacaggcgaccagcaucaaguugggaaugagagcaccgaacacggaacaaccgcuacgauuacaccccaagccccuacaaccgagauccagcugacagacuacggcgcccugacccucgauuguucuccccggacgggccuggacuucaacgaaauggugcuucugacaaugaaggagaaauccuggcucguccauaagcagugguuucuggaucuuccucugcccuggaccagcggggcuuccacaucucaagagaccuggaaucgccaggaccuccuggugaccuucaaaacagcgcacgccaagaagcaggaagucgugguucugggaagccaagagggcgcuaugcacacggcccucaccggggccacagaaauucagaccuccggaacaaccacgaucuuugcuggccaucugaaaugcagacuuaagauggauaaacugacacucaaggggaugagcuaugugauguguaccggcucuuucaaacuggagaaggaagucgccgagacccagcacggaacagugcugguucagauuaaguacgagggcaccgacgcgccgugcaaaaucccuuucuccacacaagaugaaaagggggugacgcagaacggacggcuuaucaccgcuaaucccauugucacagacaaagagaagccugugaacaucgaagccgagccgcccuuuggcgagagcuauauugugaucggggccggagaaaaagcucucaagcugucuugguucaagaaaggcagcuccauugggaagauguuugaggccaccgcuagaggcgcccgccggauggcgauccugggagauacagccugggacuucggcucuaucgggggaguuuuuaccagcgucggcaaacucgugcaucagauuuucgggacggcuuacggagugcuguuuuccggcgucagcuggaccaugaagaucgggauuggcgugcuucugacauggcucggacucaauucuagauccaccagccugucuaugacauguaucgccguuggccuugugacccucuaccugggggucauggugcaggcugauuccggaugcguuauuaacuggaaaggccgcgaacugaagugugggagcggaaucuucgugacaaaugagguccacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccguuguggucggagauguggcuggcauucuggcccaggggaaaaagaugauccggccgcaacccauggagcacaaauacucuuggaaaagcuggggaaaggccaagauuaucggcgcugacgugcagaauaccacauuuaucauugaugggccuaacacccccgaauguccugacgaucagagagcguggaauaucugggaggucgaggacuauggauucggcauuuuuacgacaaacaucuggcugaaacuucgcgauuccuacacccagguuugcgaccaccggcucaugagcgccgcuauuaaagauucuagagccgugcaugccgacaugggcuauuggaucgaauccgagaagaaugaaacauggaaacuggcucgcgccagcuucaucgaggugaagaccugugucuggcccaagucucacacacugugguccaacggggugcucgaaagcgagaugauuaucccgaaaauuuacggaggcccuaucucucaacauaauuaucggcccggguacuucacccagacggcgggaccuuggcaccugggcaaacuugagcuggauuuugaccucugcgaagggaccacaguuguggucgaugagcacugcggaaacagaggccccagccugcggaccacaaccgugacgggcaaaauuauccaugaaugguguugccgcuccuguacacugccuccccuuagauucagaggggaagacggaugcugguacggcauggagaucagaccgguuaaggaaaaagaggaaaaucucgucaagagcauggucucugcuggguccggagagguggacagcuuuucccugggccugcucuguauuucuaucaugauugaagagguuaugcgcagccggugguccagaaagaugcugaugaccgggacacuugccguguucuuucugcucaucaugggacagcugaccuggaacgaucugauucgccuuugcaucauggucggcgccaaugcuucugacagaaugggcauggggaccacauaucuggcccucauggcgacguucaaaaugcggccuauguuugcugugggacugcuguuccgcagacugaccagccgggaggugcuucugcucacaauuggccugucccuggucgccucuguugaacuucccaacagccuggaggaacucggggauggacuggccaugggcaucaugauccucaagcugcuuaccgacuuucaaucccaccagcugugggcuacacuccugagccugaccuucauuaaaacgacauuuucucuucauuacgccuggaagaccauggcuauggugcuguccaucgugagccucuucccccugugucucucuaccacaucccagaaaaccacauggcugccuguccuucuggggagccugggaugcaagccgcucacgauguuucugauugccgagaauaagaucuggggccgcaaaucuuggccccuuaacgaaggcauuauggcgguggggaucguuuccauccugcucagcucccugcucaagaacgaugugccucuggccggaccccuuauugcuggcgggaugcugaucgccuguuaugucauuagcggaucuagcgcugaccugucccucgagaaagccgccgaggugucuugggaagaggaagcugagcacagcggcgcgucccauaauauccugguugaagugcaggaugacgggaccaugaagauuaaagaugaggagagagacgauacacuuaccauccugcucaaggccacacugcucgcugucucuggaguguacccucugagcauccccgccacccuuuucgucugguauuucuggcagaagaagaagcagcgguccggcgugcugugggacacgccuucucccccggaaguugagcgcgccgugcuggaugacggcauuuacagaaucaugcagcgggggcuccugggacgcagccaggucggcguggggguuuuucaagaaaacguguuccacaccauguggcacgucacaagaggagcugugcuuauguaucagggcaaacggcuggagccuuccugggccagcgugaagaaagaccucauuucuuacgggggaggcuggagacugcagggcuccuggaauaccggggaggaaguucaggucaucgcgguggagcccggaaagaacccuaaaaaugugcaaacagcucccggcaccuuuaagacaccggaaggggaggucggagccauugcccucgauuucaagccuggcacgagcgggucucccaucgugaaccgcgaaggaaaaauuguuggccuguacggcaaugggguggucaccacauccggaaccuaugugagcgcuaucgcccaggcgaaggcuucccaggagggcccucuucccgagaucgaagacgagguuuuucggaaaagaaaccugaccauuauggaucugcaucccgggucuggaaagacacgccgguaccucccugccaucgugagagaagccauuaaacgcaagcugcggacgcuuauccuggcuccgaccagagucguggccagcgagauggcugaagcccucaagggcaugcccauucgcuaucaaacaaccgcgguuaaauccgagcacacagggaaggagaucguggaccugaugugccaugccaccuucacgaugcggcugcucagcccugucagagugcccaauuacaacaugaucauuauggaugaagcucacuuuacagacccuucuuccaucgccgcucggggcuauauuagcacccgcgugggaaugggcgaggccgccgcuaucuucaugaccgcgacacccccugggucugucgaagccuuuccgcagagcaaugcuguuauucaggaugaggaaagagacauccccgagcgguccuggaacucuggauacgaguggaucaccgauuucccuggcaaaacagugugguuugugcccagcauuaaguccgggaaugacaucgccaacugucuucgcaaaaauggaaagagagucauucagcugucucggaagaccuucgauacggaauaucagaagaccaagaacaacgacugggacuacgugguuaccacagauaucagcgagaugggcgccaauuucagagcugaccgcgugauugauccucggagaugccugaaacccgucauccucaaggacgggccggaacgcgugauucuggccggcccuaugcccguuaccguggcguccgcugcccagcggagaggacgcgucggccggaaccauaauaaagagggggaucaguacaucuauaugggacagccccuuaacaaugacgaggaucacgcccacuggacggaagcuaagaugcugcucgacaacaucaauaccccugagggcauuauccccgcccuguuugaaccugagagagaaaagagcgcggccauugauggggaguaccgccugagaggagaggcucggaaaacauucguggaacucaugcgcagaggcgaccuuccggucuggcugucuuauaagguggccuccgagggguuucaauacagcgaucggcgcuggugcuucgacggcgaaagaaacaaucagguucuggaggaaaacauggauguggagaucuggaccaaagagggagaacggaagaaacucagaccccgcuggcuggacgcucggacauauuccgacccucuugcccugagagaguuuaaggaguucgcugccggccgccggucugugagcggggaucucauucuggagaucggaaaacugccccagcaucucacccagaaggcgcaaaaugcccuugacaaccuggucaugcugcacaauuccgaacagggcgggagagcuuaccggcaugccauggaggagcucccugauacaaucgaaacccugaugcuucuggcucucauugccguucugacgggaggcgugacacuguuuuuccucucuggccgcgggcuuggaaagaccagcaucggccugcugugugugauggccuccagcguccuccuguggauggcuucuguggagccccacuggauugcggccuccaucauucuugaauuuuuccugaugguucuccugaucccggagccugacagacagcggacaccccaggauaaccaacuggcuuauguggucaucgggcuccuuuuuaugauucugacaguggccgccaaugagaugggacugcucgaaaccaccaagaaggaccugggcaucgggcacgucgcuguggagaaccaucaccaugccgcgaugcuugauguugaccugcacccugccagcgcuuggacgcucuacgccguggcuaccacaauuaucacccccaugaugcgccauacaauugaaaacaccacggccaauaucucucugaccgcgauugccaaccaggcugccauccugaugggacucgauaaaggcuggccuaucuccaagauggacauuggcgucccccuucuggcucuggggugcuacagccaggugaauccgcucacacugaccgccgcuguucuuaugcugguggcccacuaugcgaucauuggaccuggccuccaagccaaagcuacaagagaggcccagaagcggaccgcugccgggaucaugaagaaccccacggucgauggaauuguggccaucgaccuggaucccgugguuuacgacgcgaaauucgaaaagcagcugggccagaucaugcuccuuauucuguguacaucucaaauccugcucaugcgcaccacaugggcucugugcgagagcauuacccuugccaccgggccucugacaacgcucugggagggauccccgggcaaauuuuggaauaccacaaucgcugucucuauggccaacauuuucagaggcagcuaucuggccggggcuggacuggccuucucccucaugaaaagccuuggcgggggacggcgcggcaccggggcgcagggagaaacacugggcgagaaauggaagagacagcugaaucagcucuccaagucugaauuuaacaccuacaaacggagcggcaucauggagguggacagauccgaagccaaggaggggcugaaacgcggagagacgacaaagcacgcugugucucggggcaccgccaaacuuagaugguucgucgaacgcaaucugguuaagcccgaggggaaggugaucgaucucggauguggcagagggggauggagcuauuacugcgcuggccugaaaaaggugaccgaagucaaaggcuauacaaaagggggaccuggccaugaggaacccauuccuauggccaccuacggguggaaccuggugaaacuccacuccggaaaggacguguuuuucauucccccugagaaaugugauacacuucugugcgacaucggcgagucuagcccgaaucccacgaucgaagaggggagaacccugcgcguucucaagauggucgaaccuuggcugcggggaaaccaauuuuguauuaaggugcuuaaucccuacaugccuuccguuguggagacacuggagcagaugcagagaaaacauggcggcaugcucguccgcaacccccugagcagaaauucuacccacgaaauguauuggguguccugcgggacaggaaacaucgugagcgcggucaauaugaccucuagaaugcugcucaaccgcuucacgauggcccaccggaagccgaccuacgagagagauguugaccugggcgcugggacacgccauguggccguggaaccugaggucgcuaaccuugauauuaucggacagagaaucgaaaauauuaaacacgagcauaaguccaccuggcacuaugacgaggauaaccccuacaaaacaugggccuaucauggcagcuacgaagugaagcccucuggguccgcuagcuccaugguuaauggaguggucaagcugcucaccaaaccuugggacgugauccccaugguuacacaaauugccaugaccgauacgacaccuuuuggccagcagcggguguucaaggagaaagucgacacccgcaccccgaaggcgaaaagaggcacaacgcaaaucauggaagugaccgcccgguggcuguggggguuucuuagcagaaacaagaagccccggauuuguacacgcgaggaguucaccagaaaaguucggucuaaugcugccaucggagcuguguuugucgacgagaaccaguggaauagcgccaaggaggccguggaagaugagcgcuucugggaccugguccacagagaacgggagcuccacaaacagggcaagugcgcgacaugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcguugagggggagggacugcacaaacucggcuacauucugagagacaucucuaagauuccugggggaaauauguaugccgaugacaccgcuggcugggauacacggaucaccgaagacgaucuucagaacgaggccaaaauuacggacaucauggaacccgagcaugcgcugcucgccaaggcuaucuuuaaacugaccuaccaaaauaaggugguccgcgugcagagaccugccaagaacgggacagugauggauguuauuagccggcgcgaccagagaggcuccggacaggugggcaccuaugggcugaauacauucaccaacauggaagcucaacucauccggcagauggagucugagggaauuuuuagccccuccgaacuggagacgccgaaccuugccgaaagaguccuggauuggcucgagaaauacggcguggaacgccugaagcggauggcgaucagcggggacgacuguguugugaaaccuauugaugacagauucgccacagcucuuaccgcccugaaugauaugggaaagguccgcaaagacaucccccagugggagccuucuaagggcuggaacgauuggcagcaagugcccuuuugcucccaccacuuccaucagcucaucaugaaggacgggcgggagauugucgugccuuguagaaaucaggaugaacugguuggccgcgcucgggugagccagggagccggcuggucucugagagagcccgcuugccucgggaaauccuaugcccaaauguggcagcugauguacuuucaccgccgggaccuuagacuggcggccaacgcuaucuguagcgccgucccgguggauuggguuccuacaucccgcaccacguggucuauucaugcccaccaucaguggaugaccacagaagacaugcucagcguguggaaucgggucuggaucgaggaaaaccccuggauggaggauaagacccacauuuccagcugggaggacgugcccuaucugggaaaaagagaagaccaauggugcggcucucuuaucgggcugacagcucgggccaccugggcgacaaauauucagguggcuaucaaccagguuagacgccucaucggaaaugagaacuaccuggauuacaugaccuccaugaagcgguucaaaaaugaaagcgacccugagggcgcccugugguga

SEQ ID NO: 19439 - RNA, 9879 nt, Artificial Sequence
  derived and/or modified CDS sequence (opt5) from DENV-1__KC762639__SS-prME
agcgugaccaugcugcucaugcugacacccacggcucuugcuuuccaccugaccacacggggcggggagccucauaugaucguguccaagcaggaacggggaaagucucuccuguuuaagaccagcgccggcguuaacaugugcacacuuauugcgauggaccugggggagcucugugaagauacccugacauacaaaugcccccgcaucaccgaggcugaacccgacgauguggacuguuggugcaaugccacggauaccugggugacauauggaaccuguucccaaacaggcgagcaccggcgggacaagcgcucugucgcccuggcuccucauguggggcucggacuggagacccggacggaaacauggaugagcuccgagggcgccuggaaacagauucagcggguugaaaccugggcccuucgccaccccggcuucacagugaucgcccuguuucucgcgcaugccauugggaccucuaucacccagaagggaaucauuuucauccugcuuaugcuggucacaccuagcauggcuaugagaugcgugggcauugggucccgggauuuuguugagggacucagcggcgccacguggguggacgucgugcuggagcacgggucuugugugaccacaauggcuaaggauaaacccacccuggacaucgaacuccugaagacagaggucaccaacccugccguucuucgcaaacugugcauugaagcgaagaucuccaauacgacaaccgauagcagauguccgacccaaggagaggccacacucguggaagaacaagacgcuaacuucgugugccggcgcaccuuugucgauagaggcuggggcaauggguguggacuguucggcaaagggucucuuauuacaugcgccaaguuuaagugcgugacgaaacuggagggaaagaucguucaguacgaaaaccucaaauauuccgugaucgucaccgugcacacaggcgaccagcaucaaguugggaaugagagcaccgaacacggaacaaccgcuacgauuacaccccaagccccuacaaccgagauccagcugacagacuacggcgcccugacccucgauuguucuccccggacgggccuggacuucaacgaaauggugcuucugacaaugaaggagaaauccuggcucguccauaagcagugguuucuggaucuuccucugcccuggaccagcggggcuuccacaucucaagagaccuggaaucgccaggaccuccuggugaccuucaaaacagcgcacgccaagaagcaggaagucgugguucugggaagccaagagggcgcuaugcacacggcccucaccggggccacagaaauucagaccuccggaacaaccacgaucuuugcuggccaucugaaaugcagacuuaagauggauaaacugacacucaaggggaugagcuaugugauguguaccggcucuuucaaacuggagaaggaagucgccgagacccagcacggaacagugcugguucagauuaaguacgagggcaccgacgcgccgugcaaaaucccuuucuccacacaagaugaaaagggggugacgcagaacggacggcuuaucaccgcuaaucccauugucacagacaaagagaagccugugaacaucgaagccgagccgcccuuuggcgagagcuauauugugaucggggccggagaaaaagcucucaagcugucuugguucaagaaaggcagcuccauugggaagauguuugaggccaccgcuagaggcgcccgccggauggcgauccugggagauacagccugggacuucggcucuaucgggggaguuuuuaccagcgucggcaaacucgugcaucagauuuucgggacggcuuacggagugcuguuuuccggcgucagcuggaccaugaagaucgggauuggcgugcuucugacauggcucggacucaauucuagauccaccagccugucuaugacauguaucgccguuggccuugugacccucuaccugggggucauggugcaggcugauuccggaugcguuauuaacuggaaaggccgcgaacugaagugugggagcggaaucuucgugacaaaugagguccacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccguuguggucggagauguggcuggcauucuggcccaggggaaaaagaugauccggccgcaacccauggagcacaaauacucuuggaaaagcuggggaaaggccaagauuaucggcgcugacgugcagaauaccacauuuaucauugaugggccuaacacccccgaauguccugacgaucagagagcguggaauaucugggaggucgaggacuauggauucggcauuuuuacgacaaacaucuggcugaaacuucgcgauuccuacacccagguuugcgaccaccggcucaugagcgccgcuauuaaagauucuagagccgugcaugccgacaugggcuauuggaucgaauccgagaagaaugaaacauggaaacuggcucgcgccagcuucaucgaggugaagaccugugucuggcccaagucucacacacugugguccaacggggugcucgaaagcgagaugauuaucccgaaaauuuacggaggcccuaucucucaacauaauuaucggcccggguacuucacccagacggcgggaccuuggcaccugggcaaacuugagcuggauuuugaccucugcgaagggaccacaguuguggucgaugagcacugcggaaacagaggccccagccugcggaccacaaccgugacgggcaaaauuauccaugaaugguguugccgcuccuguacacugccuccccuuagauucagaggggaagacggaugcugguacggcauggagaucagaccgguuaaggaaaaagaggaaaaucucgucaagagcauggucucugcuggguccggagagguggacagcuuuucccugggccugcucuguauuucuaucaugauugaagagguuaugcgcagccggugguccagaaagaugcugaugaccgggacacuugccguguucuuucugcucaucaugggacagcugaccuggaacgaucugauucgccuuugcaucauggucggcgccaaugcuucugacagaaugggcauggggaccacauaucuggcccucauggcgacguucaaaaugcggccuauguuugcugugggacugcuguuccgcagacugaccagccgggaggugcuucugcucacaauuggccugucccuggucgccucuguugaacuucccaacagccuggaggaacucggggauggacuggccaugggcaucaugauccucaagcugcuuaccgacuuucaaucccaccagcugugggcuacacuccugagccugaccuucauuaaaacgacauuuucucuucauuacgccuggaagaccauggcuauggugcuguccaucgugagccucuucccccugugucucucuaccacaucccagaaaaccacauggcugccuguccuucuggggagccugggaugcaagccgcucacgauguuucugauugccgagaauaagaucuggggccgcaaaucuuggccccuuaacgaaggcauuauggcgguggggaucguuuccauccugcucagcucccugcucaagaacgaugugccucuggccggaccccuuauugcuggcgggaugcugaucgccuguuaugucauuagcggaucuagcgcugaccugucccucgagaaagccgccgaggugucuugggaagaggaagcugagcacagcggcgcgucccauaauauccugguugaagugcaggaugacgggaccaugaagauuaaagaugaggagagagacgauacacuuaccauccugcucaaggccacacugcucgcugucucuggaguguacccucugagcauccccgccacccuuuucgucugguauuucuggcagaagaagaagcagcgguccggcgugcugugggacacgccuucucccccggaaguugagcgcgccgugcuggaugacggcauuuacagaaucaugcagcgggggcuccugggacgcagccaggucggcguggggguuuuucaagaaaacguguuccacaccauguggcacgucacaagaggagcugugcuuauguaucagggcaaacggcuggagccuuccugggccagcgugaagaaagaccucauuucuuacgggggaggcuggagacugcagggcuccuggaauaccggggaggaaguucaggucaucgcgguggagcccggaaagaacccuaaaaaugugcaaacagcucccggcaccuuuaagacaccggaaggggaggucggagccauugcccucgauuucaagccuggcacgagcgggucucccaucgugaaccgcgaaggaaaaauuguuggccuguacggcaaugggguggucaccacauccggaaccuaugugagcgcuaucgcccaggcgaaggcuucccaggagggcccucuucccgagaucgaagacgagguuuuucggaaaagaaaccugaccauuauggaucugcaucccgggucuggaaagacacgccgguaccucccugccaucgugagagaagccauuaaacgcaagcugcggacgcuuauccuggcuccgaccagagucguggccagcgagauggcugaagcccucaagggcaugcccauucgcuaucaaacaaccgcgguuaaauccgagcacacagggaaggagaucguggaccugaugugccaugccaccuucacgaugcggcugcucagcccugucagagugcccaauuacaacaugaucauuauggaugaagcucacuuuacagacccuucuuccaucgccgcucggggcuauauuagcacccgcgugggaaugggcgaggccgccgcuaucuucaugaccgcgacacccccugggucugucgaagccuuuccgcagagcaaugcuguuauucaggaugaggaaagagacauccccgagcgguccuggaacucuggauacgaguggaucaccgauuucccuggcaaaacagugugguuugugcccagcauuaaguccgggaaugacaucgccaacugucuucgcaaaaauggaaagagagucauucagcugucucggaagaccuucgauacggaauaucagaagaccaagaacaacgacugggacuacgugguuaccacagauaucagcgagaugggcgccaauuucagagcugaccgcgugauugauccucggagaugccugaaacccgucauccucaaggacgggccggaacgcgugauucuggccggcccuaugcccguuaccguggcguccgcugcccagcggagaggacgcgucggccggaaccauaauaaagagggggaucaguacaucuauaugggacagccccuuaacaaugacgaggaucacgcccacuggacggaagcuaagaugcugcucgacaacaucaauaccccugagggcauuauccccgcccuguuugaaccugagagagaaaagagcgcggccauugauggggaguaccgccugagaggagaggcucggaaaacauucguggaacucaugcgcagaggcgaccuuccggucuggcugucuuauaagguggccuccgagggguuucaauacagcgaucggcgcuggugcuucgacggcgaaagaaacaaucagguucuggaggaaaacauggauguggagaucuggaccaaagagggagaacggaagaaacucagaccccgcuggcuggacgcucggacauauuccgacccucuugcccugagagaguuuaaggaguucgcugccggccgccggucugugagcggggaucucauucuggagaucggaaaacugccccagcaucucacccagaaggcgcaaaaugcccuugacaaccuggucaugcugcacaauuccgaacagggcgggagagcuuaccggcaugccauggaggagcucccugauacaaucgaaacccugaugcuucuggcucucauugccguucugacgggaggcgugacacuguuuuuccucucuggccgcgggcuuggaaagaccagcaucggccugcugugugugauggccuccagcguccuccuguggauggcuucuguggagccccacuggauugcggccuccaucauucuugaauuuuuccugaugguucuccugaucccggagccugacagacagcggacaccccaggauaaccaacuggcuuauguggucaucgggcuccuuuuuaugauucugacaguggccgccaaugagaugggacugcucgaaaccaccaagaaggaccugggcaucgggcacgucgcuguggagaaccaucaccaugccgcgaugcuugauguugaccugcacccugccagcgcuuggacgcucuacgccguggcuaccacaauuaucacccccaugaugcgccauacaauugaaaacaccacggccaauaucucucugaccgcgauugccaaccaggcugccauccugaugggacucgauaaaggcuggccuaucuccaagauggacauuggcgucccccuucuggcucuggggugcuacagccaggugaauccgcucacacugaccgccgcuguucuuaugcugguggcccacuaugcgaucauuggaccuggccuccaagccaaagcuacaagagaggcccagaagcggaccgcugccgggaucaugaagaaccccacggucgauggaauuguggccaucgaccuggaucccgugguuuacgacgcgaaauucgaaaagcagcugggccagaucaugcuccuuauucuguguacaucucaaauccugcucaugcgcaccacaugggcucugugcgagagcauuacccuugccaccgggccucugacaacgcucugggagggauccccgggcaaauuuuggaauaccacaaucgcugucucuauggccaacauuuucagaggcagcuaucuggccggggcuggacuggccuucucccucaugaaaagccuuggcgggggacggcgcggcaccggggcgcagggagaaacacugggcgagaaauggaagagacagcugaaucagcucuccaagucugaauuuaacaccuacaaacggagcggcaucauggagguggacagauccgaagccaaggaggggcugaaacgcggagagacgacaaagcacgcugugucucggggcaccgccaaacuuagaugguucgucgaacgcaaucugguuaagcccgaggggaaggugaucgaucucggauguggcagagggggauggagcuauuacugcgcuggccugaaaaaggugaccgaagucaaaggcuauacaaaagggggaccuggccaugaggaacccauuccuauggccaccuacggguggaaccuggugaaacuccacuccggaaaggacguguuuuucauucccccugagaaaugugauacacuucugugcgacaucggcgagucuagcccgaaucccacgaucgaagaggggagaacccugcgcguucucaagauggucgaaccuuggcugcggggaaaccaauuuuguauuaaggugcuuaaucccuacaugccuuccguuguggagacacuggagcagaugcagagaaaacauggcggcaugcucguccgcaacccccugagcagaaauucuacccacgaaauguauuggguguccugcgggacaggaaacaucgugagcgcggucaauaugaccucuagaaugcugcucaaccgcuucacgauggcccaccggaagccgaccuacgagagagauguugaccugggcgcugggacacgccauguggccguggaaccugaggucgcuaaccuugauauuaucggacagagaaucgaaaauauuaaacacgagcauaaguccaccuggcacuaugacgaggauaaccccuacaaaacaugggccuaucauggcagcuacgaagugaagcccucuggguccgcuagcuccaugguuaauggaguggucaagcugcucaccaaaccuugggacgugauccccaugguuacacaaauugccaugaccgauacgacaccuuuuggccagcagcggguguucaaggagaaagucgacacccgcaccccgaaggcgaaaagaggcacaacgcaaaucauggaagugaccgcccgguggcuguggggguuucuuagcagaaacaagaagccccggauuuguacacgcgaggaguucaccagaaaaguucggucuaaugcugccaucggagcuguguuugucgacgagaaccaguggaauagcgccaaggaggccguggaagaugagcgcuucugggaccugguccacagagaacgggagcuccacaaacagggcaagugcgcgacaugcguguauaacaugauggggaaacgcgaaaagaagcugggagaguuuggcaaagcuaagggguccagagccaucugguacauguggcugggcgcccgguuccucgaguucgaagcucugggauuuaugaaugaggaucauugguucucucgcgaaaacagccuuuccggcguugagggggagggacugcacaaacucggcuacauucugagagacaucucuaagauuccugggggaaauauguaugccgaugacaccgcuggcugggauacacggaucaccgaagacgaucuucagaacgaggccaaaauuacggacaucauggaacccgagcaugcgcugcucgccaaggcuaucuuuaaacugaccuaccaaaauaaggugguccgcgugcagagaccugccaagaacgggacagugauggauguuauuagccggcgcgaccagagaggcuccggacaggugggcaccuaugggcugaauacauucaccaacauggaagcucaacucauccggcagauggagucugagggaauuuuuagccccuccgaacuggagacgccgaaccuugccgaaagaguccuggauuggcucgagaaauacggcguggaacgccugaagcggauggcgaucagcggggacgacuguguugugaaaccuauugaugacagauucgccacagcucuuaccgcccugaaugauaugggaaagguccgcaaagacaucccccagugggagccuucuaagggcuggaacgauuggcagcaagugcccuuuugcucccaccacuuccaucagcucaucaugaaggacgggcgggagauugucgugccuuguagaaaucaggaugaacugguuggccgcgcucgggugagccagggagccggcuggucucugagagagacagcuugccucgggaaauccuaugcccaaauguggcagcugauguacuuucaccgccgggaccuuagacuggcggccaacgcuaucuguagcgccguccccguggauuggguuccgaccucccgcacgaccuggucuauucaugcccaccaucaguggaugacaaccgaagacaugcucagcguguggaaucgggucuggaucgaggaaaacccuuggauggaggauaagacacacauuuccagcugggaggacgugcccuaucugggaaaaagagaagaccaauggugcggcucucuuaucgggcugaccgcucgggccacaugggcgaccaauauucagguggcuaucaaccagguuagacgccucaucggaaaugagaacuaccuggauuacaugacguccaugaagcgguucaaaaaugaaagcgaccccgagggcgcccugugguga

SEQ ID NO: 19440 - RNA, 9879 nt, Artificial Sequence
  derived and/or modified CDS sequence (opt5) from DENV-1__KC762642__SS-prME
agcgugaccaugcugcucaugcugaugcccacagcucuugcuuuccaccugacgaccagaggaggggaaccucauaugauugucuccaagcaggaacggggaaaaucucuccuguuuaagaccagcgccggcguuaacaugugcacccuuauugcgauggaccugggggaacucugugaagauacacugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaagacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccacacaagagaccuggaaucgccaggaccuccuggugaccuucaaaacagcgcacgccaagaagcaggaagucgugguucugggaucucaagagggcgcuaugcacacggcccucaccggggccacagaaauucagaccagcggaacaaccacgaucuuugcuggccaucugaaaugcagacuuaagauggauaaacugacacucaaggggauguccuaugugauguguaccggcagcuucaaacuggagaaggaagucgccgagacccagcacggaacagugcugguucagauuaaguacgagggcaccgacgcgccgugcaaaaucccuuucucuacacaagaugaaaagggggugacgcagaacggacggcuuaucaccgcuaaucccauugucacagacaaagagaagccugugaacaucgaagccgagccgcccuuuggcgaguccuauauugugaucggggccggagaaaaagcucucaagcugagcugguucaagaaaggcucuagcauugggaagauguuugaggccaccgcuagaggcgcccgccggauggcgauccugggagauacagccugggacuucggcuccaucgggggaguuuuuaccucugucggcaaacucgugcaucagauuuucgggacggcuuacggagugcuguuuagcggcgucuccuggaccaugaagaucgggauuggcgugcuucugacauggcucggacugaauagcagaucuaccucccugagcaugacauguaucgccguuggccuugugacccucuaccugggggucauggugcaggcugauucuggaugcguuauuaacuggaaaggccgcgaacugaaguguggguccggaaucuucgugacaaaugagguccacaccuggacggaacaauauaaguuucaggccgacagcccuaaacggcucuccgcggccauuggcaaggcuugggaggagggggugugcggcaucagaucugccacacgccuggaaaacaucauguggaaacagauuagcaacgagcuuaaucauauccugcucgaaaacgacaugaaguucaccguuguggucggagauguggcuggcauucuggcccaggggaaaaagaugauccggccgcaacccauggagcacaaauacuccuggaagucuuggggaaaggccaaaauuaucggcgcugacgugcagaauaccacauuuaucauugaugggccuaacacccccgaauguccugacgaucagagagcguggaauaucugggaggucgaggacuauggauucggcauuuuuacgacaaacaucuggcugaaacuucgcgauagcuacacccagguuugcgaccaccggcucauguccgccgcuauuaaagauagcaaggccgugcaugccgacaugggcuauuggaucgaaucugagaaaaaugaaacauggaagcuggcuagagccuccuucaucgaggugaagaccuguauuuggcccaaaagccacacacuguggucuaacgggguccucgaauccgagaugaucauuccgaagaucuacggaggcccuauuagccaacauaauuaucgccccggguacuucacccagacggcgggaccuuggcaccugggcaaacuugagcuggauuuugaccucugcgaagggaccacagugguuguggaugagcacugcggaaaccggggccccucucugagaaccacaaccgucacgggcaagaucauccaugaaugguguugccggagcuguacacugccuccccuucgcuucagaggggaggacggaugcugguacggcauggagauucggccggugaaagaaaaggaggaaaaucucguuaaguccauggugagcgcugggucuggagaggucgacuccuuuagccugggccugcucuguaucuccauuaugaucgaagaggugaugagaucucgcuggagccggaaaaugcugauuaccgggacacuugccguuuucuuucugcucaucaugggacaggugaccuggaacgaucugaccagacugugcauuauggucggcgccaaugcuuccgaccgcaugggcauggggacaacguaucuugcccugauggcgaccuucaagaugagaccuauguuugcugugggacuccuguuccggcgccucacaucuagagaggugcugcuucugaccaucggccucagccuggucgccuccguugaacugcccaacucucuugaggaacugggggauggacucgccaugggcaucaugauucugaaacuccugacagacuuucaaagccaccagcuuugggcuacccugcucucccugacguucaucaagacaaccuuuagccugcauuacgccuggaaaaccauggcuauggugcuuucuauugugucccuguucccccucugucugagcacaaccucucagaagacaacguggcucccuguccugcuugggucccugggaugcaagccgcugaccauguuucucaucgccgagaauaaaauuuggggccggaaguccuggccccugaacgaaggcaucauggcgguggggaucguuucuauucuucuguccagccuccugaaaaacgaugugccucucgccggaccccugaucgcuggcgggaugcuuauugccuguuaugucaucuccggaagcucugcugaccugagccuggagaaggccgccgagguguccugggaagaggaagcugagcacucuggcgcgagccauaauauucucguugaagugcaggaugacgggacaaugaaaaucaaggaugaggagcgcgacgauacccugacaauccuucugaaagccacccuccuggcugucuccggaguguacccucucucuauucccgccacgcuguucgucugguauuucuggcaaaagaagaaacagagaagcggcgugcuuugggacaccccuagcccucccgaaguugagcgggccgugcuggaugacggcaucuaccgcauuaugcagagagggcugcucggacggucucaggucggcguggggguuuuucaagaaaacguguuccacacaauguggcacgucacccgcggagcugugcugauguaucagggcaagagacuugagcccagcugggccuccgugaaaaaggaccugaucagcuacgggggaggcuggcggcuccagggcucuuggaauacaggggaggaaguucaggucauugcgguggagcccggcaagaauccuaagaaugugcaaaccgcucccggcacauuuaagacgccggaaggggaggucggagccaucgcccuggauuucaaaccuggcaccuccgggagccccauugugaacagagaaggaaagaucguuggccucuacggcaaugggguggucacaaccucuggaaccuauguguccgcuaucgcccaggcgaaagcuagccaggagggcccucugcccgagauugaagacgagguuuuucgcaagcggaaccuuacaaucauggaucugcaucccggguccggaaaaacgagacgcuaccugccugccauugugcgggaagccaucaagagaaagcuccgcacccugauucuugcuccgacacgggucguggccucugagauggcugaagcccugaaaggcaugcccaucagauaucaaaccacagcgguuaagagcgagcacaccgggcgcgagaucguggaccucaugugccaugccacguucacaaugcggcugcuguccccugucagagugcccaauuacaacaugauuaucauggaugaagcucacuuuaccgacccuagcucuauugccgcucggggcuauaucuccacccgcgugggaaugggcgaggccgccgcuauuuucaugacagcgacacccccugggagcgucgaagccuuuccgcagucuaaugcuguuauccaggaugaggaaagagacauccccgagcggagcuggaacuccggauacgaguggauuacagauuucccuggcaaaaccgugugguuugugcccucuaucaagagcgggaaugacauugccaacugucuccgcaaaaauggaaagagagucauccagcuuucccggaagacguucgauacagaauaucagaagaccaagaacaacgacugggacuacgugguuacaaccgauauuucugagaugggcgccaauuucagagcugaccgcgugaucgauccucggagaugccugaaacccgucauucugaaggacgggccggaacgcgugauccucgccggcccuaugcccguuacgguggcgagcgcugcccagcggagaggacgcaucggccggaaccauaauaaagagggggaucaguacauuuauaugggacagccccugaacaaugacgaggaucacgcccacuggaccgaagcuaagaugcuucuggacaacaucaauacaccugagggcauuauccccgcccucuuugaaccugagagagaaaaguccgcggccauugauggggaguaccgccugagaggagaggcucggaaaaccuucgucgaacugaugcgcagaggcgaccucccgguguggcuuagcuauaaggucgccucugagggguuucaauacuccgaucggcgcuggugcuucgacggcgaaagaaacaaucaggugcuggaggaaaacauggauguugagaucuggacaaaagagggagaacggaagaaacugagaccccgcuggcucgacgcucggaccuauagcgacccucuggcccuuagagaguuuaaggaguucgcugccggccgccgguccgugucuggggaucugauccucgagauuggaaaacugccccagcaucugacacagagagcgcaaaaugcccucgacaaccuugugaugcugcacaauagcgaacagggcgggcgggcuuaccgccaugccauggaggagcugccugauaccaucgaaacgcucaugcugcuugcucugauugccguccucacaggaggcguuacccuguuuuuccuguccggcagagggcucggaaagaccucuaucggccuucugugugugauggccagcuccgugcugcucuggauggcuagcgucgagccccacuggauugcggccucuaucauccuggaauuuuuccuuauggugcugcucauuccggagccugaccggcagcgcacaccccaggauaaccaacuggcuuauguugugaucgggcugcucuuuaugauucuuaccgucgccgccaaugagaugggacugcuggaaacaacgaagaaagaccucggcaucgggcacguggcugucgagaaccaucaccaugccgcgaugcuggauguggaccuucacccugccuccgcuuggacccuguacgccguugcuacaaccauuaucacacccaugaugagacauaccauugaaaacacgaccgccaauaucagccucacagcgaucgccaaccaggcugccauucugaugggacuggauaagggcuggccuaucucuaaaauggacauuggcgugccccuccuugcucuggggugcuacucccaggucaauccgcugacccucacagccgcugugcugaugcuuguugcccacuaugcgaucauuggaccuggccugcaagccaaggcuacccgggaggcccagaaacgcacggcugccgggaucaugaagaaccccacaguggauggaaucgucgccauugaccucgaucccgugguguacgacgcgaaguucgaaaaacagcugggccagaucaugcugcucauucuuuguaccagccaaauccugcugaugagaacaaccugggcucucugcgagucuauuacccuggccacagggccucuuacgacccugugggagggaagcccgggcaaguuuuggaauacaaccaucgcuguuuccauggccaacaucuuccggggcucuuaucucgccggggcuggacuggccuucagccugaugaaaucccucggcgggggacgcagaggcacaggggcgcagggagaaacccuuggcgagaaguggaaacggcagcugaaucagcugagcaaguccgaauuuaacacguacaagagaucuggcauuauggaggucgaccgcagcgaagccaaagaggggcucaagcggggagagacaaccaaacacgcuguguccagaggcaccgccaagcugcgcugguucguggaacggaaucuugucaaacccgaggggaagguuaucgaucugggauguggcagagggggauggucuuauuacugcgcuggccucaagaaagugacagaagugaagggcuauaccaaagggggaccuggccaugaggaacccauuccuauggccacauacggguggaaccuggucaagcugcacagcggaaaagacguguuuuucauucccccugagaagugugauacgcuccuuugcgacaucggcgaguccucuccgaaucccaccaucgaagaggggcgcacacugcggguucugaaaaugguggaaccuuggcucagaggaaaccaauuuuguauuaagauccugaaucccuacaugccuagcgucguggagacccuugagcagaugcagcgcaagcauggcggcaugcugguucggaacccccucuccagaaauagcacacacgaaauguauugggugucuugcgggaccggaaacaucgucuccgcggugaauaugacgagccgcaugcugcugaaccgguucaccauggcccacagaaaaccgacauacgagcgcgauguggaccucggcgcugggaccagacaugucgccguugaaccugagguggcuaaccuggauauuaucggacagcggauugaaaauaucaaguaugagcacaaaucuacauggcauuacgacgaggauaaccccuauaagaccugggccuaccacggcuccuaugaagugaaacccagcgggucugcuuccagcauggucaauggagugguuaaacuucugacaaagccuugggacgugauucccauggucacccaaaucgccaugacggauacaaccccuuuuggccagcagcgcguguucaaagagaagguugacaccagaacaccgaaagcgaagcggggcacggcccaaaucauggaagugaccgcuagauggcucuggggguuucugucccggaacaaaaagccccgcauuuguacaagagaggaguucacccggaagguccgcagcaaugccgcuaucggagccguguuuguugacgagaaccaguggaacucugccaaagaggcgguggaagaugagagauucugggaccuuguccaucgggaacgcgagcugcacaagcagggcaaaugcgcuacaugcguguacaacaugauggggaagagagagaaaaagcucggagaguuuggcaaggccaaagggagccgggccauuugguacauguggcugggcgcucgcuuccuggaguucgaagcccucggauuuaugaaugaggaucacugguucuccagagaaaacucucugagcggcgucgagggggagggacuucauaagcugggcuauauccuccgggacauuuccaaaaucccugggggaaauauguacgcugaugacaccgccggcugggauacacgcaucaccgaagacgaucugcagaacgaggcgaagauuacggacaucauggaacccgagcacgcccuucuggcuaaagccguguuuaagcucaccuaucaaaauaaaguugugagaguccagcggccugcuaagaacgggacagugauggaugugauuucucgcagagaccagcggggcagcggacagguuggcaccuacgggcugaauacauucaccaacauggaagcccaacugaucagacagauggaguccgagggaaucuuuucucccagcgaacucgagacgccgaaccuggcggaacgcgugcuuuauuggcuggagaaguacggcgucgaacggcucaaaagaauggccaucuccggggaugacugugugguuaagccuaucgacgaucgcuucgcuacagcccugaccgcucuuaaugacaugggaaaagugcggaaggauauuccccagugggagccuagcaaaggcuggaacgacuggcagcaaguccccuuuugcucucaucacuuccaccagcugaucaugaaggaugggagagagauuguggucccuugucgcaaucaggacgaacucgugggccgggccagaguuucccagggagcuggcuggagccugcgcgagacagccugccuggggaagucuuaugcgcaaauguggcagcucauguacuuucaucggagagaucugcgccuugccgcuaacgccaucuguuccgccgugcccgucgacugggugccgaccagccggacgaccugguccauucacgcucaucaccaguggaugacaaccgaagauaugcugucuguuuggaauagaguguggaucgaggaaaacccuuggauggaggacaaaacacauauuagcuccugggaggauguccccuaccucggaaagcgggaagaccaauggugcggcagccugaucgggcuuaccgccagagcgacaugggcuaccaauauccagguggccauuaaccaggugcgccggcugaucggaaaugagaacuaucucgacuacaugacgucuaugaaaagauucaagaaugaauccgaucccgagggcgcccugugguga

SEQ ID NO: 19441 - RNA, 9879 nt, Artificial Sequence
  derived and/or modified CDS sequence (opt5) from DENV-1__JQ915077__SS-prME
agcgugaccaugcugcucaugcugcuucccacaguccugacguuccaccucaccacaagaggcggggagccucauaugauuguuuccaagcaggaacggggaaaaucucugcuuuuuaagaccagcgccggcgugaauaugugcacacugauugcuauggaccucggggagcugugugaugacaccaugacauacaaaugcccgcgcaucaccgaaacggagcccgaugacguggauuguuggugcaaugccaccgaaacaugggucaccuauggaacauguucccagaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagaacaagacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucacaccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacauccggggccagcaccucccaagagaccuggaaccgccaggaccuccuggucacauucaaaacggcucacgccaagaagcaggaagugguugugcugggaucucaagagggcgccaugcacaccgcucucacaggggcgaccgaaauccagacaagcggaaccacgacaauuuuugccggccaucugaaaugcagacuuaagauggauaaacugacccucaaggggaucuccuaugucauguguaccggcagcuucaaacuggagaaggaaguggcugagacacagcacggaaccguucuggugcaggucaaguacgagggcacagacgccccgugcaaaaucccuuucucuucccaagaugaaaagggggugacgcagaauggacggcuugugaccgccaaccccauuguuacagacaaagagaagccugucaauaucgaagcugagccgcccuuuggcgagagcuauauuguggugggggccggagaaaaagcgcucaagcugucuugguucaagaaaggcagcuccaucgggaagauguuugaggcuaccgccagaggcgcccgccggauggcuauucugggagauacagccugggacuucggcucuaucgggggagucuuuaccagcgugggcaaacucguucaucagaucuucgggacggcuuacggagugcuguuuuccggcgucagcuggaccaugaagauugggaucggcauucuucugacauggcucggacugaacucuagauccaccagccugucuaugacauguaucgccgugggcaugguuacccuuuaccucggggugaugguccaggcggauuccggaugcgugauuaauuggaaaggccgcgaacugaagugugggagcggaaucuucguuacaaacgaggugcacaccuggacggaacaauauaaguuucaggccgacuccccuaaacggcugucugcugccauuggcaaggcuugggaggagggggucugcggcaucagaagcgccacacgccucgaaaacaucauguggaaacagauuuccaaugagcugaaccauauccuucuggaaaaugacaugaaguucaccgugguggucggagauguuucuggcauucucgcgcaggggaaaaagaccauccggccgcaacccauggagcacaaauacagcuggaaguccuggggaaaggccaaaauuaucggcgcugacgugcagaacacaaccuuuaucauugaugggccuaauacgcccgaauguccugacgaucagagagccuggaacaucugggagguggaggacuauggauucggcauuuuuacaaccaauaucuggcugaagcugcgcgauagcuacacacaggucugcgaccaccggcuuaugucugcugccauuaaagauuccaaggccgugcaugcugacaugggcuauuggaucgaaagcgagaaaaacgaaaccuggaagcucgcgagagccucuuucaucgagguuaagacauguguguggcccaaaucccacacccuguggagcaaugggguccuggaaucugagaugauuaucccgaagauuuacggaggcccuaucagccaacauaacuaucgccccggguacuucacgcagaccgcuggaccuuggcaccucggcaaacuggagcuugauuuugaccugugcgaagggacaaccgugguuguggaugagcacugcggaaaucggggccccucccucagaacaaccacggucacaggcaagauuauccaugaaugguguugccggagcuguacccugccuccccugcgcuucaaaggggaggacggaugcugguacggcauggagaucagaccggugaaggaaaaggaggaaaaccuuguuaaaucuaugguguccgccgggagcggagaggucgacuccuuuucucucggccugcuguguauuagcaucaugauugaagaggugaugcgguccagauggucucgcaagaugcucaugacagggacccugguggucuuccuucugcucacccugggacagcugacauggaaugaucuuauccggcugugcauuaugguuggcgccaacgcuagcgacaauaugggcauggggacgaccuaucucgcccugauggcgacauuuagaaugcgcccuauguucgcugugggacuccuguuuagacggcuuaccucccgcgaggugcugcuccugacagucggccugucucuuguggccagcguugaacugcccaacucccucgaugagcugggggacggacucgccaugggcaucaugauucugaaacuucugaccgauuuccaaagccaccagcucugggcuauccugcugucucuuacguuugugaagacaacccugucccuccauuacgccuggaaaaccauggcgaugauccugagcauugucucucuccugccccuuugucuguccacaaccagccagaagacaacguggcugccugugcuccuggggucucuuggaugcaagccgcugaccauguuccucaucacagaaaacaaaauuuggggcagaaaguccuggccccugaaugagggcaucauggcuguugggauugugagcauccuccuguccagccuucugaaaaacgacgucccucuggccggaccccucaucgccggcgggaugcugauugcuuguuaugugaucucuggaagcuccgccgaucuuucucuggaaaaggcugccaaagucagcugggaggaggaagcggagcacuccggcgccucucauaauauucucguggaaauccaggacgaugggaccaugaagauuaaagacgaggaacgggaugacacaaucaccauccugcucaaggcuacgcugcuugccauuagcggaguuuacccuauguccauccccgcuacccuguuuguguggcacuucuggcaaaagaaaaagcagcgcucuggcguccugugggauacaccuagcccucccgagguggagaaagccguucucgacgacggcauuuauagaauccugcagcgggggcuucugggacgcucccaggugggcgucgggguguuucaagaaggaguguuccacaccauguggcauguuacaagaggcgccguccucauguaccaggggaagcggcuggagcccagcugggcuucugugaaaaaggaucucauuuccuauggaggcggcuggcgcuuccaggggagcuggaacaccggagaagaggugcaggucaucgcgguggagcccggcaagaauccuaaaaacguucaaacagcccccgggacguuuaagaccucugaaggagaggugggcgcuauugcccuggacuucaaaccggggacauccggaagcccuaucgucaauagagaaggcaagaucgugggccuuuacgggaacggaguugugaccaccuccggcacauacgucucugccauugcucaggccaaagcgagccaggaggggccccugccugaaaucgaggaugagguguuucggaagagaaaucugacgauuauggaccuccaccccggauccggcaagacccgccgguaucugcccgcuaucguuagagaagccauuaaacgcaaacuucggacacuggugcucgccccuaccagagucguggcuagcgagauggccgaagcgcugaaagggaugccgauccgcuaccaaacaaccgcugugaagucugagcauacgggcaaagaaaucgucgaucugaugugccacgccacauucaccaugcggcuccuuucccccguuagagugccuaacuauaauaugauuaucauggacgaggcccauuuuaccgaucccgcuagcauugccgcucgcggauacaucucuacacgggugggcaugggggaggccgcggccauuuucaugaccgcuacaccucccggaagcgucgaagccuuuccucaguccaacgcugugauccaggacgaggaaaaggauaucccggagagaucuuggaauagcggcuaugacuggauuaccgauuuccccgggaagacgguuugguuugugccuuccaucaaaucuggaaacgacauugccaauugucugcggaagaacggcaaacgcgucauccagcugagcagaaagacauucgacaccgaauaccagaagacaaagaacaaugauugggacuaugugguuaccacggauauuuccgagaugggggccaacuuucgggcugaccgcgugaucgaucccagacggugccucaagccugucauucugaaagacggccccgagagagugauccuugcgggaccgaugccugucaccguggccagcgcugcccagcgccggggcagaaucgggcgcaaucagaacaaggaaggagaucaguacauuuacaugggccaaccccugaauaacgacgaggaucacgcccacuggacagaagcuaaaaugcuccuggacaauaucaacacccccgaggggauuaucccugcccuguucgagcccgaacgggagaagucugcggcuauugauggagaauauagacuccgcggcgaggcccggaaaacauucguugaacuuaugagacgcggggaccugccuguguggcuguccuacaagguggccagcgagggcuuucaguauuccgauagacgguggugcuucgacggagagcgcaauaaccagguccucgaagagaauauggacguugaaaucuggaccaaagagggcgaaagaaagaagcugcggccgcgcuggcuugaugcuagaacauacucugacccccuggcccuccgggaguuuaaagaguucgcggccgggagacgcagcguguccggagaucugauccuggaaauuggcaagcucccucagcaucuuacccaacgggcucagaacgcccuggacaaucuggugaugcuccacaacucugagcaagggggaaaggcuuauagacaugccauggaggaacugcccgauacgaucgaaacaauuaugcuucuggcucucaucgccguccugaccggcggcgugacccuguuuuuccucagcgggcgcggacuuggcaagacauccauugggcugcuguguguuaccuccucuagcgugcuccuguggauggcgagcgucgagccucacuggaucgccgcuucuaucauucuugaguuuuuccugauggugcuccugauccccgaaccggaccggcagagaacaccucaagauaaucagcuggccuacgucgugauuggacuccuuuuuaugauccugacgguugcugccaacgagaugggccugcucgaaaccaccaagaaagaccuggggauuggacacgccgcugcggagaaccaucaccaugccgcuaugcuugauguggaccugcaccccgccuccgccuggacccucuaugcugucgccacaaccaucauuacgccuaugaugcggcauaccaucgagaauacaaccgcgaacaucagccugacagccauugcuaaucaggccgcuauccugaugggccucgauaagggcuggcccauuucuaaaauggacaucggggugccucuucuggcccugggaugcuacagccaaguuaacccccucacccugacggcggccgugcuuaugcuggucgcucacuacgccauuaucggcccggggcuccaggcuaaggccacacgcgaagcucagaaaagaaccgccgcgggaaucaugaagaauccuacaguggauggcauuguggccaucgaccuggaccccguugucuaugaugcuaaauucgagaagcagcuggggcaaauuaugcuccuuauccuguguaccucccagauucugcucaugcggaccacaugggcccugugcgaaucuaucacgcuugcuaccggaccccugacaacccucugggagggcagcccuggcaaguuuuggaacacaaccaucgccguguccauggccaauauuuuccgcgggagcuaccuggcgggagcuggccuggccuuuucccucaugaaaucucuugggggaggcagacgggggacgggagcucagggcgaaacacugggcgagaaguggaaacgccagcugaaccaacucagcaaguccgaguucaauaccuauaaaagaucugggaucauugaaguggaccggagcgaggccaaggaaggacugaagcgcggcgagaccacaaaacacgccgucuccagagggaccgcuaaacuucggugguucguugaaagaaaccuggugaaaccggagggaaaggugaucgaucucggcugugggcgcggaggcuggucuuacuauugcgccggccugaaaaaggucacagaggugaaaggguacacgaagggaggccccgggcaugaggagccuauucccauggcgaccuauggauggaaucugguuaagcuccacagcggcaaagacguguuuuucaucccucccgaaaagugugauacacuucugugcgacauuggggaguccagcccuaacccgaccaucgaagagggacggacacugagaguccucaaaaugguggagcccuggcugcgcggcaaucaguuuuguaucaagauucuuaacccuuacaugcccucuguuguggaaacccuggagcagaugcagcggaaacauggcgggaugcucgucagaaauccucugucccgcaacagcacgcacgaaauguacugggugucuugcggaaccggcaauaucguguccgccgucaacaugacaagccggaugcugcucaacagauucaccauggcucaccgcaagcccacauaugagcgggauguugaccugggggccggaaccagacauguggcuguggagccggaagucgccaaucuugauauuaucggccaacgcauugagaacaucaagaaugaacacaaaucuacauggcauuacgacgaggauaacccuuauaagaccugggcguaccacggguccuaugaagugaaacccagcggauccgccagcucuaugguuaauggcgugguccggcugcucacgaagcccugggacgugaucccuaugguuacacagauugcuaugaccgacaccacacccuuuggccagcaaagaguguucaaagagaaggucgauacgcgcaccccuaaggccaaaagagggacagcucagaucauggaggugaccgccaaguggcuguggggauuucuuagccggaacaaaaagccgcgcauuuguacaagagaagaguucacccggaaaguuagauccaaugcugccaucggcgcgguguuugucgacgaaaaccaguggaacucugccaaggaggcuguggaagaugagcgguucugggaccugguccgcagagagcgggaacuccauaagcaggggaaaugcgccacaugcguguacaacaugaugggaaagcgcgagaaaaagcugggcgaauuugggaaagcuaagggcagcagagccauuugguauauguggcugggagcccgguuccucgaguuugaagcgcugggcuucaugaaugaggaucacugguucucccgcgagaacucucuuagcgggguugaaggagagggccugcacaaacucggguacauccugagagacaucuccaagauucccggaggcaauauguacgcugaugacaccgccgggugggauacgcggaucaccgaagacgaucuucaaaacgaggccaagauuacagacaucauggagccugaacaugcucugcucgccaccucuauuuuuaaacugacauaucagaauaaggugguccgcgugcagagacccgcuaaaaacggcaccgugauggauguuaucagccggcgcgaccagagaggauccggccaaguggggacguacggacugaacacauucaccaauauggaggcccagcucauccggcagauggaaagcgagggcaucuuuucuccuuccgaacuggagacacccaaccuugcggggcgcguccuggacuggcucgagaagcacggaaccgaaagacugcggagaauggccaucagcggcgaugacugugugguuaaaccgauugaugaccgcuucgcuacggcccuuaccgcucugaaugauauggggaaggugcggaaggacaucccucagugggagcccucuaaaggcuggaacgauuggcaacaggucccuuuuugcucccaucacuuccaccagcucauuaugaaggacggaagagaaaucgugguccccugucgcaaucaggaugagcuggugggccgggccagaguuagccaaggggcgggauggucccugcgcgaaacagccugccucggcaaaucuuaugcucagauguggcagcugauguacuuucaucggagagaccuucgccuggccgcuaacgccauuuguagcgcugugccugucgauugggugcccaccucccggacaaccuggagcauccacgcccaucaccaauggaugacaaccgaggacaugcucucuguuuggaauagaguguggaucgaggaaaacccguggauggaggacaagacgcaugucuccagcugggaagaugugccuuaucuggggaaacgcgaggaccaguggugcggaucucuuauuggccugacagcgcgggccaccugggcuaccaauauccagguggccauuaaccagguuagacggcucaucgggaaugaaaacuaccuggauuauaugacaagcaugaagagauucaagaaugaguccgaccccgagggcgcccugugguga

SEQ ID NO: 19442 - RNA, 9879 nt, Artificial Sequence
  derived and/or modified CDS sequence (opt5) from DENV-1__JQ915079__SS-prME
agcgugaccaugcugcucaugcugcuucccacaguccugacguuccaccucaccacaagaggcggggagccucauaugaucguuuccaagcaggaacggggaaaaucucugcuuuuuaagaccagcgccggcgugaacaugugcacacugauugcuauggaccucggggagcugugugaugacaccaugacauacaaaugcccgcgcaucaccgaaacggagcccgaugacguggauuguuggugcaaugccaccgaaacaugggucaccuauggaacauguucccaaaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagagcaggacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucaccccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacaaccggggccuccaccagccaagagacauggaaccgccaggaccuccuggucacguucaaaaccgcucacgccaagaagcaggaagugguugugcugggaucccaagagggcgccaugcacacagcucucaccggggcgacagaaauccagaccucuggaacgacaaccauuuuugccggccaucugaaaugcagacuuaagauggauaaacugacccucaaggggaucagcuaugucauguguacaggcuccuucaaacuggagaaggaaguggcugagacccagcacggaacaguucuggugcaggucaaguacgagggcacggacgccccgugcaaaaucccuuucagcucucaagaugaaaagggggugacccagaauggacggcuugugacagccaaccccauuguuaccgacaaagagagaccugucaauaucgaagcugagccccccuuuggcgaguccuauauuguggugggggccggagaaaaggcgcucaaacugagcugguucaagaagggcucuagcaucgggaaaauguuugaggcuacagcccgcggcgcccggagaauggcuauucugggagauaccgccugggacuucggcuccaucgggggagucuuuacgucugugggcaagcucguucaucagaucuucgggaccgcuuacggagugcuguuuagcggcgucuccuggacaaugaaaauugggaucggcauucuucugaccuggcucggacugaacagccgcucuacaucccugagcaugaccuguaucgccgugggcaugguuacacuuuaccucggggugaugguccaggcggauucuggaugcgugauuaauuggaagggccgggaacugaaauguggguccggaaucuucguuaccaacgaggugcacacguggacagaacaauauaaguuucaggccgacagcccuaagagacuguccgcugccauuggcaaagcuugggaggagggggucugcggcauccgcucugccacccggcucgaaaacaucauguggaagcagauuagcaaugagcugaaccauauccuucuggaaaaugacaugaaauucaccgugguggucggagauguuuccggcauucucgcgcaggggaagaaaacaaucagaccgcaacccauggagcacaaguacucuuggaaaagcuggggaaaggccaagauuaucggcgcugacgugcagaacaccacguuuaucauugaugggccuaauacacccgaauguccugacgaucagcgcgccuggaacaucugggagguggaggacuauggauucggcauuuuuaccacaaauaucuggcugaaacugcgggauuccuacacccaggucugcgaccacagacuuaugagcgcugccauuaaggauucuaaagccgugcaugcugacaugggcuauuggaucgaauccgagaagaacgaaacauggaaacucgcgcgcgccagcuucaucgagguuaagaccuguguguggcccaagucucacacgcugugguccaaugggguccuggaaagcgagauggugauuccgaaaaucuacggaggcccuauuucucaacauaacuaucggcccggguacuucacccagacagcuggaccuuggcaccucggcaagcuggagcuugauuuugaccugugcgaagggaccacaguuguggucgaugagcacugcggaaauagaggccccagccuccggaccacgacagugaccggcaaaaucauucaugaaugguguugccgcuccuguacacugccuccccugagauucaagggggaggacggaugcugguacggcauggagauccggccgguuaaagaaaaggaggaaaaccuugugaagagcauggucucugccggguccggagagguggacagcuuuucccucggccugcuguguaucucuauuaugaucgaagaggugaugagaagccgcuggucccggaaaaugcucaugaccgggacccuggucguuuuccuucugcucacacugggacagcugacguggaaugaucuuauuagacugugcaucauggugggcgccaacgcuucugacaauaugggcauggggaccacauaucucgcccugauggcgaccuuucgcaugagaccuauguucgcugugggacuccuguuucggcgccuuacaagcagagagguccugcuccugaccgugggccugucccuuguugccucuguggaacugcccaacagccucgaugagcugggggacggacucgccaugggcauuaugauccugaagcuucugacggauuuccaaucccaccagcucugggcuacacugcugagccuuaccuuugucaaaaccacacugucucuccauuacgccuggaagaccauggcgaugauucuguccaucgugagccuccugccccuuugucugucuacaacgucccagaaaaccacauggcugccuguucuccuggggagccuuggaugcaagccgcugaccauguuccucaucacagaaaacaagauuuggggccggaaaucuuggccccugaaugagggcaucauggcuguggggauugucuccauccuccugagcucccuucugaagaacgacgugccucuggccggaccccucauugccggcgggaugcugaucgcuuguuaugucaucagcggaucuagcgccgaucuuucccuggaaaaagcugccaaggugucuugggaggaggaagcggagcacagcggcgccucccauaauauucucguugaaauccaggacgaugggaccaugaaaauuaaggacgaggaacgcgaugacacgaucaccauucugcucaaagcuacacugcuugccaucucuggaguguacccuaugagcauccccgcuacccuguuugucuggcacuucuggcaaaagaagaaacagagauccggcgugcugugggauacaccuucucccccggagguugagaaggccgugcucgacgacggcauuuaucggauccugcagcgcgggcuucugggaagaagccaggucggcguggggguguuucaagaaggaguuuuccacaccauguggcaugucacacggggcgccgugcucauguaccaggggaaacgccuggagccuuccugggcuagcgugaagaaagaucucauuucuuauggaggcggcuggagauuccagggguccuggaacaugggagaagagguccaggugaucgcgguugagcccggcaagaauccuaagaacgugcaaacggcccccgggaccuuuaaaacaagcgaaggagaggucggcgcuauugcccuggacuucaagccggggaccucuggauccccuaucgugaaucgggaaggcaaaauuguuggccuuuacgggaacggaguggucaccacaagcggcacguacguguccgccaucgcucaggccaaggcgucucaggaggggccccugccugaaaucgaggaugagguuuuuagaaaacgcaaucugaccauuauggaccuccaccccggaagcggcaagacacggagauaucugcccgcuaucgugcgcgaagccauuaagcggaaacuuagaacccugguccucgccccuacacgcgugguggcuuccgagauggccgaagcgcugaaggggaugccgauccgguaccaaaccacggcugucaaaagcgagcauacaggcaaggaaauuguugaucugaugugccacgccaccuucaccaugagacuccuuucucccgugcgcgugccuaacuauaauaugaucaucauggacgaggcccauuuuacagaucccgcuuccauugccgcucggggauacaucagcaccagagucggcaugggggaggccgcggccauuuucaugacagcuaccccucccggaucuguggaagccuuuccucagagcaacgcuguuauccaggacgaggaaaaagauauuccggagcgguccuggaauucuggcuaugacuggaucacggauuuccccgggaagacagugugguuugucccuagcaucaaguccggaaacgacauugccaauugucugcgcaaaaacggcaagagagugauccagcugucucggaaaaccuucgacacagaauaccaaaagaccaaaaacaaugauugggacuauguugugacgaccgauauuagcgagaugggggccaacuuucgcgcugacagagucaucgauccccggagaugccucaagccugugauucugaaggacggccccgagcgcgucauccuugcgggaccgaugccugugacaguugccuccgcugcccagcggagaggccgcauugggcggaaucagaacaaagaaggagaucaguacaucuacaugggccaaccccugaauaacgacgaggaucacgcccacuggaccgaagcuaagaugcuccuggacaauaucaacacacccgaggggauuaucccugcccuguucgagcccgaaagagagaaaagcgcggcuauugauggagaauaucgccuccggggcgaggccagaaagaccuucguggaacuuaugcgcagaggggaccugccuguguggcugucuuacaaagucgccuccgagggcuuucaguauagcgaucggcgcuggugcuucgacggagagagaaauaaccagguucucgaagagaauauggacguggaaaucuggacaaaggagggcgaacggaaaaagcugcgcccgagauggcuugaugcucggaccuacuccgacccccuggcccucagagaguuuaaggaguucgcggccgggcgccggucugugagcggagaucugauucuggaaaucggcaaacucccucagcaucuuacgcaaagagcucagaacgcccuggacaaucuggucaugcuccacaacuccgagcaggggggaaaggcuuaucgccaugccauggaagagcugcccgauacaaucgaaaccauuaugcuucuggcucucaucgccgugcugaccggcggcguuacacuguuuuuccucucugggcggggacuuggcaaaaccagcauugggcugcugugugugacauccagcucugcgcuccuguggauggccuccgucgagccucacuggaucgcugccagcauuauccuugaguuuuuccugauggugcuccugauccccgaaccggacagacagcggacgccucaagauaaucagcuggcuuacgucgugauuggacuccuuuuuaugauccugaccguugccgccaacgagaugggccugcucgaaacaaccaagaaagaccuggggauuggacacacagcugcggagaaccaucaccaugccgcuaugcuugauguggaccugcaccccgccucugccuggacccucuaugcugucgccacgaccaucauuacaccuaugaugcgccauaccaucgagaauacaaccgcgaacauuucccugacggccaucgcuaaucaggccgcuauccugaugggccucgauaagggcuggcccauuagcaagauggacaucggggugccucuucuggcccugggaugcuacucucaaguuaacccccucacacugaccgcggccgugcuuaugcuggucgcucacuacgccauuaucggcccggggcuccaggcuaaagccacaagagaagcucagaagcggaccgccgcgggaauuaugaaaaauccuaccguggauggcaucguggccaucgaccuggaccccguugucuaugaugcuaaguucgagaaacagcuggggcaaauuaugcuccuuauccuguguacaagccagauucugcucaugcgcacgaccugggcccugugcgaauccaucacacuugcuaccggaccccugacaacccucugggagggcucuccuggcaaguuuuggaacacgacaauugccgugagcauggccaauaucuucagaggguccuaccuggcgggagcuggccuggccuuuagccucaugaagucccuugggggaggccggcgcgggaccggagcucagggcgaaacccugggcgagaaauggaagagacagcugaaccaacucucuaaaagccaguucaauacauauaagcgguccgggaucauugagguggaccgcucugaagccaaagagggacugaagagaggcgaaaccacaaagcacgccgucagccgggggacggcuaaacuuagaugguucguugagcgcaaccuggugaagccggaaggaaaagugaucgaucucggcugugggcggggaggcugguccuacuauugcgccggccugaagaaagucaccgaggugaagggguacacaaaaggaggccccgggcaugaggaaccuauucccauggcgaccuauggauggaaucugguuaagcuccacucuggcaaggacguguuuuucaucccucccgagaaaugugauacacuucugugcgacauuggggaaagcuccccuaacccgaccaucgaggaaggaagaacgcugcgcguccucaagaugguggagcccuggcugcggggcaaucaguuuuguauuaaaauccuuaacccuuacaugcccagcguuguggagacccuggaacagaugcaaagaaagcauggcgggaugcucguccgcaauccucugucucggaacuccacacacgagauguacugggugagcugcggaaccggcaauaucgugucugccgucaacaugacauccagaaugcugcucaaccgcuucaccauggcucaccggaaacccacauaugaaagagauguugaccugggggccggaacccgccauguggcuguggagccggaggucgccaaucuugauauuaucggccagcggauugaaaacaucaagaaugagcacaagagcacguggcauuacgacgaagauaacccuuauaaaacaugggcguaccacgggucuuaugaggugaagcccuccggaagcgccuccagcaugguuaauggcguggucagacugcucaccaaacccugggacgugauuccuaugguuacccagaucgcuaugacagacacgacccccuuuggccaacagcgcguguucaaggaaaaagucgauacaagaaccccuaaggccaagcgggggacagcucagaucauggaggugaccgccaaauggcuguggggauuucuuucucgcaacaagaaaccgagaauuuguacacgggaggaauucaccagaaagguucggagcaaugcugccaucggcgcgguguuugucgacgagaaccaguggaauuccgccaaagaagcuguggaggaugaacgcuucugggaccuggucagacgggagcgcgagcuccauaagcaagggaagugcgccacgugcguguacaacaugaugggaaaaagagaaaagaaacugggcgaguuugggaaggcuaaaggcucucgggccauuugguauauguggcugggagcccgcuuccucgaauuugaggcgcugggcuucaugaaugaagaucacugguucagcagagagaacucccuuucugggguugagggagaaggccugcacaagcucggguacauccugcgggacauuagcaaaauccccggaggcaauauguacgcugaugacaccgccgggugggauacacgcaucaccgaggaagaccuucagaacgaggccaagauuacagauaucauggagccugaacaugcucugcucgccaccuccauuuuuaagcugacguaucagaauaaaguggucagagugcagcggcccgcuaagaacggcacagugauggacguuaucucucgcagagaucaacggggaagcggccagguggggaccuacggacugaacacauucaccaauauggaggcccagcucauucgccagauggaauccgagggcaucuuuagcccuucugaacuggagacgcccaaccuugcggggagaguccuggacuggcucgagaaacacggaaucgaacggcugagacgcauggccauuuccggcgacgauugugugguuaagccgaucgacgaucgguucgcuaccgcccuuacagcucugaaugacauggggaaagugagaaaggauauuccucaaugggagcccagcaagggcuggaacgacuggcagcaggucccuuuuugcucucaucacuuccaccagcucaucaugaaagauggacgcgaaauugugguccccugucggaaucaagacgagcuggugggcagagcccgcguuucccagggggcgggauggagccugcgggaaaccgccugccucggcaaguccuaugcucagauguggcaacugauguacuuucauagacgcgaucuucggcuggccgcuaacgccaucuguucugcugugccugucgacugggugcccacaagcagaaccacaugguccauucacgcccaucaccaguggaugaccacggaggauaugcucagcguuuggaaucgcguguggaucgaggaaaacccguggauggaggacaaaacacaugucucuuccugggaagacgugccuuaucuggggaagcgggaggaucaguggugcggaagccuuaucggccugaccgcgagagccaccugggcuacaaauauucagguggccaucaaccaaguucggagacucauugggaaugaaaacuaccuggacuauaugaccucuaugaaacgcuucaagaaugagagcgaucccgagggcgcccugugguga

SEQ ID NO: 19443 - RNA, 9879 nt, Artificial Sequence
  derived and/or modified CDS sequence (opt5) from DENV-1__JQ915080__SS-prME
agcgugaccaugcugcucaugcugcuucccacaguccugacguuccaccucaccacaagaggcggggagccucauaugaucguuuccaagcaggaacggggaaaaucucugcuuuuuaagaccagcgccggcgugaacaugugcacacugauugcuauggaccucggggagcugugugaugacaccaugacauacaaaugcccgcgcaucaccgaaacggagcccgaugacguggauuguuggugcaaugccaccgaaacaugggucaccuauggaacauguucccaaaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagagcaggacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucaccccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacaaccggggccuccaccagccaagagacauggaaccgccaggaccuccuggucacguucaaaaccgcucacgccaagaagcaggaagugguugugcugggaucccaagagggcgccaugcacacagcucucaccggggcgacagaaauccagaccucuggaacgacaaccauuuuugccggccaucugaaaugcagacuuaagauggauaaacugacccucaaggggaucagcuaugucauguguacaggcuccuucaaacuggagaaggaaguggcugagacccagcacggaacaguucuggugcaggucaaguacgagggcacggacgccccgugcaaaaucccuuucagcucucaagaugaaaagggggugacccagaauggacggcuugugacagccaaccccauuguuaccgacaaagagagaccugucaauaucgaagcugagccccccuuuggcgaguccuauauuguggugggggccggagaaaaggcgcucaaacugagcugguucaagaagggcucuagcaucgggaaaauguuugaggcuacagcccgcggcgcccggagaauggcuauucugggagauaccgccugggacuucggcuccaucgggggagucuuuacgucugugggcaagcucguucaucagaucuucgggaccgcuuacggagugcuguuuagcggcgucuccuggacaaugaaaauugggaucggcauucuucugaccuggcucggacugaacagccgcucuacaucccugagcaugaccuguaucgccgugggcaugguuacacuuuaccucggggugaugguccaggcggauucuggaugcgugauuaauuggaagggccgggaacugaaauguggguccggaaucuucguuaccaacgaggugcacacguggacagaacaauauaaguuucaggccgacagcccuaagagacuguccgcugccauuggcaaagcuugggaggagggggucugcggcauccgcucugccacccggcucgaaaacaucauguggaagcagauuagcaaugagcugaaccauauccuucuggaaaaugacaugaaauucaccgugguggucggagauguuuccggcauucucgcgcaggggaagaaaacaaucagaccgcaacccauggagcacaaguacucuuggaaaagcuggggaaaggccaagauuaucggcgcugacgugcagaacaccacguuuaucauugaugggccuaauacacccgaauguccugacgaucagcgcgccuggaacaucugggagguggaggacuauggauucggcauuuuuaccacaaauaucuggcugaaacugcgggauuccuacacccaggucugcgaccacagacuuaugagcgcugccauuaaggauucuaaagccgugcaugcugacaugggcuauuggaucgaauccgagaagaacgaaacauggaaacucgcgcgcgccagcuucaucgagguuaagaccuguguguggcccaagucucacacgcugugguccaaugggguccuggaaagcgagauggugauuccgaaaaucuacggaggcccuauuucucaacauaacuaucggcccggguacuucacccagacagcuggaccuuggcaccucggcaagcuggagcuugauuuugaccugugcgaagggaccacaguuguggucgaugagcacugcggaaauagaggccccagccuccggaccacgacagugaccggcaaaaucauucaugaaugguguugccgcuccuguacacugccuccccugagauucaagggggaggacggaugcugguacggcauggagauccggccgguuaaagaaaaggaggaaaaccuugugaagagcauggucucugccggguccggagagguggacagcuuuucccucggccugcuguguaucucuauuaugaucgaagaggugaugagaagccgcuggucccggaaaaugcucaugaccgggacccuggucguuuuccuucugcucacacugggacagcugacguggaaugaucuuauuagacugugcaucauggugggcgccaacgcuucugacaauaugggcauggggaccacauaucucgcccugauggcgaccuuucgcaugagaccuauguucgcugugggacuccuguuucggcgccuuacaagcagagagguccugcuccugaccgugggccugucccuuguugccucuguggaacugcccaacagccucgaugagcugggggacggacucgccaugggcauuaugauccugaagcuucugacggauuuccaaucccaccagcucugggcuacacugcugagccuuaccuuugucaaaaccacacugucucuccauuacgccuggaagaccauggcgaugauucuguccaucgugagccuccugccccuuugucugucuacaacgucccagaaaaccacauggcugccuguucuccuggggagccuuggaugcaagccgcugaccauguuccucaucacagaaaacaagauuuggggccggaaaucuuggccccugaaugagggcaucauggcuguggggauugucuccauccuccugagcucccuucugaagaacgacgugccucuggccggaccccucauugccggcgggaugcugaucgcuuguuaugucaucagcggaucuagcgccgaucuuucccuggaaaaagcugccaaggugucuugggaggaggaagcggagcacagcggcgccucccauaauauucucguugaaauccaggacgaugggaccaugaaaauuaaggacgaggaacgcgaugacacgaucaccauucugcucaaagcuacacugcuugccaucucuggaguguacccuaugagcauccccgcuacccuguuugucuggcacuucuggcaaaagaagaaacagagauccggcgugcugugggauacaccuucucccccggagguugagaaggccgugcucgacgacggcauuuaucggauccugcagcgcgggcuucugggaagaagccaggucggcguggggguguuucaagaaggaguuuuccacaccauguggcaugucacacggggcgccgugcucauguaccaggggaaacgccuggagccuuccugggcuagcgugaagaaagaucucauuucuuauggaggcggcuggagauuccagggguccuggaacaugggagaagagguccaggugaucgcgguugagcccggcaagaauccuaagaacgugcaaacggcccccgggaccuuuaaaacaagcgaaggagaggucggcgcuauugcccuggacuucaagccggggaccucuggauccccuaucgugaaucgggaaggcaaaauuguuggccuuuacgggaacggaguggucaccacaagcggcacguacguguccgccaucgcucaggccaaggcgucucaggaggggccccugccugaaaucgaggaugagguuuuuagaaaacgcaaucugaccauuauggaccuccaccccggaagcggcaagacacggagauaucugcccgcuaucgugcgcgaagccauuaagcggaaacuuagaacccugguccucgccccuacacgcgugguggcuuccgagauggccgaagcgcugaaggggaugccgauccgguaccaaaccacggcugucaaaagcgagcauacaggcaaggaaauuguugaucugaugugccacgccaccuucaccaugagacuccuuucucccgugcgcgugccuaacuauaauaugaucaucauggacgaggcccauuuuacagaucccgcuuccauugccgcucggggauacaucagcaccagagucggcaugggggaggccgcggccauuuucaugacagcuaccccucccggaucuguggaagccuuuccucagagcaacgcuguuauccaggacgaggaaaaagauauuccggagcgguccuggaauucuggcuaugacuggaucacggauuuccccgggaagacagugugguuugucccuagcaucaaguccggaaacgacauugccaauugucugcgcaaaaacggcaagagagugauccagcugucucggaaaaccuucgacacagaauaccaaaagaccaaaaacaaugauugggacuauguugugacgaccgauauuagcgagaugggggccaacuuucgcgcugacagagucaucgauccccggagaugccucaagccugugauucugaaggacggccccgagcgcgucauccuugcgggaccgaugccugugacaguugccuccgcugcccagcggagaggccgcauugggcggaaucagaacaaagaaggagaucaguacaucuacaugggccaaccccugaauaacgacgaggaucacgcccacuggaccgaagcuaagaugcuccuggacaauaucaacacacccgaggggauuaucccugcccuguucgagcccgaaagagagaaaagcgcggcuauugauggagaauaucgccuccggggcgaggccagaaagaccuucguggaacuuaugcgcagaggggaccugccuguguggcugucuuacaaagucgccuccgagggcuuucaguauagcgaucggcgcuggugcuucgacggagagagaaauaaccagguucucgaagagaauauggacguggaaaucuggacaaaggagggcgaacggaaaaagcugcgcccgagauggcuugaugcucggaccuacuccgacccccuggcccucagagaguuuaaggaguucgcggccgggcgccggucugugagcggagaucugauucuggaaaucggcaaacucccucagcaucuuacgcaaagagcucagaacgcccuggacaaucuggucaugcuccacaacuccgagcaggggggaaaggcuuaucgccaugccauggaagagcugcccgauacaaucgaaaccauuaugcuucuggcucucaucgccgugcugaccggcggcguuacacuguuuuuccucucugggcggggacuuggcaaaaccagcauugggcugcugugugugacauccagcucugcgcuccuguggauggccuccgucgagccucacuggaucgcugccagcauuauccuugaguuuuuccugauggugcuccugauccccgaaccggacagacagcggacgccucaagauaaucagcuggcuuacgucgugauuggacuccuuuuuaucauucugaccguugccgccaacgagaugggccugcucgaaacaaccaagaaagaccuggggaucggacacacagcugcggagaaccaucaccaugccgcuaugcuugauguggaccugcaccccgccucugccuggacccucuaugcugucgccacgaccauuaucacaccuaugaugcgccauaccauugagaauacaaccgcgaacaucucccugacggccaucgcuaaucaggccgcuauucugaugggccucgauaagggcuggcccaucagcaagauggacauuggggugccucuucuggcccugggaugcuacucucaaguuaacccccucacacugaccgcggccgugcuuaugcuggucgcucacuacgccaucauuggcccggggcuccaggcuaaagccacaagagaagcucagaagcggaccgccgcgggaaucaugaaaaauccuaccguggauggcaucguggccauugaccuggaccccguugucuaugaugcuaaguucgagaaacagcuggggcaaaucaugcuccuuauucuguguacaagccagauccugcucaugcgcacgaccugggcccugugcgaauccauuacacuugcuaccggaccccugacaacccucugggagggcucuccuggcaaguuuuggaacacgacaaucgccgugagcauggccaauaucuucagaggguccuaccuggcgggagcuggccuggccuuuagccucaugaagucccuugggggaggccggcgcgggaccggagcucagggcgaaacccugggcgagaaauggaagagacagcugaaccaacucucuaaaagccaguucaauacauauaagcgguccgggauuaucgagguggaccgcucugaagccaaagagggacugaagagaggcgaaaccacaaagcacgccgucagccgggggacggcuaaacuuagaugguucguugagcgcaaccuggugaagccggaaggaaaagugauugaucucggcugugggcggggaggcugguccuacuauugcgccggccugaagaaagucaccgaggugaagggguacacaaaaggaggccccgggcaugaggaaccuauccccauggcgaccuauggauggaaucugguuaagcuccacucuggcaaggacguguuuuucauuccucccgagaaaugugauacacuucugugcgacaucggggaaagcuccccuaacccgaccauugaggaaggaagaacgcugcgcguccucaagaugguggagcccuggcugcggggcaaucaguuuuguaucaaaauccuuaacccuuacaugcccagcguuguggagacccuggaacagaugcaaagaaagcauggcgggaugcucguccgcaauccucugucucggaacuccacacacgagauguacugggugagcugcggaaccggcaauauugugucugccgucaacaugacauccagaaugcugcucaaccgcuucaccauggcucaccggaaacccacauaugaaagagauguugaccugggggccggaacccgccauguggcuguggagccggaggucgccaaucuugauaucauuggccagcggaucgaaaacauuaagaaugagcacaagagcacguggcauuacgacgaagauaacccuuauaaaacaugggcguaccacgggucuuaugaggugaagcccuccggaagcgccuccagcaugguuaauggcguggucagacugcucaccaaacccugggacgugaucccuaugguuacccagaucgcuaugacagacacgacccccuuuggccaacagcgcguguucaaggaaaaagucgauacaagaaccccuaaggccaagcgggggacagcucagauuauggaggugaccgccaaauggcuguggggauuucuuucucgcaacaagaaaccgagaaucuguacacgggaggaauucaccagaaagguucggagcaaugcugccauuggcgcgguguuugucgacgagaaccaguggaauuccgccaaagaagcuguggaggaugaacgcuucugggaccuggucagacgggagcgcgagcuccauaagcaagggaagugcgccacgugcguguacaacaugaugggaaaaagagaaaagaaacugggcgaguuugggaaggcuaaaggcucucgggccaucugguauauguggcugggagcccgcuuccucgaauuugaggcgcugggcuucaugaaugaagaucacugguucagcagagagaacucccuuucugggguugagggagaaggccugcacaagcucggguacauucugcgggacaucagcaaaauccccggaggcaauauguacgcugaugacaccgccgggugggauacacgcauuaccgaggaagaccuucagaacgaggccaagaucacagauauuauggagccugaacaugcucugcucgccaccuccaucuuuaagcugacguaucagaauaaaguggucagagugcagcggcccgcuaagaacggcacagugauggacguuauuucucgcagagaucaacggggaagcggccagguggggaccuacggacugaacacauucaccaauauggaggcccagcucauccgccagauggaauccgagggcaucuuuagcccuucugaacuggagacgcccaaccuugcggggagaguccuggacuggcucgagaaacacggaauugaacggcugagacgcauggccaucuccggcgacgauugugugguuaagccgauugacgaucgguucgcuaccgcccuuacagcucugaaugacauggggaaagugagaaaggauaucccucaaugggagcccagcaagggcuggaacgacuggcagcaggucccuuuuugcucucaucacuuccaccagcucauuaugaaagauggacgcgaaaucgugguccccugucggaaucaagacgagcuggugggcagagcccgcguuucccagggggcgggauggagccugcgggaaaccgccugccucggcaaguccuaugcucagauguggcaacugauguacuuucauagacgcgaucuucggcuggccgcuaacgccauuuguucugcugugccugucgacugggugcccacaagcagaaccacaugguccauccacgcccaucaccaguggaugaccacggaggauaugcucagcguuuggaaucgcguguggaucgaggaaaacccguggauggaggacaaaacacaugucucuuccugggaagacgugccuuaucuggggaagcgggaggaucaguggugcggaagccuuauuggccugaccgcgagagccaccugggcuacaaauauccagguggccauuaaccaaguucggagacucaucgggaaugaaaacuaccuggacuauaugaccucuaugaaacgcuucaagaaugagagcgaucccgagggcgcccugugguga

SEQ ID NO: 19444 - RNA, 9879 nt, Artificial Sequence
  derived and/or modified CDS sequence (opt5) from DENV-1__KJ755855__SS-prME
agcgugaccaugcugcuuaugcugaugcccaccgcccuugcuuuccaccugacgaccagaggaggggaaccucauaugaucguguccaagcaggaacggggaaagucucuccuguuuaagacaagcgccggcguuaacaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagagccgaaaccuggaugagcuccgagggcgcuuggaaacagauucagcggguugaaacgugggcccugcgccaccccggcuucacagugaucgcgcuuuuucuggcccaugcuauugggaccucuaucacacagaagggaaucauuuucauccuccugaugcuugucaccccuagcauggccaugagaugcgugggcauugggucccgggauuuuguugagggacugagcggcgcuaccuggguggacgucgagcucgaacacgggucuugugugacaacgauggccaaggauaaacccacccuggacaucgagcugcucaagacagaagugaccaacccugcgguccugcgcaaacuuugcauugaggccaagaucuccaauacaaccacggauagcagauguccgacacaaggagaagcuacccugguugaggagcaggacgccaacuucgugugccggcgcaccuuuguggauagaggcuggggcaaugggugugaacucuucggaaaaggcucucugcuuacaugcgcuaaguuuaagugcgucaccaaacuggaggggaagauugugcaguacgaaaaccucaaauauuccguuaucgugacaguccacaucgccgcccagcaucaagugggaaaugagagcacggaacacggcaccacagcuauuaucacaccccaggcgccuacaaccgagauucagcugacggacuacggggcccugacccucgacuguucuccccggacaggacuggauuucaacgagaugguucuucugaccaugaaggaaaaauccuggcucgugcauaagcagugguuucuggaccuuccucugcccuggacaagcggcgcuuccaccucucaagagacguggaaucgccucuuccugcuggucacauuuaaaaccgcccacgccaagaagcaggaaguggucgugcucggcagccaggagggggcuaugcacacagcccugaccggagcgaccgcccuucagacauucggcacgaccacaaucuucgcugggcaucugaacauuagacucaaaauggauaagcugacccugaaaggaauguccuauguuaugugcacaggcagcuuuaaacuugaaaaagagguggccgagacccagcacgggacgauccucguccagaucaaguacgaaggcacagacgcuccguguaagauuccuuucucuacccaggaugagaaaggagugacccaaaauggccggcugaucacagccaaccccauuguuaccgacaaggaaaaaccugugaauaucgaggcugagccgcccuuuggggaauccuauauugucaucggagccggcgagaaggcgcugaaacucagcugguucaagaaggggucuagcaucggaaaaauguuugaagccacagcuagaggcgcccgccggauggcuauucugggggauacggccugggacuucggcuccaucggaggcguguuuaccucuguggggaaacuuguucaucagauuuucggaacagcguacggcguccuguuuagcgggguguccuggaccaugaaaaucggaauuggcgugcuccugacauggcuggggcuuaacagcagaucuaccucccucagcaugacgugcaucgccgucggccuggugacccuguaccucggaguuauggugcaggcugauucuggcugugucauuaauuggaaggggcgcgagcugaaaugcggauccggcaucuucgugacaaacgaaguucacaccuggacagagcaguauaaguuucaagccgacagcccuaagcggcuuuccgcugccaucgggaaagccugggaggaaggaguguguggcauuagaucugcuacccgccuggagaacaucauguggaagcagauuagcaaugaacucaaccauauccugcuggagaaugaucuuaaauucacagucgugguuggggacguggcgggcauucucgcccagggaaagaaaaugauccggccgcagcccauggaacacaaguacuccuggaaaaacuggggcaaggcuaagaucauuggggccgacguccaaaauucuaccuuuaucauugauggaccuaacacgcccgagugcagcgacgaucagagagccuggaauaucugggagguggaagacuauggcuucgggauuuucacaaccaacaucuggcugaaacugcgcgauuccuacacccaggugugugaccaccggcucaugagcgcugccaucaaggauucuaaagcgguccaugcugacaugggauauuggauugaguccgaaaagaaugagacauggaaacuggccagagccagcuuuaucgaaguuaagaccugcacguggccuaagucucacacacuuugguccaacggcgugcuggagagcgagaugauuauccccaaaauuuacggcgggccgaucucucagcauaauuauagcccuggauacuucacccaaacagcuggccccuggcaccucgggaagcuggaacuggauuuugaccuuugugagggaaccacaguggucguggaugaacacugcggcaaccgcgggccuucccuccggaccacgaccguuacaggaaaaaucauucaugaguggugcuguagaagcugcacccugcccccucugcgguuccgcggcgaggacggcuguugguacgggauggaaaucagacccgugaaggagaaagaagagaaucucgucaagucuaugguguccgccggaagcggcgaaguugugucccugucucuugggcugcucugcauuagcaucaugauugaggaggucaugcgguccagauggucucgcaagaugcugaugacaggaacccuggcgguguuuuuccggaaaaucagaggccagcuuacguggaacgaucugauucgccucuguaucaugguuggggcuaaugccagcgacagaaugggaacacggaccacauaucuggcccucauggcuaccuuuaagaugcgcccgauguucuccgugggccugcuuuuuagacggcugaccucucgcgaaguccuccugcugacaaucggccuuagccugguggccuccguggagcucccuaacagccuggaagaacucgggguccugcuugcuaugggaauuaugauccugacgcuccugaccgacuuccagucucaccaacugugggccacacuucuguccaugaccuuuauuaaaacaaccuucagccuccauuacacguggaagacaauggcgaugguucugucuaucgugucccucuuuccccugugccuuagcaccaccucucagaaaacaaccuggcugcccgugcugcucggcucccugggguguaagccucuuacaauguuccugauugccgaaaacaagaucuggggaagaaaaagcuggccgcucaaugagggcaucauggcugucgggauuguguccauccugcucagcucucugcuuaagaacgauguuccccuggccggaccucugauugcuggcggcaugcucaucgccugcuaugugauuagcggguccucugccgaccugagccuugagaaagcugcggaagucuccugggaggaagaggccgaacacucuggagcuagccauaauauccugguggagguucaggaugacggcacgaugaagaucaaagaugaggaacgggacgauacccucacaauucugcucaaggccacccugcuugccguguccggggucuacccccugucuaucccugcuacacuguucgugugguauuuuuggcagaaaaagaagcaacgcagcggaguccucugggacacccccuccccucccaaaguggagaaggccguucuggaugacggcauuuacagaaucaugcagcgggggcuucugggacgcagccaggugggcgucggcguguuccaggaaaacguuuuucacacgauguggcacgugaccagaggggcgguccucauguaucaaggaaaacggcuggagccgucuuggggcagagugaagaaagaucucauuuccuacgggggaggcugggggcugaagggaagcuggaauacaggcgaggaagugcagguuaucgcugucgagccuggcaagaaccccaaaaaugugcagaccgccccugggacauucaagacccccgaaggagaggugggcgccauugcucuugacuuuaaaccggggacaucuggauccccuaucgucaaccgcgaaggcaagaucguggggcuguacggaaauggcguugugacgaccagcggcacauaugucuccgccauugcgcaugcuaaagccucucaggaggggccccugccugagaccgaaguggaggccuuccggaagagaaaccucaccaucauggaucugcaccccggaagcggcaagacacgccgguaccuucccgcuauuguuagagaagccaucaaacgcaagaugcggacgcugauucucgcuccuaccagaguggucgccuccgagauggcggaagcccugaaagggaugccgauccgcuaucaaacaaccgcugucaagagcgagcauacaggaaaagagaucguugaccugaugugucacgccaccuuuacgaugcggcuccuuucucccgugagagucccuaauuacaacaugauuaucauggacgaagcucauuucacagaucccuccagccuggccgcccggggcuauauuucuacccgcguggggaugggcgaggcugcggccaucuuuaugaccgcuacaccucccggaagcguggaagccuucccucaguccaaugccgucauucaggacgaggaaagagauaucccggagcggucuuggaacagcggcuacgaguggaucaccgacuuucccgggaagacaguuugguucgugccuuccauuaaggcuggaaaugauaucgccaacugccugcgcaaaaacggcaagagagugauucaacucucucggaaaaccuucgacacggaauaucagaagaccaagaauaacgauugggacuacgucgugaccacagauaucagcgagaugggggcgaauuuucccgcugacagaguuauugauccucgccggugucugaaccccgugauccuuaaggacggaccggaaagagucauucuggccggcccuaugcccgugaccguugccuccgcuaaucagcgccgggggagaaucggccgcaaccacaauaaggagggagaccaguacaucuauaugggccaaccccucaacaaugaugaggaccacgcccauuggacggaagcgaaaaugcugcuggauaacauuaauaccccugaggggaucauucccgcccucuucgaaccugagcgggaaaagagcgcugccaucgacggagaguacagacuucgcggcgaggcuagaaaaacauuuguggaacugaugcggcgcggggaucugccggucuggcucucuuauaagguggccuccgagggauuccaguacagcgacagacgguggugcuuugauggcgaacgcaacaaucagguccuggaggaaaacauggacguggagauuuggaccaaagagggggaaagaaagaaacuucggcccagauggcuggaugcucgcacauauuccgacccucucgcccugcgggagaagaaggaguucgcggccggcagacgcucuguuagcggagaucugauccucgagaucggcaaacuuccccagcaccugacccaacgggcucagaaugcccuggacaaccucgugaugcugcauaacuccgaacaagggggcagagcuuaccggcacgccauggaggagcuuccugauacaauugaaacccugaugcuccuggcccugaucgcugugcucacgggcggggucacacucuuuuuccugucuggaaagggccugggcaaagcggggaauggacuccugugcguuauggccagcuccgcccuucuguggauggccaacguggagccccacuggauugccgcuagcaucauucucgaauuuuuccugauggugcugcucaucccggagccugaccgccagagaacaccccaagacaaucagcuugccuaugucgugauccggcugcuguuuaugauucucaccguugcggccaacgagaugggccugcuugaaacaaccaagaaagaucuggggaucggacaugcugccguggagaaucaccaucacgcugccaugcucgacauugaucugcauccugcgucugccuggacacuguacgcugucgccacgaccaucauuacacccaugaugcgccacaccaucgaaaacacaaccgcuaauauuucccucacggccaucgcuaaccaggccgcgauccuuaugggccuggacaagggguggccuauuagcaagauggauaucggagugccccugcucgcccugggcuuccuuucucaggucaauccgcugacccucacagcugccgugcugaugcugguugcucacuacgccauuaucggcccugggcuccaagccaaagcgaccagagaggcucagaagcggacagccgcuggaauuaugaaaaaccccaccaucgacggcaucguggccauugaucuugaccccgucguguaugaugccaaguuugaaaaacagcuggggcaaaucaugcugcucauucuguguacgucccagauccuucugaugcgcacaaccugggcucucugcgagagcauuacacuggccaccggaccucugucuccgcucugggagggcagccccgggaaguccuggaauaccacaaucgcgguuucuauggccaacaucuucagaggaagcuaccuugcuggcgccggccuggcuuucucccugaugaaaagccucgggggaggccggcgcgggacgggagcccagggcgaaacccugggggagaaauggaagagacagcuuaaucaacuguccaaaacagaauuuaacaccuauaagcggucuggaauuauggagguggacagaagcgaagcgaaagagggccucaagcgcggcgagacaaccaagcaugccgucucccgggggacggcuaaacugagaugguucguggaacgcaaucuggugaagccugagggaaaaguuaucgaucucggcugugggcggggaggcuggucuuacuauugcgccgggcuuaagaaagucagcgaagugagaggauacacaaagggcggccccgggcacgaggaaccuauucccauggcuaccuauggaugggaccugcugaaacgcuguuccggcaaggaguuuuucuuuaucccuccggagaagugcgauucuuuccucggggacauuggagaaagcucccccaacccuaccaucgaggaaggccggacagugagaguccugaaaaugguugagcccuggcuucgcgggaaucaguuuuguauuaagauccugaacccuuacaugcccagcgugguggagacccucgaacagaugcagcggaaacauggaggcaugcuggucagaaacccgcugucucgcaauuccacacacgagauguacugggugagcugcggcacggggaacaucguuucugccgugaauaugaccucccggaugcuccugaacagauucacaauggcucaccgcaagccuaccuaugaaagagacgucgaucuuggagccggcacacggcauguggcgguugagcccgaaguggccaaucuggacauuaucgggcaacgcauugagaacaucaaacacgagcauaagagcaccuggcacuacgaugaagacaaucccuauaagacgugggcuuaccauggaucuuaugaggucaaaccuuccggcagcgccuccagcauggugaacgggguggucaagcuccugaccaaacccugggauguuauuccuauggugacacagaucgcuaugaccgacacaaccccguuuggacagcagagaguguucaaggaaaaagucgauacacggacccccaaggccaagagaggcacggcccaaaucauggaggugacagcgcgguggcuuuggucuuuucugagccgcaauaaaaagccuagaauuuguacccgggaagaguucacccgcaaaguuagauccaacgcugccaucggcgccguguuugucgacgagaaucaguggaacucugcuaaggaagccguggaggaugaccgguucugggaucucguucaccgcgaaagagagcugcacaaacaggggaagugcgcuacauguguguacaauaugaugggaaagcgggagaagaagcugggcgaguucgggaaagccaagggaagccgcgcgauuugguauauguggcucggcgccagauuucuggaguucgaagcucuuggguuuaugaacgaggaccauugguucucccgggaaaauucucugagcggcgucgagggagagggccuccacaaacugggguacauccuucgcgacauuuccaagauccccggaggcaacauguacgccgaugacacggcugggugggauaccagaaucacagaagacgaucugcaaaacgaggccaaaauuaccgacaucauggaaccugagcaugcgcuccuggccaagucuauuuuuaagcugacauaucagaauaaagugguucgggugcagcgccccgcuaagaacggaaccgucauggaugugaucagcagacgggaccagagaggcuccgggcaagucggcacauacggacucaauaccuucacgaacauggaagcccagcugauucgccagauggagagcgaggaaaucuuuucuccgaaugagcuugaaaccccuaaccuggcugagcgggugcucgauuggcuggaaaaauauggcguugagagacuuaagcgcauggccaucuccggggacgauugcguggucaaacccauugacgaucgguucgcuacagcccugaccgcgcucaaugacaugggaaaggugagaaaggacaucccucagugggagcccagcaaaggcuggaacgauuggcaacaggugccuuuuugcucucaccacuuccaucagcugguuaugaaggacgggcgcgaaauugugguccccugucggaaucaggaugagcuggugggcagagcucgcguuucccaaggagcuggguggagccuccgggaaacagccugccugggcaaauccuacgcccagauguggcagcuuauguauuuucacagacgcgaccugcggcucgcugccaacgcgaucuguucugcugugccggucgauugggugccuaccagcagaacgacaugguccauucaugcccaccaucaguggaugaccacagaggacaugcugagcgucuggaaucggguguggaucgaagagaaccccuggauggaggauaagaccagaguuucuuccugggaagacgugcccuaccuuggaaaacgcgaggaucaauggugcggcagccugauugggcucacggcccgggcuaccugggccacaaauauccaggucgcuaucaaccaggugagacgccugauuggaaaugaaaacuauucugacuacaugaccagcaugaagagauucaagaacgaguccgagccugaaggcgcccugugguga

SEQ ID NO: 19445 - RNA, 9879 nt, Artificial Sequence
  derived and/or modified CDS sequence (opt5) from DENV-1__KF289073__SS-prME
agcgugaccaugcuguucaugcuccugcccacagcccuugcuuuucaccugacgaccagaggcggggagccucauaugaucgucuccaagcaggaacggggaaagucucuccuguucaagaccagcgccggcguuaacaugugcacccuuauugcgauggaccugggggagcucugugaagauaccaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagaagguugaaacaugggcucugcggcaccccggcuuuaccgugaucgcccuuuuccuggcgcaugccauugggacaucuaucacccagaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaaaaauaagcccacacuggauaucgaacugcucaaaaccgaggucacaaacccugccguucugcggaaacuuugcauugaagcgaaaaucucuaagaccacgacagacucccgcuguccgacccaaggagaggccacccugguggaggaacaggaugcuaauuuugugugcagacggacauucgucgaccgcggcuggggcaacggguguggacucuuuggcaaggggagccugcuuaccugcgccaaauucaagugcgugacaaaacuggagggaaagauuguucaguacgaaaaucucaaauauucugugaucgucacggugcacaccggcgaucagcaucaaguugggaacgagacaaccgaacacggaacaaucgcuaccauuacgccccaggccccuaccuccgagauccagcugacagacuacggcgcccugacccucgacuguagccccagaacaggccuggauuuuaaugaaauggugcuucugaccaugaaggagaaaucuuggcucguccauaagcagugguuccuggaccuuccucugcccuggacguccggggcuagcacaucccaagagaccuggaaccggcaggaucuccuggugacauuuaagaccgcgcacgccaaaaagcaggaagucgugguucugggaucucaagagggcgcuaugcacaccgcccucacaggggccacggaaauucagaccagcggaacaaccacaaucuucgcuggccaucugaaaugccgccuuaagauggacaaacugacccucaaggggauguccuaugugauguguacgggcagcuucaagcuggagaaagaagucgccgagacacagcacggaaccgugcugguucaggugaaguacgagggcaccgaugcgccgugcaaaauuccuaucucuacacaagacgaaaagggggucacccagaauggaagacuuaucacagcuaaccccauugugacggauaaagagaagccugugaauaucgaaaccgagccgcccuuuggcgaguccuauauuguuaucggggccggagaaaaggcccucaaacugagcugguucaagaaaggcucuagcauugggaagauguuugaggcuacagcccggggcgcuagacgcauggccauccugggagacaccgcgugggauuucggcuccaucgggggagucuuuacaucugugggcaaacucgugcaucaggucuucgggaccgccuacggagugcuguuuagcggcguuuccuggacgaugaagauugggaucggcgugcuucugaccuggcucggacugaacagccggucuacaucccugagcaugaccuguauugcugucggcauggugacacuuuaccucgggguuauggugcaggccgacucuggaugcgucaucaauuggaagggcagagaacugaaauguggguccggaauuuucgugaccaacgagguucacacauggaccgaacaauauaaguuucaggcugauagcccuaaacgccuguccgccgcgaucggcaaggccugggaggagggggugugcggcauucggucugcuacgagacucgaaaacaucauguggaaacagaucagcaaugagcugaaccauauucuucuggaaaaugacaugaaguucacagucguggugggagacgccaacggcauccucgcucaggggaaaaagaugauucgcccgcaacccauggagcacaaguacuccuggaaaucuuggggaaaggccaaaaucauuggcgccgauauccagaauaccaccuuuaucauugacgggccugauacacccgaauguccugacgaucaccgggcuuggaacaucugggaggucgaggacuauggauucggcauuuuuaccacgaauaucuggcugaagcugagagauagcuacacacagaugugcgaccaucgccuuauguccgcggccauuaaagauagcaaggcuguucacgccgacaugggcuauuggaucgaaucugagaagaacgaaaccuggaaacucgcccgggcuuccuucaucgaggugaagacauguauuuggcccaaaagccauacccuguggucuaauggggugcuggaauccgagaugaucauuccgaagaucuacggaggcccuauuagccagcacaacuauagacccggguacuucacacaaaccgccggaccuuggcaccucggcaaacuggagcuugauuuugaccugugcgaagggacgaccgucgugguugaugagcauugcggaaaucgcggccccucucuccggacaaccacagugaccggcaagaucauccacgaaugguguugcagaagcuguacgcugccuccccugcgguucaagggggaggacggaugcugguacggcauggagauucgcccggucaaagaaaaggaggaaaaccuugugagauccaugguuagcgcggggucuggagagguggacuccuuuagccucggccugcugugugucuccaucaugauugaagaggugaugcggucuagauggagccgcaaaaugcucaugacagggacccuggcuguuuuccuucugcucaucaugggacagcugacauggaaugaucugauucggcuuugcaucauggugggcgccaacgccuccgacagaaugggcauggggaccaccuaucuggcucucauggccacauuuaagaugcgcccuauguucgcggucggacugcucuuuagacggcugacgucucgcgaggugcuucugcucaccauuggccugagccugguggcuuccgucgaacuucccaauucucuggaggaacucggggauggacuggccaugggcaucaugaugcucaaacugcuuacagacuuccagagccaucaacuguggaccacacuccugucccugaccuuuaucaagacgacacuuagccuggauuacgccuggaagaccauggcuaugguucucucuauugugucccuguucccccucugucugagcaccacaucucagaaaaccacauggcuuccugugcugcugggguccuuuggaugcaagccgcucacgauguuccugaucaccgagaacaaaauuuggggcagaaagagcuggccccuuaacgaaggcaucauggccgucgggauugugucuauccugcucuccagccugcucaaaaaugacguuccucuggcuggaccccuuaucgccggcgggaugcugauugcguguuaugugaucuccggaagcucugccgaucugagccucgagaaggcugccgaggucuccugggaagaggaagcugagcacucuggcgccagccauaacauucugguggaaguucaggacgaugggacaaugaaaaucaaggacgaggagcgggaugacacccuuacaauucugcucaaggccacccugcucgcuguguccggagucuacccuaugucuauccccgcgacgcuguuugugugguauuucuggcagaaaaagaaacaacgcagcggcguccuuugggauaccccuagcccucccgaaguggagagagccguucuggacgacggcaucuaccggauucugcagcgcgggcuccugggaagaucucaggugggcgucgggguguuccaggauggaguuuuucacacaauguggcacgugacccggggcgcuguccuuauguaucaagggaagcgccuggaacccagcugggccuccgugaaaaaggaccucaucagcuacggaggcggcuggagauuccaggggucuuggaauaugggagaggaggugcagguuauugccgucgaacccggcaagaacccuaaaaaugugcagacaacccccgggacauuuaagacgccggagggagaagugggcgcuaucgcccuggauuucaaaccugggaccuccggaagccccauugucaaccgggagggcaagaucgugggccucuacgggaauggaguugugacaaccucuggcaccuaugucuccgcgauugcucaagccaaagccagccaggaagggccucugcccgagaucgaggacgaaguguuuagaaagcgcaaccuuacaaucauggaucugcaucccggauccggcaagacgcggagauaccugccugcuauuguucgcgaggccaucaaacggaagcucagaacccugauucuugcgccgacacgcguggucgcuucugaaauggccgaggcccugaaagggaugcccauccgguaucagaccacagcugugaaguccgaacacaccggcagagagauuguugaccucaugugccaugccacguucacaaugcgccugcuguccccugugcggguccccaauuacaacaugaucaucauggaugaggcucacuuuaccgacccugccagcauugcggccagaggauauaucucuacccgggugggcaugggggaagcugccgcuauuuucaugacagccacacccccuggauccguggaggccuuuccgcaaagcaaugcugucauccaggaugaagaaagagacauucccgaaagaucuuggaacagcggcuacgauuggaucacagacuucccugggaaaaccguuugguuugugcccuccaucaagucuggaaaugacauugcgaacugucuccggaagaauggcaaacgcgugauccagcuuagcagaaagacguucgauacagaguaucagaaaaccaagaacaacgacugggauuacgucgugacaaccgacauuuccgagaugggggccaauuuccgggcugauagaguuaucgacccucgccggugccugaaacccgugauucugaaggauggcccggaaagagucauccucgccggaccuaugcccgugacgguugccucugcugcccaacgccggggcagaauugggcgcaaccagaauaaggagggagaccaguacguguauaugggccagccccugaacaaugaugaagaccaugcgcacuggaccgaggcuaaaaugcuucuggauaacaucaauacaccugaggggaucauucccgcccucuuugaaccugagcggaagaaaagcgccgcuaucgacggagaauacagacugcgcggcgaggccagaaagaccuucgucgaacugaugcggcgcggggaucucccgguguggcuuuccuauaaagucgcgagcgagggcuuucaauacucugacagacgguggugcuucgacggagagcgcaacaaucaggugcuggaagagaacauggauguugaaauuuggacaaaggagggcgaacgcaagaagcugcggcccagauggcucgacgcccgcaccuauuccgauccucuggcccuucgggaguuuaaggaguucgccgcugggagacgcagcguguccggagaccugauccucgaaauuggcaaacugccccagcaccugacacuccgggcccagaaggcucuugauaaucuggugaugcugcauaacucugagcaagggggaaaagccuacagacacgcgauggaggaacucccugacaccaucgaaacgcugaugcuucuggcccucaucgcuguccugacaggcggcguuacccuguuuuuccucagcgggaagggacuuggcaaaaccuccauugggcugcugugugugauggccucuagcgcucuccuguggauggccuccguggagccccauuggaucgccgcuagcauuauccuugaguuuuuccugaugguccuccugauuccggaaccugaucggcagcgcacaccccaggacaaucagcuggcguaugugguuaucggacuccuuuuuaugauccugaccguggccgcuaacgagaugggccugcucgaaacaacgaagaaggaucuggggauuggacacgucgccgccgagaaucaccaucacgcuaccaugcuugacguggaucugagaccugccucugcguggacacucuacgccgucgcuaccacaaucauuacccccaugaugcggcauacgaucgagaacaccacagccaacauuucccugaccgcuaucgccaaucaagcggccauucugaugggccucgacaaaggcuggccuaucagcaagauggauaucggggugccccuucuggcucugggaugcuacucucagguuaacccgcucacacugaccgccgcugugcuuaugcuggucgcccacuaugcuauuaucggcccugggcuccaggccaaagcgacgcgcgaagcccaaaagagaacagcugccggaauuaugaaaaaucccaccguggacggcaucguugcuauugaccuggaucccguggucuacgacgccaaguucgagaagcagcuggggcagaucaugcuccuuauccuguguacaucccagauucugcucaugcggaccaccugggcccugugcgaaagcaucacacuugcgacgggaccucugaccacacucugggagggcucuccgggcaaauuuuggaacaccacaauugcugugagcauggccaauaucuuccgcggguccuaucuggcuggagccggccuggccuucucucucaugaaaagccuugggggaggcagacgggggaccggagcucaaggcgaaacgcugggcgagaaauggaagcgccagcugaaccagcucuccaaaagcgaguuuaauacauacaagagauccgggauuauggaaguggaucggucugaggccaaggaaggacugaaaagaggcgagaccaccaagcaugcgguuagccgcgggacagccaaacuucggugguucgucgaaagaaaccuggugaagcccgagggaaaagugaucgaccucggcugugggcgcggaggcugguccuauuacugcgcuggccugaagaaagucaccgagguuaagggguauacaaagggaggcccugggcacgaggagcccaucccuauggccacguacggauggaaucuggugaaacuccacucuggcaaggauguguuuuucacacccccugaaaaaugugacacacuucugugcgauauuggggagagcuccccgaaccccaccaucgaagagggacggacacugagaguccucaagaugguggagccuuggcugcgcggcaaucaguuuuguauuaaaauccuuaaccccuacaugccuucuguuguggaaacccuggagcaaaugcagcggaagcauggcgggaugcucgucagaaauccccugagccgcaacuccacgcacgaaauguauugggugagcugcggaaccggcaauauuguuucugcugugaacaugacaucccggaugcugcucaauagauucaccaugacacaucgcaagccgaccuacgagcgggacgucgaucugggggccggaacaagacacguggcgguggagccugaagucgccaaccuugacaucauuggccagcgcaucgagaacaucaaaaaugaacacaagagcaccuggcauuaugaugaggacaaccccuacaaaacgugggcuuaucacgggucuuacgaaguuaagcccuccggaagcgccucuuccauggugaauggcguggucagacugcucacaaaaccuugggacgugauucccaugguuacccagaucgcuaugaccgauacaacgccuuuuggccaacagcggguguucaaggagaaggucgacacccgcacaccgagagccaaacgggggaccgcucagauuauggaggugacagccaaguggcuguggggauuucuuagcagaaacaaaaagccccggaucuguacccgcgaagaguucacaagaaaaguucgguccaaugcggccauuggcgcuguguuugucgaugaaaaccaauggaauagcgccaaggaggcuguggaagacgagcgcuucugggaucugguucauagagagcgggaacuccacaagcaggggaaaugcgcuaccugcguguauaacaugaugggaaagcgcgagaaaaagcugggcgaauuugggaaagccaagggcucuagagcgaucugguacauguggcugggagcucgguuccucgaguucgaagcccugggcuuuaugaaugaggaccauugguucagccgcgagaacucccuuucuggggucgaaggagagggccugcacaaacucggguacauccugagagauauuagcaagaucccuggaggcaauauguaugccgacgauacgaccgggugggacacacggauuaccgaagaugaccuucagaacgaggcuaagaucacagauauuauggagcccgaacacgcccugcucgcuaccuccaucuuuaaacugacguaccagaauaaggugguccgcgugcaaagaccugccaaaucuggcacaguuauggacgugaucagccggcgcgaccagagaggauccggccaggucgggaccuauggacugaacacauucaccaauauggaggugcagcucauucggcaaauggaaucugagggcaucuuucugcccagcgaacuugagacgccgaaccuggcggagagagugcucgauuggcuggaaaagcaugggguugagcgccuuaaacggauggccauuuccggagacgauuguguggucaagccuaccgacgauagauucgcuacagcccugaccgcucucaacgacaugggcaaggugcgcaaagauaucccccagugggaaccuagcaagggguggaaugacuggcagcagguucccuuuugcucucaccauuuccaccaacugauuaugaaagauggccgggagaucguggucccuuguagaaaccaggacgaacugaugggacgcgcccgggugucccagggcgcgggguggagccucagagagacagccugccugggaaagucuuacgcucagauguggcaacuuauguauuuucaccgccgggaucugagacucgccgcuaaugccaucuguuccgcuguccccguggacuggguuccgaccagccgcacaaccugguccauucaugcccaccaucaguggaugacgacagaggacaugcugucuguguggaaccgggucuggaucgaagagaauccuuggauggaagauaaaacccacgugagcuccugggaggacguucccuaccuuggcaagagagaagaucaguggugcgggagccugauuggacucaccgcgcgggccacaugggcuaccaacauccaaguggccauuaaucaggucagacgccugaucggcaacgagaauuaucuggacuacaugacaucuaugaagcgguucaaaaacgaguccgaucccgaaggggcccucugguga

SEQ ID NO: 19446 - RNA, 9879 nt, Artificial Sequence
  derived and/or modified CDS sequence (opt5) from DENV-1__JQ915072__SS-prME
agcgugaccaugcugcucaugcugcuucccaccgugcugacguuccaccucaccacaagaggcggggagccucauaugauuguuuccaagcaggaacggggaaagucucugcuuuuuaagaccagcgccggcgugaacaugugcacacugauugcuauggaccucggggagcugugugaugacaccaugacauacaagugccccagaaucaccgaaacggagcccgaugacguggauuguuggugcaaugccaccgaaacauggguuaccuauggaacauguucccagaccggcgagcacagacgggacaagcgcucuguggcccuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaggaacaagacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucacaccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacaaccggggccuccaccagccaagagacauggaaccgccaggaccuccuggucacguucaaaaccgcucacgccaagaagcaggaagugguugugcugggaucccaagagggcgccaugcacacagcucucaccggggcgacagaaauccagaccucuggaacgacaaccauuuuugccggccaucugaaaugcagacuuaagauggauaaacugacccucaaggggaucagcuaugucauguguacaggcuccuucaaacuggagaaggaaguggcugagacccagcacggaacaguucuggugcaggucaaguacgagggcacggacgccccgugcaaaaucccuuucagcucucaagaugaaaagggggugacccagaauggacggcuugugacagccaaccccauuguuaccgacaaagagaagccugucaauaucgaagcugagccgcccuuuggcgaguccuauauuguggugggggccggagaaaaagcgcucaagcugagcugguucaagaaaggcucuagcaucgggaagauguuugaggcuacagccagaggcgcccgccggauggcuauucugggagauaccgccugggacuucggcuccaucgggggagucuuuacgucugugggcaaacucguucaucagaucuucgggaccgcuuacggagugcuguuuagcggcgucuccuggacaaugaagauugggaucggcauucuucugaccuggcucggacugaacagcagaucuacaucccugagcaugaccuguaucgccgugggcaugguuacacuuuaccucggggugaugguccaggcggauucuggaugcgugauuaauuggaaaggccgcgaacugaaguguggguccggaaucuucguuaccaacgaggugcacacguggacagaacaauauaaguuucaggccgacagcccuaaacggcuguccgcugccauuggcaaggcuugggaggagggggucugcggcaucagaucugccacccgccucgaaaacaucauguggaaacagauuagcaaugagcugaaccauauccuucuggaaaaugacaugaaguucaccgugguggucggagauguuuccggcauucucgcgcaggggaaaaagacaauccggccgcaacccauggagcacaaauacucuuggaaaagcuggggaaaggccaagauuaucggcgcugacgugcagaacaccacguuuaucauugaugggccuaauacacccgaauguccugacgaucagagagccuggaacaucugggagguggaggacuauggauucggcauuuuuaccacaaauaucuggcugaagcugcgcgauuccuacacccaggucugcgaccaccggcuuaugagcgcugccauuaaagauucuaaggccgugcaugcugacaugggcuauuggaucgaauccgagaaaaacgaaacauggaagcucgcgagagccagcuucaucgagguuaagaccuguguguggcccaaaucucacacgcugugguccaaugggguccuggaaagcgagaugauuaucccgaagauuuacggaggcccuaucucucaacauaacuaucgccccggguacuucacccagacagcuggaccuuggcaccucggcaaacuggagcuugauuuugaccugugcgaagggaccacagugguuguggaugagcacugcggacaucggggccccagccucagaaccacgacagucaccggcaagauuauccacgaaugguguugccgguccuguacacugccuccccugcgcuucaaaggggaggacggaugcugguacggcauggagaucagaccggugaaggaaaaggaggaaaaucuuguuaaaagcauggugucugccggguccggagaggucgacagcuuuucccucggccugcuguguauuucuaucaugauugaagaggugaugcggagcagauggucccgcaagaugcucaugaccgggacccugguggucuuccuucugcucacacugggacagcugacguggaacgaucuuauccggcugugcauuaugguuggcgccaaugcuucugacaacaugggcauggggaccacauaucucgcccugauggcgaccuuuagaaugcgcccuauguucgcugugggacuccuguuuagacggcuuacaagccgcgaggugcugcuccugaccgucggccugucccuuguggccucuguugaacugcccaauagccucgaugagcugggggacggacucgccaugggcaucaugauucugaaacuucugacggauuuccaaucccaucagcucugggcuacacugcugagccuuaccuuugugaagaccacacugucucuccacuacgccuggaaaaccauggcgaugauccuguccaucgucagccuccugccccuuugucugucuacaacgucccagaagaccacauggcugccugugcuccuggggagccuuggaugcaagccgcugaccauguuccucauuacagaaaacaaaaucuggggcagaaagucuuggccccugaacgagggcauuauggcuguugggaucguguccauucuccugagcucccuucugaaaaaugacgucccucuggccggaccccucaucgccggcgggaugcugaucgcuuguuaugugauuagcggaucuagcgccgaucuuucccuggaaaaggcugccaaagucucuugggaggaggaagcggagcauagcggcgccucccacaacauccucguggaaauucaggacgaugggaccaugaagaucaaagacgaggaacgggaugacacgauuaccauccugcucaaggcuacacugcuugccaucucuggaguuuacccuaugagcauucccgcuacccuguuuguguggcacuucuggcaaaagaaaaagcagcgcuccggcguccugugggauacaccuucucccccggagguggagaaagccguucucgacgacggcaucuaucgcauucugcagcgggggcuucugggacgcagccaggugggcgucgggguguuucaagaaggaguguuccauaccauguggcacguuacaagaggcgccguccucauguaccaggggaagcggcuggagccuuccugggcuagcgugaaaaaggaucucaucucuuauggaggcggcuggcgcuuccagggguccuggaauaugggagaagaggugcaggucauugcgguggagcccggcaagaacccuaaaaauguucaaacggcccccgggaccuuuaagacaagcgaaggagaggugggcgcuaucgcccuggacuucaaaccggggaccucuggauccccuauugucaacagagaaggcaagaucgugggccuuuacgggaauggaguugugaccacaagcggcacguacgucuccgccaucgcucaggccaaagcgucucaggaggggccccugccugaaauugaggaugagguguuucggaagagaaaccugaccaucauggaccuccaucccggaagcggcaagacacgccgguaucugcccgcuauuguuagagaagccaucaaacgcaaacuucggacccuggugcucgccccuacaagagucguggcuuccgagauggccgaagcgcugaaagggaugccgauucgcuaccaaaccacggcugucaagagcgagcacacaggcaaagaaaucgucgaucugaugugccaugccaccuucaccaugcggcuccuuucucccguuagagugccuaauuauaacaugaucauuauggacgaggcccacuuuacagaucccgcuuccaucgccgcucgcggauacauuagcacccgggugggcaugggggaggccgcggccaucuucaugacagcuaccccucccggaucugucgaagccuuuccucagagcaaugcugugauucaggacgaggaaaaggauaucccggagagauccuggaacucuggcuaugacuggaucacggauuuccccgggaagacaguuugguuugugccuagcauuaaauccggaaaugacaucgccaacugucugcggaagaauggcaaacgcgucauucagcugucuagaaagaccuucgacacagaauaccagaagaccaagaacaacgauugggacuaugugguuacgaccgauaucagcgagaugggggccaauuuucgggcugaccgcgugauugaucccagacggugccucaagccugucauccugaaagacggccccgagagagugauucuugcgggaccgaugccugucacaguggccuccgcugcccagcgccggggcagaaucgggcgcaaccagaauaaggaaggagaucaguacaucuacaugggccaaccccugaacaaugacgaggaucacgcccauuggaccgaagcuaaaaugcuccuggacaacauuaauacacccgaggggaucauuccugcccuguucgagcccgaacgggaaaagagcgcggcuaucgauggagaauauagacuccgcggcgaggcccggaaaaccuucguugaacuuaugagacgcggggaccugccuguguggcugucuuacaagguggccuccgagggcuuucaguauagcgauagacgguggugcuucgacggagagcgcaacaaucagguccucgaagagaacauggacguugaaauuuggacaaaagagggcgaaagaaagaagcugcggccgcgcuggcuugaugcuagaaccuacuccgacccccuggcccuccgggaguuuaaagaguucgcggccgggagacgcucugugagcggagaucugauccuggaaaucggcaagcucccucagcaccuuacgcaacgggcucagaaugcccuggacaaccuggugaugcuccauaauuccgagcaagggggaaaggcuuauagacacgccauggaggagcugcccgauacaauugaaaccaucaugcuucuggcucucauugccguccugaccggcggcgugacacuguuuuuccucucugggcgcggacuuggcaagaccagcaucgggcugcuguguguuacauccagcucugcgcuccuguggauggccuccguggagccucacuggauugcugccagcaucauccuugaguuuuuccugaugguccuccugauucccgaaccggaccggcagagaacgccucaagauaaccagcuggcuuacguggucaucggacuccuuuuuaugauucugaccguggccgccaaugagaugggccugcucgaaacaaccaaaaaggaccuggggaucggacauacagcugcggagaaccaccaucacgccgcuaugcuugauguugaccugcaucccgccucugccuggacccucuaugcuguggccacgaccauuaucacaccuaugaugcggcacaccauugagaacacaaccgcgaauaucucccugacggccaucgcuaaccaggccgcuauucugaugggccucgauaagggcuggcccaucagcaaaauggacauuggggucccucuucuggcccugggaugcuacucucaagugaauccccucacacugaccgcggccguucuuaugcugguggcucacuacgccaucauuggcccggggcuccaggcuaaggccacacgcgaagcucagaaaagaaccgccgcgggaaucaugaagaacccuaccgucgauggcaucguggccauugaccuggaccccgugguuuaugaugcuaaauucgagaagcagcuggggcaaaucaugcuccuuauucuguguacaagccagauccugcucaugcggacgaccugggcccugugcgaauccauuacacuugcuaccggaccccugacaacccucugggagggcucuccuggcaaguuuuggaauacgacaaucgccgucagcauggccaacaucuuccgcggguccuaccuggcgggagcuggccuggccuuuagccucaugaaaucccuugggggaucuagacggggcaccggggcucagggagaaacccugggcgagaaguggaaacgccagcugaaucaacucagcaaguccgaguucaacauuuauaaaagaucuggcaucauugaaguggaccggagcgaggccaaggaagggcugaagcgcggagagacaaccaaacaugccguguccagaggcacagcuaaacuucggugguucgucgaaagaaaucugguuaaaccggaggggaaggugaucgaucucggauguggccgcgggggauggucuuacuauugcgccggccugaaaaaggugacggaggucaaaggcuacaccaaagggggacccggccacgaggagccuauucccauggcgacauauggguggaaccuggugaagcuccauagcggaaaagacgucuuuuucaucccucccgaaaagugugauacccuucugugcgacauuggcgaguccagcccuaauccgacaaucgaagaggggcggacccugagagugcucaaaauggucgagcccuggcugcgcggaaaccaguuuuguaucaagauucuuaauccuuacaugcccucugugguugaaacgcuggagcagaugcagcggaaacacggcggcaugcucgugagaaacccucugucccgcaauagcacccacgaaauguacugggucucuugcgggacaggaaacaucguguccgccgugaauaugaccagccggaugcugcucaacagauucacaauggcucaucgcaagcccaccuaugagcgggaugucgaccugggcgccgggacaagacacguugcuguggagccggaaguggccaaccuugauauuaucggacaacgcauugagaauaucaagaacgaacauaaaucuaccuggcacuacgacgaggauaauccuuauaagacgugggcguaccauggcuccuaugaagucaaacccagcggguccgccagcucuauggugaacggaguugugcggcugcucacaaagcccugggacgucaucccuauggugacccagauugcuaugaccgacacaacgcccuuuggccagcaaagaguuuucaaagagaagguggauacccgcacaccuaaggccaaaagaggcaccgcucagaucauggaggucacagccaaguggcuguggggguuucuuagccggaauaaaaagccgcgcauuuguaccagagaagaguucacacggaaagugagauccaacgcugccaucggagcgguuuuuguggacgaaaaucaguggaacucugccaaggaggcugucgaagaugagcgguucugggaccuggugcgcagagagcgggaacuccacaagcagggcaaaugcgcgaccugcgucuacaauaugauggggaagcgcgagaaaaagcugggagaauuuggcaaagcuaaggggagcagagccauuugguauauguggcugggcgcccgguuccucgaguuugaagcgcugggauucaugaacgaggaucacugguucucccgcgaaaauucucuuagcggcguggaaggggagggacugcauaaacucggcuacauccugagagacaucuccaagauucccgggggaaacauguacgcugaugacacggccggcugggauacccggaucacagaagaggaccuucaaaaugaggccaagauuaccgauaucauggaaccugagcacgcucugcucgccacaucuauuuuuaaacugaccuaucagaacaagguugugcgcguccagagacccgcuaaaaaugggacggugauggacgugaucagccggcgcgaucagagaggcuccggacaaguuggcacauacgggcugaacaccuucacaaacauggaagcccagcucauccggcagauggagagcgaaggaaucuuuucuccuuccgagcuggagacccccaaucuugcgggccgcgugcuggacuggcucgaaaagcaugggaucgagagacugcggagaauggccauuagcggagacgauugugucgugaaaccgaucgacgaucgcuucgcuacggcccuuaccgcucugaacgacaugggcaagguucggaaggauauuccucagugggaacccucuaaaggguggaaugacuggcaacaggugccuuuuugcucccaccacuuccaucagcucaucaugaaggauggcagagagauugucgugcccugucgcaaccaggacgaacuggucggacgggccagagugagccaaggcgcgggguggucccugcgcgagacagccugccucggaaaaucuuaugcucagauguggcagcugauguacuuucaccggagagaucuucgccuggccgcuaaugccaucuguagcgcuguuccuguggacuggguccccaccucccggacaaccuggagcauccaugcccaccaucaauggaugacaaccgaggauaugcucucuguguggaacagaguuuggauugaagagaauccguggauggaagacaagacgcacguguccagcugggaggacgucccuuaucugggcaaacgcgaagaucaguggugcgggucucuuaucggacugacagcgcgggccaccugggcuaccaacauucagguggccaucaaacaggugagacggcucauuggcaaugagaacuaccuggacuauaugacaagcaugaagagauucaaaaaugaguccgaucccgaaggggcccugugguga

SEQ ID NO: 19447 - RNA, 9879 nt, Artificial Sequence
  derived and/or modified CDS sequence (opt5) from DENV-1__JQ915071__SS-prME
agcgugaccaugcugcucaugcugcuucccacaguccugacguuccaccucaccacaagaggcggggagccucauaugaucguuuccaagcaggaacggggaaaaucucugcuuuuuaagaccagcgccggcgugaacaugugcacacugauugcuauggaccucggggagcugugugaugacaccaugacauacaaaugcccgcgcaucaccgaaacggagcccgaugacguggauuguuggugcaaugccaccgaaacaugggucaccuauggaacauguucccaaaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagagcaggacacaaauuucgucugccggcgcacguuuguggauagaggcuggggcaacggguguggacuguucggcaaagggagccuuauuaccugcgccaaguuuaagugcgcgacaaaacuggagggaaagaucguucaguacgaaaaucucaaauauucugugaucgucaccgugcacacaggcgaccagcaucaaguugggaacgagaccacggaacacggaaccauugccacaaucaccccccaggcuccuacauccgagauucagcugaccgacuacggcgcccugacgcucgauuguagcccccggacaggccuggacuucaaugaaauggugcuucugaccaugaaggagaaaucuuggcucguccauaagcagugguuucuggaucuuccucugcccuggacaaccggggcuuccaccagccaagagacauggaaccgccaggaccuccuggugacguucaaaaccgcccacgccaagaagcaggaagucgugguucugggaucccaagagggcgcuaugcacacagcgcucaccggggccacagaaauccagaccucuggaacgacaaccauuuuugcuggccaucugaaaugcagacuuaagauggauaaacugacccucaaggggaucagcuaugugauguguacaggcuccuucaaacuggagaaggaagucgccgagacccagcacggaacagugcugguucaggugaaguacgagggcacggacgccccgugcaaaaucccuuucagcucucaagaugaaaagggggucacccagaauggacggcuugugacagcuaaccccauugugaccgacaaagagagaccuguuaauaucgaagccgagccccccuuuggcgaguccuauauugucgugggggcgggagaaaaggcucucaaacugagcugguucaagaagggcucuagcaucgggaaaauguuugaggccacagcccgcggcgcucggagaauggccauucugggagauaccgcuugggacuucggcuccaucgggggaguguuuacgucugucggcaagcucgugcaucagaucuucgggaccgccuacggaguucuguuuagcggcguguccuggacaaugaaaauugggaucggcauucuucugaccuggcucggacugaacagccgcucuacaucccugagcaugaccuguaucgcggucggcauggugacacuuuaccucgggguuauggugcaggccgauucuggaugcgucauuaauuggaagggccgggaacugaaauguggguccggaaucuucgugaccaacgagguucacacguggacagaacaauauaaguuucaggcugacagcccuaagagacuguccgccgcuauuggcaaagccugggaggagggggugugcggcauccgcucugcgacccggcucgaaaacaucauguggaagcagauuagcaaugagcugaaccauauccuucuggaaaaugacaugaaauucaccgucguggugggagaugucuccggcauucucgcccaggggaagaaaacaaucagaccgcaacccauggagcacaaguacucuuggaaaagcuggggaaaggcuaagauuaucggcgccgacguucagaacaccacguuuaucauugaugggccuaauacacccgaauguccugacgaucagcgcgcuuggaacaucugggagguggaggacuauggauucggcauuuuuaccacaaauaucuggcugaaacugcgggauuccuacacccaggugugcgaccacagacuuaugagcgccgccauuaaggauucuaaagcuguccaugcggacaugggcuauuggaucgaauccgagaagaacgaaacauggaaacucgcccgcgcuagcuucaucgaggugaagaccuguguuuggcccaagucucacacgcugugguccaauggggugcuggaaagcgagaugauuaucccgaaaauuuacggaggcccuaucucucaacauaacuaucggcccggguacuucacccagacagccggaccuuggcaccucggcaagcuggagcuugauuuugaccugugcgaagggaccacagucgugguugaugagcacugcggaaauagaggccccagccuccggaccacgacagugaccggcaaaauuauccaugaaugguguugccgcuccuguacacugccuccccugagauucaagggggaggacggaugcugguacggcauggagauccggccggucaaagaaaaggaggaaaaccuugugaagagcaugguuucugccggguccggagagguggacagcuuuucccucggccugcuguguauuucuaucaugauugaagaggucaugagaagccgcuggucccggaaaaugcucaugaccgggacccuggugguguuccuucugcucacacugggacagcugacguggaaugaucuuaucagacugugcauuauggucggcgcuaacgccucugacaauaugggcauggggaccacauaucucgcgcugauggcuaccuuucgcaugagaccuauguucgccguuggacuccuguuucggcgccuuacaagcagagaggugcugcuccugaccgugggccugucccuugucgccucuguggaacugcccaacagccucgaugagcugggggacggacucgcuaugggcaucaugauucugaagcuucugacggauuuccaaucccaccagcucugggccacacugcugagccuuaccuuuguuaaaaccacacugucucuccauuacgcguggaagaccauggcuaugauccuguccaucgugagccuccugccccuuugucugucuacaacgucccagaaaaccacauggcugccuguccuccuggggagccuuggaugcaagccgcugaccauguuccucauuacagaaaacaagaucuggggccggaaaucuuggccccugaaugagggcauuauggccguggggaucguuuccauucuccugagcucccuucugaagaacgacgugccucuggccggaccccucaucgcuggcgggaugcugaucgccuguuaugucauuagcggaucuagcgcugaucuuucccuggaaaaagccgcgaaggugucuugggaggaggaagccgagcacagcggcgcuucccauaauauccucgucgaaauucaggacgaugggaccaugaaaaucaaggacgaggaacgcgaugacacgauuaccauccugcucaaagccacacugcuugcuaucucuggaguguacccuaugagcauucccgccacccuguuuguuuggcacuucuggcaaaagaagaaacagagauccggcgugcugugggauacaccuucucccccggaggucgagaaggccgugcucgacgacggcaucuaucggauucugcagcgcgggcuucugggaagaagccagguuggcgugggggucuuucaagaaggaguguuccacaccauguggcaugugacacggggcgcuguucucauguaccaggggaaacgccuggagccuuccugggcgagcgucaagaaagaucucaucucuuauggaggcggcuggagauuccagggguccuggaacacgggagaagaggugcaggugauugccgucgagcccggcaagaauccuaagaacgugcaaaccgcucccgggacauuuaaaaccagcgaaggagagguuggcgccaucgcccuggacuucaagccggggaccucuggauccccuauugugaaucgggaaggcaaaaucgucggccuuuacgggaacggagugguuacaacgagcggcaccuacguguccgcuaucgcccaggcgaaggcuucucaggaggggccccugccugaaauugaggaugaggucuuuagaaaacgcaaucugacaaucauggaccuccaccccggaagcggcaagacccggagauaucugcccgccauugugcgcgaagccaucaagcggaaacuuagaacacugguucucgcuccuacccgcguggucgccuccgagauggcggaagcucugaaggggaugccgauucgguaccaaacgacagccgugaaaagcgagcauaccggcaaggaaaucguggaucugaugugccacgccaccuucacaaugagacuccuuucucccguccgcguuccuaacuauaauaugaucauuauggacgaggcucauuuuaccgaucccgccuccaucgcugcccggggauacauuagcacaagagugggcaugggggaggcggccgcuaucuucaugaccgccacgccucccggaucuguggaagcuuuuccucagagcaacgccgucauucaggacgaggaaaaagauaucccggagcgguccuggaauucuggcuaugacuggaucacagauuuccccgggaagaccgugugguuuguuccuagcauuaaguccggaaacgacaucgccaauugucugcgcaaaaacggcaagagagugauucagcugucucggaaaacauucgacaccgaauaccaaaagacgaaaaacaaugauugggacuaugucgugaccacagauaucagcgagaugggggcuaacuuucgcgcggacagaguuauugauccccggagaugccucaagccugugauccugaaggacggccccgagcgcgucauucuugccggaccgaugccugugaccgucgcuuccgccgcccagcggagaggccgcaucgggcggaaucagaacaaagaaggagaucaguacaucuacaugggccaaccccugaauaacgacgaggaucacgcucacuggacagaagccaagaugcuccuggacaauauuaacacccccgaggggaucauuccugcgcuguucgagcccgaaagagagaaaagcgcugccaucgauggagaauaucgccuccggggcgaggccagaaagacauucguggaacuuaugcgcagaggggaccugccuguuuggcugucuuacaaaguggcuuccgagggcuuucaguauagcgaucggcgcuggugcuucgacggagagagaaauaaccaggugcucgaagagaauauggacgucgaaauuuggaccaaggagggcgaacggaaaaagcugcgcccgagauggcuugaugcccggacguacuccgacccccuggcgcucagagaguuuaaggaguucgccgcugggcgccggucuguuagcuccgaucugauccuggaaaucggaaaacucccucagcaucuuacacaaagagcccagaacgcucuggacaaucuggugaugcuccacaacucugagcagggcgggaaggccuaucgccaugcuauggaagagcugcccgauaccauugaaaccaucaugcuucuggcccucauugcggugcugacaggaggcgucacccuguuuuuccucagcggccgggggcuuggaaaaacauccaucggccugcugugugugacgagcucuuccgcccuccuguggauggcuaauguugagccucacuggauugccgcuagcaucauccuugaguuuuuccugauggugcuccugauucccgaaccggacagacagcggaccccucaagauaaccagcuggccuacgucgugaucgggcuccuuuuuaugauucugacagucgccgcuaacgagaugggacugcucgaaaccacaaagaaagaccugggcaucgggcacaccgcggccgagaaucaucaccaugcugccaugcuugauguggaccugcaccccgccucugcuuggacgcucuaugccguugcgaccacaauuaucaccccuaugaugcgccauacaauugagaacaccacggccaauaucucccugacagcuaucgccaaccaggcugccauucugaugggacucgauaagggcuggcccaucagcaagauggacauuggcgugccucuucuggcgcuggggugcuacucucaagucaauccccucacccugacagccgcugugcuuaugcugguugcccacuacgcuaucauuggaccgggccuccaggccaaagcuaccagagaagcccagaagcggaccgcggccgggaucaugaaaaacccuacaguggauggaaucgucgcuauugaccuggaccccgugguguaugaugccaaguucgagaaacagcugggccaaaucaugcuccuuauucuguguacgagccagauccugcucaugcgcaccacaugggcucugugcgaauccauuacccuugccacagggccccugaccacgcucugggagggaucuccuggcaaguuuuggaauacaaccaucgccguuagcauggcgaacaucuucagaggcuccuaccuggcuggggccggacuggcuuuuagccucaugaagucccuuggcgggggacggcgcggcaccggggcccagggagaaacacugggcgagaaauggaagagacagcugaaucaacucucuaaaagcgaguucaacaccuauaagcgguccggcauuaucgaagucgaccgcucugaggccagagaagggcugaaacggggagagacaacgaagcacgcugugagcagaggcaccgccaagcuucgcugguucguggaacggaaucuggucaaaccggaggggaagguuauugaucucggauguggcagagggggaugguccuacuauugcgcgggccugaaaaaggugacagaggugaaaggcuacaccaaggggggacccggccaugaagagccuauccccauggccacauauggguggaaccuggucaaacuccacucuggaaaggacguguuuuucauuccucccgaaaagugugauacccuucugugcgacaucggcgagagcuccccuaauccgacgauugaagaggggcgcacccugcggguucucaaaaugguggagcccuggcugagaggaaaccaguuuuguaucaagauccuuaauccuuacaugcccagcgucguggaaacacuggagcagaugcagcgcaaacauggcggcaugcucguucggaacccucugucuagaaauuccacccacgaaauguacugggugagcugcgggacaggaaacauugucucugcugugaacaugaccucccgcaugcugcucaaucgguucacaauggcccacagaaagcccaccuaugagcgcgauguggaccugggcgcugggacgcggcaugucgccguugagccggaaguggcgaaccuugauaucauuggacaaagaaucgagaauauuaaaaacgaacacaagagcacauggcauuacgacgaggauaauccuuauaagaccugggccuaccacggcucuuaugaagugaaacccuccgggagcgcuuccagcauggucaacggagugguucgccugcucaccaagcccugggacgugaucccuauggucacacagaucgccaugacggacaccacacccuuuggccagcaaagaguguucaaagagaagguugauacccggacaccuaaagcuaagcgcggcaccgcccagauuauggaggugacagcuaaguggcuguggggguuucuuucuagaaauaaaaagccgcggaucuguaccagagaagaguucacgcggaaaguccgcagcaacgccgcgauuggagccguguuuguugacgaaaaucaguggaacuccgcuaaggaggccguggaagaugagagauucugggaccugguccggcgcgagagagaacuccauaaacagggcaagugcgcuaccugcguguacaauaugauggggaagcgggagaaaaagcugggagaauuuggcaaagccaaggggucucgcgccaucugguauauguggcugggcgcgagauuccucgaguuugaagcucugggauucaugaacgaggaucacugguucagccgggagaauucccuuucuggcgucgaaggggagggacugcacaaacucggcuacauucugcgcgacaucagcaagauccccgggggaaacauguacgccgaugacacagccggcugggauaccagaauuacagaagaggaccuucaaaaugaggcuaaaaucaccgauauuauggaaccugagcaugcccugcucgcuacguccaucuuuaagcugacauaucagaacaaggugguucgggugcagcgccccgccaaaaacgggaccgucauggacgugauuucuagacgggaucagcgcggcagcggacaagugggcacauacgggcugaauaccuucacgaacauggaagcgcagcucaucagacagauggaguccgaaggaaucuuuagcccuucugagcuggagacccccaaucuugccggccggguucuggacuggcucgaaaagcacgggauugagagacugcgccggauggcuaucuccggagacgauuguguggucaaaccgauugacgauagauucgccacagcucuuaccgcccugaacgacaugggcaaggugcgcaaagauaucccucagugggaacccagcaagggguggaaugacuggcaacagguuccuuuuugcucucaucacuuccaccagcucauuaugaaggauggccgggagaucgugguccccuguagaaaccaggacgaacuggugggacgcgcgcgggucucccaaggcgccggguggagccugagagagacagcuugccucggaaaauccuaugcccagauguggcagcugauguacuuucaucgccgggaucuuagacuggcugccaaugcuauuuguucugccgugccuguugacugggugcccaccagccgcacaaccugguccauccacgcgcaucaccaauggaugacgacagaggauaugcucagcgucuggaaccggguguggaucgaagagaauccguggauggaagacaagacccauguuucuuccugggaggacgugccuuaucugggcaaaagagaagaucaguggugcgggagccuuauuggacugaccgcccgggcuacaugggccaccaacauccaggucgccauuaaucaggugagacgccucaucggcaacgagaauuaccuggacuauaugacaucuaugaagcgguucaaaaacgagagcgaucccgaaggggcucugugguga

SEQ ID NO: 19448 - RNA, 9879 nt, Artificial Sequence
  derived and/or modified CDS sequence (opt5) from DENV-1__JQ915073__SS-prME
uccgugaccaugcugcucaugcugcuucccaccguccugacguuccaccucaccacaagaggcggggagccucauaugaucguuuccaagcaggaacggggaaaaucucugcuuuuuaagaccuccgccggcgugaacaugugcacacugauugcuauggaccucggggagcugugugaugacaccaugacauacaaaugcccgagaaucaccgaaacggagcccgaugacguggauuguuggugcaaugccaccgaaacaugggucaccuauggaacauguuuccagaccggcgagcacagacgggacaagcgcuccguggcgcuggcuccucauguugggcucggacuggagacgagaacagaaaccuggaugucuagcgagggcgccuggcggcagauucagaaaguggaaacaugggcccuucgccaccccggcuuuaccgucaucgcucuguuccucgcccaugcuauugggaccuccaucacacagaagggaaucauuuuuauccugcuuaugcuggugacgccuucuauggccaugagaugcguuggcauugggaaccgggauuucguggagggacucagcggcgcgaccugggucgacguggugcuggagcacggguccugugucacaaccauggccaaggauaaacccacacuggacaucgaacuccugaagaccgagguuacgaauccugcugugcuucgcaaacugugcauugaagccaagaucagcaacacaaccaccgauucuagauguccgacacaaggagaggcuacccucguggaagaacaagacacaaauuuugucugccggcgcacguucguggauagaggcuggggcaacggguguggacuguuuggcaaagggucccuuauuaccugcgccaaguucaagugcguuacaaaacuggagggaaagaucgugcaguacgaaaaucucaaauauagcgucaucgugaccguucacacaggcgaccagcaucaaguggggaacgagaccacggaacacggaaccauugcgacaaucacaccccaggccccuacaucugagauucagcugaccgacuacggcgcucugacgcucgauuguagcccccggacaggccuggacuuuaaugaaaugguccuucugaccaugaaggagaaaagcuggcucgugcauaagcagugguuccuggaucuuccucugcccuggacaaccggggccucuaccucccaagagacauggaaccgccaggaccuccuggucacguuuaaaaccgcucacgccaagaagcaggaagugguugugcugggaagccaagagggcgccaugcacacagcucucaccggggcgacagaaauccagaccuccggaacgacaaccauuuucgccggccaucugaaaugcagacuuaagauggauaaacugacccucaaggggaucucuuaugucauguguacaggcagcuucaaacuggagaaggaaguggcugagacccagcacggaacaguucuggugcaggucaaguacgagggcacggacgccccgugcaaaaucccuuuuuccagccaagaugaaaagggggugacccagaauggacggcuugugacagccaaccccauuguuaccgacaaagagaagccugucaauaucgaagcugagccgcccuucggcgagucuuauauuguggugggggccggagaaaaagcgcucaagcuguccugguuuaagaaaggcagcucuaucgggaagauguucgaggcuacagccagaggcgcccgccggauggcuauucugggagauaccgccugggacuuuggcagcaucgggggagucuucacguccgugggcaaacucguucaucagaucuuugggaccgcuuacggagugcuguucucuggcgucagcuggacaaugaagauugggaucggcauucuucugaccuggcucggacugaacuccagaagcacaucucuguccaugaccuguaucgccgugggcaugguuacacuuuaccucggggugaugguccaggcggauagcggaugcgugauuaauuggaaaggccgcgaacugaagugugggucuggaaucuuuguuaccaacgaggugcacacguggacagaacaauauaaguuccaggccgacuccccuaaacggcugagcgcugccauuggcaaggcuugggaggagggggucugcggcaucagauccgccacccgccucgaaaacaucauguggaaacagauuucuaaugagcugaaccauauccuucuggaaaaugacaugaaguuuaccgugguggucggagauguuagcggcauucucgcgcaggggaaaaagacaauccggccgcaacccauggagcacaaauacuccuggaagucuuggggaaaggccaaaauuaucggcgcugacgugcagaacaccacguucaucauugaugggccuaauacacccgaauguccugacgaucagagagccuggaacaucugggagguggaggacuauggauuuggcauuuucaccacaaauaucuggcugaagcugcgcgauagcuacacccaggucugcgaccaccggcuuauguccgcugccauuaaagauagcaaggccgugcaugcugacaugggcuauuggaucgaaucugagaaaaacgaaacauggaagcucgcgagagccuccuucaucgagguuaagaccuguguguggcccaaaagccacacgcuguggucuaaugggguccuggaauccgagaugauuaucccgaagauuuacggaggcccuaucagccaacauaacuaucgccccggguacuuuacccagacagcuggaccuuggcaccucggcaaacuggagcuugauuucgaccugugcgaagggaccacagugguuguggaugagcacugcggacaucggggccccucucucagaaccacgacagucaccggcaagauuauccacgaaugguguugccggagcuguacacugccuccccugcgcuuuaaaggggaggacggaugcugguacggcauggagaucagaccggugaaggaaaaggaggaaaaucuuguuaaauccauggugagcgccgggucuggagaggucgacuccuucagccucggccugcuguguauuuccaucaugauugaagaggugaugcggucuagauggagccgcaagaugcucaugaccgggacccugguggucuuucuucugcucacacugggacagcugacguggaacgaucuuauccggcugugcauuaugguuggcgccaaugcuuccgacaacaugggcauggggaccacauaucucgcccugauggcgaccuucagaaugcgcccuauguuugcugugggacuccuguucagacggcuuacaucucgcgaggugcugcuccugaccgucggccugagccuuguggccuccguugaacugcccaauucucucgaugagcugggggacggacucgccaugggcaucaugauucugaaacuucugacggauuuucaaagccaucagcucugggcuacacugcugucccuuaccuucgugaagaccacacugagccuccacuacgccuggaaaaccauggcgaugauccugucuaucgucucccuccugccccuuugucugagcacaacgucucagaagaccacauggcugccugugcuccuggggucccuuggaugcaagccgcugaccauguuucucauuacagaaaacaaaaucuggggcagaaagagcuggccccugaacgagggcauuauggcuguugggaucgugucuauucuccuguccagccuucugaaaaaugacgucccucuggccggaccccucaucgccggcgggaugcugaucgcuuguuaugugauuuccggaagcucugccgaucuuagccuggaaaaggcugccaaagucuccugggaggaggaagcggagcauucuggcgccagccacaacauccucguggaaauucaggacgaugggaccaugaagaucaaagacgaggaacgggaugacacgauuaccauccugcucaaggcuacacugcuugccaucuccggaguuuacccuaugucuauucccgcuacccuguucguguggcacuuuuggcaaaagaaaaagcagcgcagcggcguccugugggauacaccuagcccucccgagguggagaaagccguucucgacgacggcaucuaucgcauucugcagcgggggcuucugggacgcucucaggugggcgucgggguguuccaagaaggaguguuccauaccauguggcacguuacaagaggcgccguccucauguaccaggggaagcggcuggagcccagcugggcuuccgugaaaaaggaucucaucagcuauggaggcggcuggcgcuuucaggggucuuggaauacgggagaagaggugcaggucauugcgguggagcccggcaagaacccuaaaaauguucaaaccacacccgggaccuucaagaccuccgaaggagaggugggcgccaucgcucuggacuuuaaaccggggacaagcggaucuccuauugucaacagagaaggcaagaucgugggccuuuacgggaauggaguugugacgaccuccggcacauacgucagcgccaucgcccaggcuaaagccucccaggaggggccccugccugaaauugaggaugagguguuccggaagagaaaccugaccaucauggaccuccaucccggaucuggcaagacacgccgguaucugcccgcgauuguuagagaagcuaucaaacgcaaacuucggacccuggugcucgccccuacgagagucguggccagcgagauggcugaagcccugaaagggaugccgauucgcuaccaaacaaccgcggugaaguccgagcacaccggcaaagaaaucgucgaucugaugugccaugcuacauuuaccaugcggcuccuuagccccguuagagugccuaauuauaacaugaucauuauggacgaggcccacuucacagaucccgccucuaucgcugcccgcggauacauuuccacccgggugggcaugggggaggcugccgcgaucuuuaugacggccacaccucccggaagcgcugaagccuucccucagucuaaugcugucauucaggacgaggaaaaggauaucccggagagaagcuggaacuccggcuaugacuggaucaccgauuuucccgggaagacagugugguucguuccuucuauuaaaagcggaaaugacaucgccaacugucugcggaagaauggcaaacgcgugauucagcuguccagaaagaccuuugacacggaauaccagaagaccaagaacaacgauugggacuaugucgugacaaccgauaucucugagaugggggccaauuuccgggcugaccgcguuauugaucccagacggugccucaagccugugauccugaaagacggccccgagagagucauucuugcgggaccgaugccugugacagucgccagcgcugcccagcgccggggcagaaucgggcgcaaccagaauaaggaaggagaucaguacaucuacaugggccaaccccugaacaaugacgaggaucacgcccauuggaccgaagcuaaaaugcuccuggacaacauuaauacacccgaggggaucauuccugcccuguucgagcccgaacgggagaaguccgcggcuaucgauggagaauauagacuccgcggcgaggcccggaaaaccuuuguggaacuuaugagacgcggggaccugccuguuuggcugagcuacaagguggccucugagggcuuccaguauuccgauagacgguggugcuuugacggagagcgcaacaaucaggugcucgaagagaacauggacgucgaaauuuggacgaaagagggcgaaagaaagaagcugcggccgcgcuggcuugaugcuagaacauacagcgacccccuggcccuccgggaguucaaagaguuugcggccgggagacgcuccguuucuggagaucugauccuggaaaucggcaagcucccucagcaccuuacccaacgggcucagaaugcccuggacaaccuggugaugcuccauaauagcgagcaagggggaaaggcuuauagacacgccauggaggaacugcccgauaccauugaaacaaucaugcuucuggcucucauugccgugcugaccggcggcgucacacuguucuuucucuccgggcgcggacuuggcaagacgucuaucgggcugcugugugugaccagcuccagcgcgcuccuguggauggccucuguugagccucacuggauugcugccuccaucauccuugaguucuuucugauggugcuccugauucccgaaccggaccggcagagaacaccucaagauaaccagcuggcuuacgucgugaucggacuccuuuucaugauucugaccgucgccgccaaugagaugggccugcucgaaacaaccaaaaaggaccuggggaucggacauacggcugcggagaaccaccaucacgccgcuaugcuugauguggaccugcaucccgccagcgccuggacccucuaugcuguugccacaaccauuaucacaccuaugaugcggcacaccauugagaacacgacagcgaauaucucucugaccgccaucgcuaaccaggccgcuauucugaugggccucgauaagggcuggcccaucuccaaaauggacauuggggugccucuucuggcccugggaugcuacagccaagucaauccccucacacugaccgcggccgugcuuaugcugguugcucacuacgccaucauuggcccggggcuccaggcuaaggccacccgcgaagcucagaaaagaacagccgcgggaaucaugaagaacccuacgguggauggcaucgucgccauugaccuggaccccgugguguaugaugcuaaauuugagaagcagcuggggcaaaucaugcuccuuauucuguguaccucucagauccugcucaugcggacaaccugggcccugugcgaaagcauuacacuugcuaccggaccccugacgacacucugggagggcuccccuggcaaguucuggaauaccaccaucgccguuucuauggccaacaucuuucgcgggagcuaccuggcgggagcuggccuggccuucucccucaugaaaagccuugggggaggcagacgggggacaggagcucagggcgaaacccugggcgagaaguggaaacgccagcugaaucaacucuccaagucugaguucaacacauauaaaagaagcgggauuaucgaagucgaccgguccgaggccaaggaaggacugaagcgcggcgagacgaccaaacaugccgugucuagagggacagcuaaacuucggugguuuguggaaagaaaucuggucaaaccggagggaaagguuauugaucucggcugugggcgcggaggcuggagcuacuauugcgccggccugaaaaaggugaccgaggugaaaggguacacaaagggaggccccgggcacgaggaaccuauccccauggcgaccuauggauggaaccuggucaagcuccauuccggcaaagacguguucuuuauuccucccgaaaagugugauacgcuucugugcgacaucggggagucuagcccuaauccgaccauugaagagggacggacacugagaguucucaaaaugguggagcccuggcugcgcggcaaccaguucuguaucaagauccuuaauccuuacaugcccuccgucguggaaacccuggagcagaugcagcggaaacacggcgggaugcucguuagaaacccucugagccgcaauucuacacacgaaauguacuggguguccugcggaaccggcaacauugucagcgccgugaauaugacaucucggaugcugcucaacagauuuaccauggcucaucgcaagcccacguaugagcgggauguggaccugggggccggaacaagacacgucgcuguugagccggaaguggccaaccuugauaucauuggccaacgcaucgagaauauuaagaacgaacauaaauccaccuggcacuacgacgaggauaauccuuauaagaccugggcguaccaugggagcuaugaagugaaacccucuggauccgccagcuccauggucaacggcgugguucggcugcucacaaagcccugggacgugaucccuauggucacgcagaucgcuaugaccgacacaacccccuucggccagcaaagaguguuuaaagagaagguugauacacgcaccccuaaggccaaaagagggacagcucagauuauggaggugaccgccaaguggcuguggggauuccuuagccggaauaaaaagccgcgcaucuguacgagagaagaguuuacccggaaagucagaucuaacgcugccauuggcgcgguguucguugacgaaaaucaguggaacagcgccaaggaggcuguggaagaugagcgguuuugggaccugguccgcagagagcgggaacuccacaagcaggggaaaugcgccacaugcguguacaauaugaugggaaagcgcgagaaaaagcugggcgaguucgggaaagcuaagggcuccagagccaucugguauauguggcugggagcccgguuucucgaguucgaagcgcugggcuucaugaacgaggaucacugguuuucucgcgagaauagccuuuccggggucgaaggagagggccugcauaaacucggguacauucugagagacaucucuaagauccccggaggcaacauguacgcugaugacaccgccgggugggauacacggauuaccgaagaggaccuucaaaaugaggccaagaucacggauauuauggaaccugagcacgcucugcucgccacaagcaucuucaaacugaccuaucagaacaaggugguucgcgugcagagacccgcuaaaaauggcacagucauggacgugauuucccggcgcgaucagagaggaucuggccaaguggggaccuacggacugaacacguuuaccaacauggaagcccagcucauccggcagauggagagcgaaggcaucuucuccccuagcgagcuggagacacccaaucuugcggggcgcguucuggacuggcucgaaaagcauggaauugagagacugcggagaauggccaucucuggcgacgauuguguggucaaaccgauugacgaucgcuuugcuaccgcccuuacagcucugaacgacauggggaaggugcggaaggauaucccucagugggaacccuccaaaggcuggaaugacuggcaacagguuccuuucugcagccaccacuuucaucagcucauuaugaaggauggaagagagaucgugguccccugucgcaaccaggacgaacuggugggccgggccagagucucucaaggggcgggauggucccugcgcgagaccgccugccucggcaaaagcuaugcucagauguggcagcugauguacuuccaccggagagaucuucgccuggccgcuaaugccauuuguuccgcugugccuguugacugggugcccacaucucggaccacguggagcauccaugcccaccaucaauggaugacaaccgaggauaugcucuccgucuggaacagaguguggaucgaagagaauccguggauggaagacaagacccacguuagcucuugggaggacgugccuuaucuggggaaacgcgaagaucaguggugcggaucccuuauuggccugacagcgcgggccaccugggcuacaaacauccaggucgccauuaaucaggugagacggcucaucgggaacgagaauuaccuggacuauaugacgagcaugaagagauuuaagaacgagucugaucccgaaggcgcccugugguga

SEQ ID NO: 19449 - RNA, 9879 nt, Artificial Sequence
  derived and/or modified CDS sequence (opt5) from DENV-1__JQ915075__SS-prME
agcgugaccaugcugcucaugcugcuucccacaguccugacguuccaccucaccacaagaggcggggagccucauaugaucguuuccaagcaggaacggggaaaaucucugcuuuuuaagaccagcgccggcgugaacaugugcacacugauugcuauggaccucggggagcugugugaugacaccaugacauacaaaugcccgcgcaucaccgaaacggagcccgaugacguggauuguuggugcaaugccaccgaaacaugggucaccuauggaacauguucccaaaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagagcaggacacaaauuucgucugccggcgcacguuuguggauagaggcuggggcaacggguguggacuguucggcaaagggagccuuauuaccugcgccaaguuuaagugcgcgacaaaacuggagggaaagaucguucaguacgaaaaucucaaauauucugugaucgucaccgugcacacaggcgaccagcaucaaguugggaacgagaccacggaacacggaaccauugccacaaucaccccccaggcuccuacauccgagauucagcugaccgacuacggcgcccugacgcucgauuguagcccccggacaggccuggacuucaaugaaauggugcuucugaccaugaaggagaaaucuuggcucguccauaagcagugguuucuggaucuuccucugcccuggacaaccggggcuuccaccagccaagagacauggaaccgccaggaccuccuggugacguucaaaaccgcccacgccaagaagcaggaagucgugguucugggaucccaagagggcgcuaugcacacagcgcucaccggggccacagaaauccagaccucuggaacgacaaccauuuuugcuggccaucugaaaugcagacuuaagauggauaaacugacccucaaggggaucagcuaugugauguguacaggcuccuucaaacuggagaaggaagucgccgagacccagcacggaacagugcugguucaggugaaguacgagggcacggacgccccgugcaaaaucccuuucagcucucaagaugaaaagggggucacccagaauggacggcuugugacagcuaaccccauugugaccgacaaagagagaccuguuaauaucgaagccgagccccccuuuggcgaguccuauauugucgugggggcgggagaaaaggcucucaaacugagcugguucaagaagggcucuagcaucgggaaaauguuugaggccacagcccgcggcgcucggagaauggccauucugggagauaccgcuugggacuucggcuccaucgggggaguguuuacgucugucggcaagcucgugcaucagaucuucgggaccgccuacggaguucuguuuagcggcguguccuggacaaugaaaauugggaucggcauucuucugaccuggcucggacugaacagccgcucuacaucccugagcaugaccuguaucgcggucggcauggugacacuuuaccucgggguuauggugcaggccgauucuggaugcgucauuaauuggaagggccgggaacugaaauguggguccggaaucuucgugaccaacgagguucacacguggacagaacaauauaaguuucaggcugacagcccuaagagacuguccgccgcuauuggcaaagccugggaggagggggugugcggcauccgcucugcgacccggcucgaaaacaucauguggaagcagauuagcaaugagcugaaccauauccuucuggaaaaugacaugaaauucaccgucguggugggagaugucuccggcauucucgcccaggggaagaaaacaaucagaccgcaacccauggagcacaaguacucuuggaaaagcuggggaaaggcuaagauuaucggcgccgacguucagaacaccacguuuaucauugaugggccuaauacacccgaauguccugacgaucagcgcgcuuggaacaucugggagguggaggacuauggauucggcauuuuuaccacaaauaucuggcugaaacugcgggauuccuacacccaggugugcgaccacagacuuaugagcgccgccauuaaggauucuaaagcuguccaugcggacaugggcuauuggaucgaauccgagaagaacgaaacauggaaacucgcccgcgcuagcuucaucgaggugaagaccuguguuuggcccaagucucacacgcugugguccaauggggugcuggaaagcgagaugauuaucccgaaaauuuacggaggcccuaucucucaacauaacuaucggcccggguacuucacccagacagccggaccuuggcaccucggcaagcuggagcuugauuuugaccugugcgaagggaccacagucgugguugaugagcacugcggaaauagaggccccagccuccggaccacgacagugaccggcaaaauuauccaugaaugguguugccgcuccuguacacugccuccccugagauucaagggggaggacggaugcugguacggcauggagauccggccggucaaagaaaaggaggaaaaccuugugaagagcaugguuucugccggguccggagagguggacagcuuuucccucggccugcuguguauuucuaucaugauugaagaggucaugagaagccgcuggucccggaaaaugcucaugaccgggacccuggugguguuccuucugcucacacugggacagcugacguggaaugaucuuaucagacugugcauuauggucggcgcuaacgccucugacaauaugggcauggggaccacauaucucgcgcugauggcuaccuuucgcaugagaccuauguucgccguuggacuccuguuucggcgccuuacaagcagagaggugcugcuccugaccgugggccugucccuugucgccucuguggaacugcccaacagccucgaugagcugggggacggacucgcuaugggcaucaugauucugaagcuucugacggauuuccaaucccaccagcucugggccacacugcugagccuuaccuuuguuaaaaccacacugucucuccauuacgcguggaagaccauggcuaugauccuguccaucgugagccucuucccccugugucuuucuacaacgucccagaaaaccacauggcugccuguccugcucgggagccugggaugcaagccgcuuaccauguuucugauuacagaaaacaagaucuggggccggaaaucuuggccccucaaugagggcauuauggccguggggaucguuuccauucugcucagcucccugcuuaagaacgacgugccucuggccggaccccugaucgcuggcgggaugcucaucgccuguuaugucauuagcggaucuagcgcugaucugucccuugaaaaagccgcgaaggugucuugggaggaggaagccgagcacagcggcgcuucccauaauauccuggucgaaauucaggacgaugggaccaugaaaaucaaggacgaggaacgcgaugacacgauuaccauccuccugaaagccacacuccuggcuaucucuggaguguacccuaugagcauucccgccacccuuuucguuuggcacuuuuggcaaaagaagaaacagagauccggcgugcugugggauacaccuucucccccggaggucgagaaggccgugcuggacgacggcaucuaucggauucuccagcgcgggcugcuuggaagaagccagguuggcgugggggucuuccaagaaggaguguuccacaccauguggcaugugacacggggcgcuguucugauguaccaggggaaacgccucgagccuuccugggcgagcgucaagaaagaucugaucucuuauggaggcggcuggagauuucagggguccuggaacacgggagaagaggugcaggugauugccgucgagcccggcaagaauccuaagaacgugcaaaccgcucccgggaucuucaaaacaagcgaaggagagguuggcgccauugcccucgacuuuaagccggggaccucuggauccccuaucgugaaucgggaaggcaaaaucgucggccuguacgggaacggagugguuaccacaagcggcacguacguguccgcuauugcccaggcgaaggcuucucaggaggggccccuuccugaaaucgaggaugaggucuucagaaaacgcaaucugaccauuauggaccugcaccccggaagcggcaagacacggagauaucuccccgccaucgugcgcgaagccauuaagcggaaacugagaacccuuguucuggcuccuacacgcguggucgccuccgagauggcggaagcucucaaggggaugccgauccgguaccaaaccacggccgugaaaagcgagcauacaggcaaggaaaucguggaucugaugugccacgccaccuuuaccaugagacugcucucucccguccgcguuccuaacuauaauaugauuaucauggacgaggcucauuucacagaucccgccuccauugcugcccggggauacaucagcaccagagugggcaugggggaggcggccgcuauuuuuaugacagccaccccucccggaucuguggaagcuuucccucagagcaacgccgucauccaggacgaggaaaaagauaucccggagcgguccuggaauucuggcuaugacuggauuacggauuuucccgggaagacagugugguucguuccuagcaucaaguccggaaacgacauugccaauugucuucgcaaaaacggcaagagagugauccagcugucucggaaaaccuuugacacagaauaccaaaagaccaaaaacaaugauugggacuaugucgugacgaccgauauuagcgagaugggggcuaacuuccgcgcggacagaguuaucgauccccggagaugccugaagccugugauucucaaggacggccccgagcgcgucauccuggccggaccgaugccugugacagucgcuuccgccgcccagcggagaggccgcaucgggcggaaucagaacaaagaaggagaucaguacauuuacaugggccaaccccuuaauaacgacgaggaucacgcucacuggaccgaagccaagaugcugcucgacaauaucaacacacccgaggggauuaucccugcgcuguucgagcccgaaagagagaaaagcgcugccauugauggagaauaucgccugcggggcgaggccagaaagaccuuuguggaacucaugcgcagaggggaccuuccuguuuggcugucuuacaaaguggcuuccgagggcuuccaguauagcgaucggcgcuggugcuuugacggagagagaaauaaccaggugcuggaagagaauauggacgucgaaaucuggacaaaggagggcgaacggaaaaagcuccgcccgagauggcuggaugcccggaccuacuccgacccccuugcgcugagagaguucaaggaguuugccgcugggcgccggucuguuagcuccgaucucauccuggaaauuggaaaacugccucagcaucucacgcaaagagcccagaacgcucuugacaaucuggugaugcugcacaacucugagcagggcgggaaggccuaucgccaugcuauggaagagcuccccgauacaaucgaaaccauuaugcugcuugcccugaucgcggugcucaccggaggcgucacacuguucuuucugagcggccgggggcucggaaaaaccuccauuggccuucugugugugacaagcucuuccgcccugcucuggauggcuaauguugagccucacuggaucgccgcuagcaucauucuggaguucuuucuuauggugcugcucauccccgaaccggacagacagcggacgccucaagauaaccagcuggccuacgucgugauugggcugcucuucaugauccuuaccgucgccgcuaacgagaugggacugcuggaaacaaccaagaaagaccucggcauugggcacacagcggccgagaaucaucaccaugcugccaugcuggauguggaccuucaccccgccucugcuuggacccuguaugccguugcgacgaccaucauuacaccuaugaugcgccauaccaucgagaacacaaccgccaauaucucccucacggcuauggccaaccaggcugccauucugaugggacuggauaagggcuggcccaucagcaagauggacauuggcgugccucuccuugcgcuggggugcuacucucaagucaauccccugacacucaccgccgcugugcugaugcuuguugcccacuacgcuaucauuggaccgggccugcaggccaaagcuacaagagaagcccagaagcggaccgcggccgggaucaugaaaaacccuaccguggauggaaucgucgcuauugaccucgaccccgugguguaugaugccaaguuugagaaacagcugggccaaaucaugcugcucauucuuuguacaagccagauccugcugaugcgcacgaccugggcucucugcgaauccauuacacuggccaccgggccccuuacaacccugugggagggaucuccuggcaaguucuggaauacgacaaucgccguuagcauggcgaacaucuuuagaggcuccuaccucgcuggggccggacuggcuuucagccugaugaagucccucggcgggggacggcgcggcaccggggcccagggagaaacccuuggcgagaaauggaagagacagcugaaucaacugucuaaaagcgaguucaacacauauaagcgguccggcauuaucgaagucgaccgcucugaggccagagaagggcucaaacggggagagaccacaaagcacgcugugagcagaggcacggccaagcugcgcugguuuguggaacggaaucuugucaaaccggaggggaagguuauugaucugggauguggcagagggggaugguccuacuauugcgcgggccucaaaaaggugaccgaggugaaaggcuacacaaaggggggacccggccaugaagagccuauccccauggccaccuauggguggaaccuggucaaacugcacucuggaaaggacguguucuuuauuccucccgaaaagugugauacacuccuuugcgacaucggcgagagcuccccuaauccgaccauugaagaggggcgcacgcugcggguucugaaaaugguggagcccuggcucagaggaaaccaguucuguaucaagauccugaauccuuacaugcccagcgucguggaaacccuugagcagaugcagcgcaaacauggcggcaugcugguucggaacccucucucuagaaauuccacacacgaaauguacugggugagcugcgggaccggaaacauugucucugcugugaacaugacaucccgcaugcugcugaaucgguuuaccauggcccacagaaagcccacauaugagcgcgauguggaccucggcgcugggacccggcaugucgccguugagccggaaguggcgaaccuggauaucauuggacaaagaaucgagaauauuaaaaacgaacacaagagcacguggcauuacgacgaggauaauccuuauaagacaugggccuaccacggcucuuaugaagugaaacccuccgggagcgcuuccagcauggucaacggagugguucgccuucugaccaagcccugggacgugaucccuauggucacccagaucgccaugacagacacgacccccuucggccagcaaagaguguuuaaagagaagguugauacacggaccccuaaagcuaagcgcggcacagcccagauuauggaggugaccgcuaaguggcucuggggguuccugucuagaaauaaaaagccgcggaucuguacaagagaagaguuuacccggaaaguccgcagcaacgccgcgauuggagccguguucguugacgaaaaucaguggaacuccgcuaaggaggccguggaagaugagagauuuugggaccuuguccggcgcgagagagaacugcauaaacagggcaagugcgcuacgugcguguacaauaugauggggaagcgggagaaaaagcucggagaauucggcaaagccaaggggucucgcgccaucugguauauguggcugggcgcgagauuucuggaguucgaagcucucggauucaugaacgaggaucacugguuuagccgggagaauucccugucuggcgucgaaggggagggacuucacaaacugggcuacauucuccgcgacaucagcaagauccccgggggaaacauguacgccgaugacaccgccggcugggauacaagaauuaccgaagaggaccugcaaaaugaggcuaaaaucacagauauuauggaaccugagcaugcccuucuggcuaccuccaucuucaagcucacguaucagaacaaggugguucgggugcagcgccccgccaaaaacgggacagucauggacgugauuucuagacgggaucagcgcggcagcggacaagugggcaccuacgggcugaauacauuuaccaacauggaagcgcagcugaucagacagauggaguccgaaggaaucuucagcccuucugagcucgagacgcccaaucuggccggccggguucuugacuggcuggaaaagcacgggauugagagacuccgccggauggcuaucuccggagacgauuguguggucaaaccgauugacgauagauuugccaccgcucugacagcccuuaacgacaugggcaaggugcgcaaagauaucccucagugggaacccagcaagggguggaaugacuggcaacagguuccuuucugcucucaucacuuucaccagcugauuaugaaggauggccgggagaucgugguccccuguagaaaccaggacgaacucgugggacgcgcgcgggucucccaaggcgccggguggagccugagagagaccgcuugccugggaaaauccuaugcccagauguggcagcucauguacuuccaucgccgggaucugagacuugcugccaaugcuauuuguucugccgugccuguugacugggugcccacaagccgcaccacaugguccauccacgcgcaucaccaauggaugaccacggaggauaugcugagcgucuggaaccggguguggaucgaagagaauccguggauggaagacaagacacauguuucuuccugggaggacgugccuuaucucggcaaaagagaagaucaguggugcgggagccugauuggacuuaccgcccgggcuaccugggccacaaacauccaggucgccauuaaucaggugagacgccugaucggcaacgagaauuaccucgacuauaugaccucuaugaagcgguuuaaaaacgagagcgaucccgaaggggcucugugguga

SEQ ID NO: 19450 - RNA, 9879 nt, Artificial Sequence
  derived and/or modified CDS sequence (opt5) from DENV-1__JQ915076__SS-prME
agcgugaccaugcugcucaugcugcuucccaccgugcugacguuccaccucaccacaagaggcggggagccucauaugaucguuuccaagcaggaacggggaaagucucugcuuuuuaagaccagcgccggcgugaacaugugcacacugauugcuauggaccucggggagcugugugaugacaccaugacauacaaaugcccccgcaucaccgaaacggagcccgaugacguggauuguuggugcaaugccaccgaaacaugggucaccuauggaacauguucccagaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaggaacaagacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucacaccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacaaccggggccuccaccagccaagagacauggaaccgccaggaccuccuggucacguucaaaaccgcucacgccaagaagcaggaagugguugugcugggaucccaagagggcgccaugcacacagcucucaccggggcgacagaaauccagaccucuggaacgacaaccauuuuugccggccaucugaaaugcagacuuaagauggauaaacugacccucaaggggaugagcuaugucauguguacaggcuccuucaaacuggagaaggaaguggcugagacccagcacggaacaguucuggugcaggucaaguacgagggcacggacgccccgugcaaaaucccuuucagcucucaagaugaaaagggggugacccagaauggacggcuugugacagccaaccccaucguuaccgacaaagagaagccugucaauauugaagcugagccgcccuuuggcgaguccuauaucguggugggggccggagaaaaagcgcucaagcugagcugguucaagaaaggcucuagcauugggaagauguuugaggcuacagccagaggcgcccgccggauggcuauccugggagauaccgccugggacuucggcuccauugggggagucuuuacgucugugggcaaacucguucaucagaucuucgggaccgcuuacggagugcuguuuagcggcgucuccuggacaaugaagaucgggauuggcauccuucugaccuggcucggacugaacagcagaucuacaucccugagcaugaccuguauugccgugggcaugguuacacuuuaccucggggugaugguccaggcggauucuggaugcgugaucaauuggaaaggccgcgaacugaaguguggguccggaauuuucguuaccaacgaggugcacacguggacagaacaauauaaguuucaggccgacagcccuaaacggcuguccgcugccaucggcaaggcuugggaggagggggucugcggcauuagaucugccacccgccucgaaaacaucauguggaaacagaucagcaaugagcugaaccauauucuucuggaaaaugacaugaaguucaccgugguggucggagauguuuccggcauccucgcgcaggggaaaaagacaauucggccgcaacccauggagcacaaauacucuuggaaaagcuggggaaaggccaagaucauuggcgcugacgugcagaacaccacguuuaucaucgaugggccuaauacacccgaauguccugacgaucagagagccuggaacauuugggagguggaggacuauggauucggcaucuuuaccacaaauauuuggcugaagcugcgcgauuccuacacccaggucugcgaccaccggcuuaugagcgcugccaucaaagauucuaaggccgugcaugcugacaugggcuauuggauugaauccgagaaaaacgaaacauggaagcucgcgagagccagcuucaucgagguuaagaccuguguguggcccaaaucucacacgcugugguccaaugggguccuggaaagcgagaugaucauuccgaagaucuacggaggcccuauuucucaacauaacuaucgccccggguacuucacccagacagcuggaccuuggcaccucggcaaacuggagcuugauuuugaccugugcgaagggaccacagugguuguggaugagcacugcggacaucggggccccagccucagaaccacgacagucaccggcaagaucauucacgaaugguguugccgguccuguacacugccuccccugcgcuucaaaggggaggacggaugcugguacggcauggagaucagaccggugaaggaaaaggaggaaaaucuuguuaaaagcauggugucugccggguccggagaggucgacagcuuuucccucggccugcuguguaucucuauuaugaucgaagaggugaugcggagcagauggucccgcaagaugcucaugaccgggacccugguggucuuccuucugcucacacugggacagcugacguggaacgaucuuauucggcugugcaucaugguuggcgccaaugcuucugacaacaugggcauggggaccacauaucucgcccugauggcgaccuuuagaaugcgcccuauguucgcugugggacuccuguuuagacggcuuacaagccgcgaggugcugcuccugaccgucggccugucccuuguggccucuguugaacugcccaauagccucgaugagcugggggacggacucgccaugggcauuaugauccugaaacuucugacggauuuccaaucccaucagcucugggcuacacugcugagccuuaccuuugugaagaccacacugucucuccacuacgccuggaaaaccauggcgaugauucuguccaucgucagccuccugccccuuugucugucuacaacgucccagaagaccacauggcugccugugcuccuggggagccuuggaugcaagccgcugaccauguuccucaucacagaaaacaaaauuuggggcagaaagucuuggccccugaacgagggcaucauggcuguugggauuguguccauccuccugagcucccuucugaaaaaugacgucccucuggccggaccccucauugccggcgggaugcugaucgcuuguuaugugaucagcggaucuagcgccgaucuuucccuggaaaaggcugccaaagucucuugggaggaggaagcggagcauagcggcgccucccacaacauucucguggaaauccaggacgaugggaccaugaagauuaaagacgaggaacgggaugacacgaucaccauucugcucaaggcuacacugcuugccaucucuggaguuuacccuaugagcauccccgcuacccuguuuguguggcacuucuggcaaaagaaaaagcagcgcuccggcguccugugggauacaccuucucccccggagguggagaaagccguucucgacgacggcauuuauagaauccugcagcgggggcuucugggacgcagccaggugggcgucgggguguuucaagaaggaguguuccauaccauguggcacguuacaagaggcgccguccucauguaccaggggaagcggcuggagccuuccugggcuagcgugaaaaaggaucucauuucuuauggaggcggcuggcgcuuccagggguccuggaauacgggagaagaggugcaggucaucgcgguggagcccggcaagaacccuaaaaauguucaaaccgcccccgggacauuuaagaccagcgaaggagaggugggcgcuauugcccuggacuucaaaccggggaccucuggauccccuaucgucaacagagaaggcaagauugugggccuuuacgggaauggaguugugacaacgagcggcaccuacgucuccgccaucgcucaggccaaaacaucucaggaggggccccugccugaaaucgaggaugagguguuucggaagagaaaccugaccauuauggaccuccaucccggaagcggcaagacacgccgguaucugcccgcgaucguuagagaagcuauuaaacgcaaacuucggacccuggugcucgccccuacgagagucguggccuccgagauggcugaagcccugaaagggaugccgauccgcuaccaaacaaccgcggucaagagcgagcacaccggcaaagaaauugucgaucugaugugccaugcuacauucaccaugcggcuccuuucucccguuagagugccuaauuauaacaugaucaucauggacgaggcccacuuuacagaucccgccuccauugcugcccgcggauacaucagcacccgggugggcaugggggaggcugccgcgauuuucaugacggccacaccucccggaucugucgaggcuuuuccucagagcaaugccgugauccaggacgaggaaaaggauauuccggagagauccuggaacucuggcuaugacuggaucaccgauuuccccgggaagacaguuugguuugugccuagcaucaaauccggaaaugacauugcuaacugucugcggaagaauggcaaacgcgucauccagcugucuagaaagaccuucgacacggaauaccagaagaccaagaacaacgauugggacuaugugguuacaaccgauauuagcgagaugggggccaauuuucgggccgaccgcgugaucgaucccagacggugccucaagccugucauucugaaagacggccccgagagagugauccuugcuggaccgaugccugucacaguggcguccgccgcucagcgccggggcagaauugggcgcaaccagaauaaggaaggagaucaguacguuuacaugggccaaccccugaacaaugacgaggaucacgcccauuggaccgaagccaaaaugcuccuggacaacaucaauacacccgaggggaucauuccugcucuguucgagcccgaacgggaaaagagcgccgcgaucgauggagaauauagacuccgcggcgaggcucggaaaaccuucguggaacuuaugagacgcggggaccugccuguguggcugucuuacaaggucgccuccgagggcuuucaguauagcgauagacgguggugcuucgacggagagcgcaacaaucagguucucgaagagaacauggacguggaaauuuggacgaaagagggcgaaagaaagaagcugcggccgcgcuggcuugaugccagaacauacuccgacccccuggcucuccgggaguuuaaagaguucgccgcggggagacgcucugugagcggagaucugauccuggaaauuggcaagcucccucagcaccuuacccaacgggcccagaaugcucuggacaaccuggucaugcuccauaauuccgagcaagggggaaaagccuauagacacgcuauggaggaacugcccgauaccaucgaaacaaucaugcuucuggcccucauugcugugcugaccggcggcguuacacuguuuuuccucucugggcgcggacuuggcaagacgagcaucgggcugcugugugugaccuccagcucugcccuccuguggauggcguccgucgagccucacuggauugccgcuagcaucauucuugaguuuuuccugauggugcuccugauccccgaaccggaccggcagagaacaccucaagauaaccagcuggccuacgucgugaucggacuccuuuuuaugauucugaccguugcugccaaugagaugggccugcucgaaacaaccaaaaaggaccuggggaucggacauacggccgcugagaaccaccaucacgcggccaugcuugauguggaccugcaucccgcuucugccuggacccucuaugccgucgcuacaaccauuaucacaccuaugaugcggcacaccauugagaacacgacagccaauaucucccugaccgcgauugccaaccaggcugccauccugaugggccucgauaagggcuggcccaucagcaaaauggacauuggggugccucuucuggcucugggaugcuacucucaaguuaauccccucacacugaccgccgcggugcuuaugcuggucgcccacuacgcuaucauuggcccggggcuccaggccaaggcuacccgcgaagcccagaaaagaacagcugccggaaucaugaagaacccuacgguggauggcauuguggcgaucgaccuggaccccguugucuaugaugccaaauucgagaagcagcuggggcaaaucaugcuccuuauucuguguaccagccagauccugcucaugcggacaaccugggcucugugcgaauccauuacacuugccaccggaccccugacgacacucugggagggcucuccuggcaaguuuuggaauaccaccaucgcugugagcauggccaacauuuuccgcggguccuaccuggccggagcgggccuggcuuuuagccucaugaaaucccuugggggaggcagacgggggacaggagcccagggcgaaacccugggcgagaaguggaaacgccagcugaaucaacucucuaagagcgaguucaacaucuauaaaagauccgggaucauugaaguggaccggucugaggcuaaggaaggacugaagcgcggcgagacaacgaaacaugccgucagcagagggaccgccaaacuucggugguucguugaaagaaaucuggugaaaccggagggaaaggugaucgaucucggcugugggcgcggaggcugguccuacuauugcgcuggccugaaaaaggucacagaggugaaaggguacaccaagggaggccccgggcacgaggagccuauucccauggccacauauggauggaaccugguuaagcuccauucuggcaaagacguguuuuucaucccucccgaaaagugugauacccuucugugcgacauuggggagagcuccccuaauccgacgaucgaagagggacggacccugagaguccucaaaaugguggagcccuggcugcgcggcaaccaguuuuguauuaagauccuuaauccuuacaugcccagcguuguggaaacacuggagcagaugcagcggaaacacggcgggaugcucgucagaaacccucugucucgcaauuccacccacgaaauguacugggugagcugcggaacaggcaacaucgugucugcggucaauaugaccucccggaugcugcucaacagauucacaauggcccaucgcaagcccaccuaugagcgggauguugaccugggggcuggaacgagacacguggccguggagccggaagucgcuaaccuugauauuaucggccaacgcauugagaauaucaagaacgaacauaaaagcacauggcacuacgacgaggauaauccuuauaagaccugggccuaccaugggucuuaugaagugaaacccuccggaagcgcguccagcaugguuaacggcgugguccggcugcucaccaagcccugggacgugauuccuaugguuacacagaucgccaugacggacaccacacccuuuggccagcaaagaguguucaaagagaaggucgauacccgcacaccuaaggcuaaaagagggaccgcccagaucauggaggugacagcuaaguggcuguggggauuucuuucucggaauaaaaagccgcgcauuuguaccagagaagaguucacgcggaaaguuagaagcaacgccgcuaucggcgccguguuugucgacgaaaaucaguggaacuccgcgaaggaggccguggaagaugagcgguucugggaccugguccgcagagagcgggaacuccacaagcaggggaaaugcgcuaccugcguguacaauaugaugggaaagcgcgagaaaaagcugggcgaauuugggaaagccaagggcucuagagcuauuugguauauguggcugggagcccgguuccucgaguuugaagcccugggcuucaugaacgaggaucacugguucagccgcgaaaauucccuuucugggguugaaggagagggccugcauaaacucggguacauccugagagacauuagcaagauccccggaggcaacauguacgcggaugacacagcugggugggauacccggaucacagaagaggaccuucaaaaugaggccaagauuaccgauaucauggaaccugagcacgcccugcucgcuacguccauuuuuaaacugacauaucagaacaaggugguccgcgugcagagacccgccaaaaauggcaccgugauggacguuaucucucggcgcgaucagagaggaagcggccaaguggggacauacggacugaacaccuucacgaacauggaagcucagcucauucggcagauggaguccgaaggcaucuuuagcccuucugagcuggagacccccaaucuugccgggcgcguccuggacuggcucgaaaagcauggaaucgagagacugcggagaauggcgauuuccggcgacgauugugugguuaaaccgaucgacgaucgcuucgccacagcucuuaccgcccugaacgacauggggaaggugcggaaggauauuccucagugggaacccagcaaaggcuggaaugacuggcaacaggucccuuuuugcucucaccacuuccaucagcucaucaugaaggauggaagagagauugugguccccugucgcaaccaggacgaacuggugggccgggcuagaguuucccaaggggccggauggagccugcgcgagacagcgugccucggcaaauccuaugcccagauguggcagcugauguacuuucaccggagagaucuucgccuggcugccaaugcuaucuguucugccgugccugucgacugggugcccaccagccggacaaccugguccauucaugcucaccaucaauggaugacgacagaggauaugcucagcguuuggaacagaguguggaucgaagagaauccguggauggaagacaagacccacgucucuuccugggaggacgugccuuaucuggggaaacgcgaagaucaguggugcggaagccuuaucggccugaccgcccgggcgacaugggccaccaacauucagguggcuaucaaucagguuagacggcucauugggaacgagaauuaccuggacuauaugacaucuaugaagagauucaagaacgagagcgaucccgaaggcgcccugugguga

SEQ ID NO: 19451 - RNA, 9879 nt, Artificial Sequence
  derived and/or modified CDS sequence (opt5) from DENV-1__KF289072__SS-prME
agcgugaccaugcugcucaugcugcuucccacagcccuggcuuuccaccucacgaccagaggcggggagccucauaugaucgucuccaagcaggaacggggaaagucucugcuuuuuaagacaagcgccggcguuaacaugugcacccugauugcgauggaccucggggagcugugugaagauacaaugaccuacaagugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaggaacaagaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuaagggggaggauggaugcugguacggcauggagauccggccggugaaagaaaaggaggaaaaccucguuagauccauggugagcgccgggucuggagaggucgacuccuucagccugggccugcucuguguguccauuaugaucgaagagguuaugcgcucucgguggagcagaaagaugcugaugacagggacccuugcgguguuuuuccugcucauuaugggacagcugaccuggaaugaccugauccgccuuugcauuauggucggcgcuaacguguccgauagaaugggcauggggacaacguaucuggcccucauggccaccuuuaaaaugcggccuauguucgcugugggacugcucuuucgcagacugacaucucgggagguccuucugcucaccaucggccugagccugguugccuccguggaacuucccaacucucuggaggaacucggggacggacuggcgaugggcauuaugaugcucaagcugcuuacagauuuccaaagccaccagcuguggaccacgcuccugucccugacauuuaucaaaaccacccuuagccuggacuacgcuuggaagacaauggccauggugcucucuaucgucucccuguucccccucugucugagcaccacaucucagaaaacgaccuggcuuccugugcugcugggguccuuuggaugcaagccgcucacaauguuccugauuaccgagaauaagaucuggggccgcaaaagcuggccccuuaacgaaggcauuauggccguugggaucgugucuauucugcucuccagccugcucaagaaugaugucccucuggcuggaccccuuaucgccggcgggaugcugaucgcuuguuaugugauuuccggaagcucugccgaccugagccucgagagagcggccgagguuuccugggaagaggaagcugagcauucuggcgccagccacaacauccugguggaaguccaggaugacgggacaaugaaaauuaaggaugaggagcgggacgauacccuuacgauccugcucaaagcuacccugcucgccguguccggagucuacccuaugucuauucccgccacacuguuugugugguauuucuggcaaaagaaaaagcagcgcagcggcguucuuugggacaccccuagcccucccgaaguggagagagcuguccuggaugacggcaucuaccggauccugcagcgcgggcuccugggaagaucucaggugggcguugggguguuccaagacggagucuuucauacaauguggcacgugacccggggcgcggugcuuauguaucaggggaagagacuggaacccagcugggccuccguuaaaaaggaucucauuagcuacggaggcggcuggcgcuuccaggggucuuggaauacaggagaggagguccaggugaucgcuguggaacccggcaaaaacccuaagaauguccaaacgacccccgggacauuuaaaaccccggagggagccgugggcgccauugcucuggacuucaagccugggaccuccggaagccccaucguuaaccgggaaggcaagauugugggccucuacgggaauggagucgugacaacgucuggcaccuauguuuccgccaucgcgcaggcuaaagccagccaggaggggccucugcccgaaauugaggaugagguguuuaagaaaagaaaccuuacaaucauggaccugcaccccggauccggcaagacccgccgguaccugccugccaucgucagagaagcuauuaaacgcaagcuccggacacugauccuugccccgaccagagugguugcgucugagauggcugaagcccugaaggggaugcccauucgcuaucaaacgacagccgugaaaagcgagcauaccggcaaggaaaucgucgaucucaugugccacgcuaccuucacaaugcggcugcuguccccugugagagugcccaauuacaacaugauuaucauggacgaggcccauuuuaccgauccugcuagcaucgccgcgcggggauauauuucuacacgcgucggcaugggggaggccgcugccaucuucaugaccgcuacgcccccuggauccguugaagccuuuccgcagagcaaugccgugauucaggacgaggaaagagauauccccgagcggucuuggaacagcggcuacgacuggauuacagauuucccugggaaaaccgugugguuuguccccuccaucaagucuggaaaugacaucgcuaacugucuccgcaaaaacggcaagagagugauucagcuuagccggaagacauucgacaccgaauaucagaagacgaagaauaacgauugggacuacguugugaccacagauaucuccgagaugggggcgaauuucagagccgaccgcgucauugauccucggagaugccugaaacccgugauccugaaggacggcccggagcgcguuauucucgcuggaccuaugcccgugaccgccgccucugcugcccagcggagaggccgcaucgggcggaaccagaauaaagaaggagaucaguacauuuauaugggccaaccccugaacaaugacgaggaucacgcgcauuggacagaagcuaagaugcuucuggacaacaucaauaccccugaggggaucauucccgcccucuuugagccugaaagagaaaaguccgccgcuaucgauggagaauaccgccugagaggcgaggcccggaaaacauucgucgaacugaugcgcagaggggaccucccgguguggcuuuccuauaaggucgcgagcgagggcuuucaguacucugaucggcgcuggugcuucgacggagagagaaacaaucaggugcuggaagagaacauggacguugaaauuuggaccaaagagggcgaacggaagaaacugagaccccgcuggcucgaugcccggacguauuccgacccucuggcucuuagagaguuuaaggaguucgccgcugggcgccggagcguguccggagaucugauccucgaaauuggcaaacugccccagcaccugacacucagagcccaaaaugcucuugacaaccuggugaugcugcacaauucugagcaagggggaaaggccuaccggcaugcgauggaggagcucccugauaccaucgaaacccugaugcuucuggcccucaucgcuguccugacaggcggcguuacccuguuuuuccucagcgggaagggacuuggcaaaacauccauugggcugcugugugugauggccucuagcgugcuccuguggauggcuuccgucgagccccacuggaucgccgccagcauuauccuugaguuuuuccugauggugcuccugauuccggaaccugaccgccagagaacgccccaggauaaccaacuggcuuauguugugaucggacuccuuuuuaugauccugaccgucgcggccaacgagaugggccugcucgaaacaaccaagaaagaccuggggauuggacauguggucgcugagaaucaccaccaugccacaaugcuugauaucgaccugcacccugccucugcuuggacccucuacgccguggcgacgaccauuaucacacccaugaugcggcauaccauugagaacacaaccgccaauaucucccugacggcuauugccaaccaggcugccauccugaugggccucgauaagggcuggccuaucagcaaaauggacauugggguuccccuucuggcgcugggaugcuacucucaggugaauccgcucacacugaccgccgcuguccuuaugcugguggcccacuaugcuaucauuggcccugggcuccaagccaaggcuacacgcgaagcccagaagagaaccgcggccggaaucaugaaaaaccccaccguugauggcauuguggcuaucgaccuggaccccgucguguacgaugccaaguucgagaaacagcuggggcagaucaugcuccuuauucuguguacaucccaaauccugcucaugcggacgaccugggcucugugcgaaagcauuacacuugccaccggaccucugacaacccucugggagggcucuccgggccgcuuuuggaauacgacaaucgccgugagcauggcgaacauuuucagaggguccuaucuggcuggagccggccuggcuuucucucucaugaaaagccuugggggaggccggcgcgggaccggagcccagggcgaaacccugggcgagaaauggaagagacagcugaaucagcucuccaagagcgaguuuaacacauacaaacgguccgggaucauggaaguugacagaucugaggccaaggaaggacugaaacgcggcgagaccacaaagcaugcugucagccgggggacggccaaacuuagaugguucguggaacgcaaucuggugaagcccgagggaaaggucaucgaucucggcugugggcggggaggcugguccuauuacugcgcgggccugaaaaagguuaccgaggugaaaggguauacaaagggaggcccugggcacgaggagcccauuccuauggccaccuacggauggaacaucgugaaacugcacucuggcagagacgucuuuuucacacccccugaaaagugugauacccuccuuugcgacauuggggagagcuccccgaaucccacgaucgaagagggacgcacccugcgggugcugaaaaugguugagccuuggcucagaggcaaccaauuuuguauuaagauccugaaucccuacaugccuucuguggucgaaacacuugagcagaugcagcgcaagcauggcgggaugcuggugcggaacccccucagcagaaauuccacccacgaaauguauuggguuagcugcggaacaggcaacauugugucugcugucaacaugaccucccgcaugcugcugaaucgguucacaaugacccauagaaaaccgacguacgagcgcgauguggaccucggggccggaacaagacacguggcugucgagccugaaaucgccaaccuggauaucauuggccagcggaucgagaauauuaagaacgaacacaaaagcaccuggcauuaugacgaggauaaucccuacaagaccugggcguaucacgggucuuacgaaguuaaacccuccggaagcgccucuuccauggugaacggcgugguccgccuucugacaaagccuugggacgugauccccaugguuacgcaaauugcuaugaccgacacaaccccuuuuggccagcagagaguguucaaggagaaagucgauacacggaccccgagacccaagcgggggacagcccaaaucauggaggugaccgcuaaauggcucuggggauuucugagccgcaauaagaaaccuagaaucuguacgcgggaagaguucacccgcaagguuagauccaacgccgcuauuggcgccguguuugucgacgaaaaucaguggaacagcgcgaaggaggccguggaagaugagcgguucugggaccuuguucaucgcgagagagaacugcacaaacaggggaagugcgcuacaugcguguauaauaugaugggaaaacgggagaagaaacucggcgaauuugggaaggccaagggcucucgcgcuaucugguacauguggcugggagccagauuccuggaguucgaagcccucggcuuuaugaacgaggaucauugguucagccgggaaaauucccugucuggggucgaaggagagggccuucacaaacugggguacauucuccgcgacaucagcaagauucccggaggcaacauguaugcggaugacaccgcugggugggauacaagaaucaccgaagacgaucugcagaaugaggccaaaaucacggacauuauggagccugaacacgcccuucuggcuacauccaucuuuaagcucaccuaccaaaacaaagugguccgggugcagcgccccgccaagucuggcacaguuauggaugugauuagcagacgggaccagagaggauccggccaggucgggaccuauggacugaacacguucaccaauauggaggugcaacugauccgccagauggaaucugagggcauuuuuagcccguccgaacucgagaacagcaaucuggcugagcgggugcuugacuggcuggaaaaacaugggguugagagacucaagcgcauggccaucucuggagaugacuguguggucaagccuacagaugaccgguucgcgaccgcccugacagcucuuaacgauaugggcaaagugagaaaggacaucccccagugggaaccuuccaaaggguggaaugauuggcagcaaguucccuuuugcagccaccauuuccaccagcugauuaugaaggacggccgcgagaucguggucccuugucggaaccaggaugaacucgugggcagagcucgcgucucucagggagcuggguggucccugcgggagaccgccugccugggaaaaagcuacgcgcaaauguggcagcucauguauuuucacagacgcgaccugcggcuugccgcuaaugccauuuguuccgcugugcccguugauugggugccgacaucuagaaccacguggagcauccaugcccaccaucaguggaugacaaccgaggacaugcuguccgucuggaaccggguguggauugaagagaauccuuggauggaagacaagacccacguuagcucuugggaggaugugcccuaccucggcaagagagaagaccaauggugcgggucccugaucggacuuacagcucgcgccaccugggcgacaaacauucaggucgccaucaaucaggugcggagacugaucggcaacgagaauuaucucgauuacaugacgagcaugaaacgcuucaagaacgagucugacagcgaaggggcucugugguga

SEQ ID NO: 19452 - RNA, 9879 nt, Artificial Sequence
  derived and/or modified CDS sequence (opt5) from DENV-1__JQ692085__SS-prME
agcgugaccaugcugcucaugcugcuucccacagcucuggcuuuccaccucacgacccggggcggggagccucauaugaucgucuccaagcaggaacggggaaagucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaggagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaggauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaagcgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagccgugggcgccauugcucuggacuucaaaccugggaccuccggaagccccaucguuaacagagaaggcaagauugugggccucuacgggaauggagucgugacaacgucuggcaccuauguuuccgccaucgcgcaggcuaaggccagccaggaggggccucugcccgaaauugaggaugagguguuuaaaaagcgcaaccuuacaaucauggaccugcaccccggauccggcaaaacccggagauaccugccugccaucguccgcgaagcuauuaagcggaaacucagaacacugauccuugccccgacccgcgugguugcgucugagauggcugaagcccugaaggggaugcccauucgguaucaaacgacagccgugaaguccgagcauaccggcaaagaaaucgucgaucucaugugccacgcuaccuucacaaugagacugcuguccccugugcgggugcccaauuacaacaugauuaucauggacgaggcccauuuuaccgauccugcuagcaucgccgcgcgcggauauauuucuacaagagucggcaugggggaggccgcugccaucuucaugaccgcuacgcccccuggauccguugaagccuuuccgcagagcaaugccgugauucaggacgaggaacgggauauccccgagcgcucuuggaacagcggcuacgacuggauuacagauuucccugggaagaccgugugguuuguccccuccaucaaaucuggaaaugacaucgcuaacugucucagaaagaacggcaaacgggugauucagcuuagcagaaagacauucgacaccgaauaucaaaagacgaaaaauaacgauugggacuacguugugaccacagauaucuccgagaugggggcgaauuuccgcgccgaccgggucauugauccuagacgcugccugaagcccgugauccugaaagacggcccggagcggguuauucucgcuggaccuaugcccgugaccgccgccucugcugcccagagacgcggccggaucgggagaaaccagaauaaggaaggagaucaguacauuuauaugggccaaccccugaacaaugacgaggaucacgcgcauuggacagaagcuaaaaugcuucuggacaacaucaauaccccugaggggaucauucccgcccucuuugagccugaacgcgaaaagagcgccgcuaucgauggagaauacagacugcggggcgaggcccgcaagacauucgucgaacugaugagaagaggggaccucccgguguggcuuuccuauaaagucgcgagcgagggcuuucaguacucugaucgcagauggugcuucgacggagagcggaacaaucaggugcuggaagagaacauggacguugaaauuuggaccaaggagggcgaacgcaagaagcugcgcccccgguggcucgaugccagaacguauuccgacccucuggcccuucgcgaguuuaaagaguucgccgcugggcggagaagcguguccggagaucugauccucgaaauuggcaagcugccccagcaccugacacuccgggcccaaaaugcucuugacaaccuggugaugcugcacaauucugagcaagggggaaaagccuaccgccaugcgauggaggagcucccugauaccaucgaaacccugaugcuucuggcccucaucgcuguccugacaggcggcguuacccuguuuuuccucagcgggaagggacuuggcaagacauccauugggcugcugugugugauggccucuagcgugcuccuguggauggcuuccgucgagccccacuggaucgccgccagcauuauccuugaguuuuuccugauggugcuccugauuccggaaccugacagacagcggacgccccaggauaaccaacuggcuuauguugugaucggacuccuuuuuaugauccugaccgucgcggccaacgagaugggccugcucgaaacaaccaaaaaggaccuggggauuggacauguggucgcugagaaucaccaccaugccacaaugcuugauaucgaccugcacccugccucugcuuggacccucuacgccguggcgacgaccauuaucacacccaugaugcgccauaccauugagaacacaaccgccaauaucucccugacggcuauugccaaccaggcugccauccugaugggccucgauaaaggcuggccuaucagcaagauggacauugggguuccccuucuggcgcugggaugcuacucucaggugaauccgcucacacugaccgccgcuguccuuaugcugguggcccacuaugcuaucauuggcccugggcuccaagccaaagcuacaagagaagcccagaagcggaccgcggccggaaucaugaagaaccccaccguugauggcauuguggcuaucgaccuggaccccgucguguacgaugccaaauucgagaagcagcuggggcagaucaugcuccuuauucuguguacaucccaaauccugcucaugcgcacgaccugggcucugugcgaaagcauuacacuugccaccggaccucugacaacccucugggagggcucuccgggcagauuuuggaauacgacaaucgccgugagcauggcgaacauuuuccggggguccuaucuggcuggagccggccuggcuuucucucucaugaaaagccuugggggaggccgcagagggaccggagcccagggcgaaacccugggcgagaaguggaaacggcagcugaaucagcucuccaagagcgaguuuaacacauacaagagauccgggaucauggaaguugaccgcucugaggccaaagaaggacugaagcggggcgagaccacaaaacaugcugucagcagagggacggccaaacuucgcugguucguggaacggaaucuggugaaacccgagggaaaggucaucgaucucggcugugggagaggaggcugguccuauuacugcgcgggccugaagaaaguuaccgaggugaagggguauacaaaaggaggcccugggcacgaggagcccauuccuauggccaccuacggauggaacaucgugaagcugcacucuggccgcgacgucuuuuucacacccccugaaaaaugugauacccuccuuugcgacauuggggagagcuccccgaaucccacgaucgaagagggacggacccugagagugcugaagaugguugagccuuggcuccgcggcaaccaauuuuguauuaaaauccugaaucccuacaugccuucuguggucgaaacacuugagcagaugcagcggaagcauggcgggaugcuggugagaaacccccucagccgcaauuccacccacgaaauguauuggguuagcugcggaacaggcaacauugugucugcugucaacaugaccucccggaugcugcugaauagauucacaaugacccaucgcaagccgacguacgagagagauguggaccucggggccggaacacggcacguggcugucgagccugaaaucgccaaccuggauaucauuggccagcgcaucgagaauauuaaaaacgaacacaagagcaccuggcauuaugacgaggauaaucccuacaaaaccugggcguaucacgggucuuacgaaguuaagcccuccggaagcgccucuuccauggugaacggcguggucagacuucugacaaaaccuugggacgugauccccaugguuacgcaaauugcuaugaccgacacaaccccuuuuggccagcagcggguguucaaggagaaggucgauacaagaaccccgcggcccaaacgcgggacagcccaaaucauggaggugaccgcuaaguggcucuggggauuucugagcagaaauaaaaagccucggaucuguacgcgcgaagaguucaccagaaaaguucgguccaacgccgcugugggcgccgucuuuguggacgaaaaucaguggaacagcgcgaaggaggccguugaagaugagcgcuucugggaccuugugcauagagagcgggaacugcacaagcaggggaaaugcgcuacaugcgucuauaauaugaugggaaagcgcgagaaaaagcucggcgaauuugggaaagccaagggcucuagagcuauuugguacauguggcugggagcccgguuccuggaguucgaagcccucggcuuuaugaacgaggaucauugguucagccgcgaaaauucccugucugggguggaaggagagggccuucacaagcugggguacauccucagagacauuagcaaaauccccggaggcaacauguaugcggaugacaccgcugggugggauacacggauuaccgaagacgaucugcagaaugaggccaagaucacggacaucauggagccugaacacgcccuucuggcuacauccauuuuuaaacucaccuaccaaaacaaggucgugcgcguucagagacccgccaaaucuggcacagugauggaugucaucagccggagagaccagcgcggauccggccagguggggaccuauggacugaacacguucaccaauauggaggugcaacugauucggcagauggaaucugagggcaucuuuagcccgaacgaacucgaaaauuccaaccuggcugagagaguucuugacuggcuggaaaagcaugggguggagcgccucaaacggauggccauuagcggagaugacugugucgugaagccuacagaugacagauucgcgaccgcccugacagcucuuaaugauaugggcaagguucgcaaagacaucccccagugggaaccuucuaagggguggaacgauuggcagcaagugcccuuuugcucccaccauuuccaccagcugaucaugaaagacggccgggagauugucgugccuuguagaaaucaggaugaacucgucggacgcgcccgggugagccagggcgcuggguggucucugagagagaccgccugccugggaaaguccuacgcgcaaauguggcagcucauguauuuucaccgccgggaccugagacuugccgcuaacgccaucuguagcgcuguucccguggauugggucccgacaucccggaccacguggucuauucaugcccaccaucaguggaugacaaccgaggacaugcugagcguguggaauagaguuuggaucgaagagaacccuuggauggaagacaaaacccacguguccagcugggaggauguccccuaccucggcaagcgcgaagaccaauggugcgggucucugauuggacuuacagcucgggccaccugggcgacaaauauccagguggccauuaaccaggugagacgccugaucggcaaugagaacuaucucgauuacaugacguccaugaagagauucaaaaaugagagcgacucugaaggggcucugugguga

SEQ ID NO: 19453 - RNA, 9879 nt, Artificial Sequence
  derived and/or modified CDS sequence (opt5) from DENV-1__JQ917404__SS-prME
agcgugaccaugcugcucaugcugcuucccacagcucuggcuuuccaccucacgacccggggcggggagccucauaugaucgucuccaagcaggaacggggaaagucucugcuuuuuaagacaagcgccggcguuaacaugugcacccugauugcgauggaccucggggagcugugugaagauacaaugaccuacaagugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacacggaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaagcgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccagagaaggcgagcgcaagaaacugcggcccagauggcucgaugcgcgcacguauuccgacccucuggcccuucgggaguuuaaggaguucgcugccgggagacggagcguguccggagaucugauccucgagauuggcaaacugccccagcaccugacacuccgcgcucaaaaugcccuugacaaccuggugaugcugcacaauucugaacaagggggaaaggcuuacagacaugccauggaggaacucccugauaccaucgagacccugaugcuucuggcgcucaucgccguccugacaggcggcguuacccuguuuuuccucagcgggaaaggacuuggcaagacauccauugggcugcugugugugauggcuucuagcgugcuccuguggauggccuccgucgagccccacuggaucgcugccagcauuauccuugaauuuuuccugauggugcuccugauuccggagccugaccggcagcgcacgccccaggauaaccaacuggccuauguugugaucggacuccuuuuuaugauccugaccgucgcugcgaacgaaaugggccugcucgagacaaccaagaaagaccuggggauuggacauguggucgccgagaaucaccaccaugcuacaaugcuugauaucgaccugcacccugccucugccuggacccucuacgcuguggccacgaccauuaucacacccaugaugagacauaccauugaaaacacaaccgcgaauaucucccugacggccauugcuaaccaggccgcuauccugaugggccucgauaagggcuggccuaucagcaaaauggacauugggguuccccuucuggcccugggaugcuacucucaggugaauccgcucacacugaccgcggccguccuuaugcugguggcucacuaugccaucauuggcccugggcuccaagcuaaggccacacgggaggcucagaaacgcaccgccgcgggaaucaugaagaaccccaccguugauggcauuguggccaucgaccuggaccccgucguguacgaugcuaaguucgaaaaacagcuggggcagaucaugcuccuuauucuguguacaucccaaauccugcucaugagaacgaccugggcccugugcgagagcauuacacuugcuaccggaccucugacaacccucugggaaggcucuccgggccgguuuuggaauacgacaaucgccgugagcauggccaacauuuuccgcggguccuaucuggcgggagcuggccuggccuucucucucaugaaaagccuugggggaggcagacgggggaccggagcucagggcgagacccugggcgagaaauggaagagacagcugaaucagcucuccaaaagcgaauuuaacacauacaagcgcuccgggaucauggagguugaccggucugaagccaaggagggacugaaaagaggcgaaaccacaaagcaugccgucagccgcgggacggcuaaacuucggugguucguggagagaaaucuggugaagcccgagggaaaagucaucgaucucggcugugggcgcggaggcugguccuauuacugcgccggccugaagaagguuaccgaagugaaaggguauacaaagggaggcccugggcacgaggaacccauuccuauggcgaccuacggauggaacaucgugaaacugcacucuggccgggacgucuuuuucacacccccugagaagugugauacccuccuuugcgacauuggggaaagcuccccgaaucccacgaucgaggagggaagaacccugcgcgugcugaaaaugguugaaccuuggcuccggggcaaccaauuuuguauuaagauccugaaucccuacaugccuucuguggucgagacacuugaacagaugcagagaaaacauggcgggaugcuggugcgcaacccccucagcagaaauuccacccacgagauguauuggguuagcugcggaacaggcaacauugugucugccgucaacaugaccuccagaaugcugcugaaucgcuucacaauggcucauagaaagccgaccuacgagcgggauguggaccucggggccggaacgcgccacguggcugucgaaccugagaucgccaaccuggauaucauuggccagagaaucgaaaauauuaagaacgagcacaaaagcacauggcauuaugacgaagauaaucccuacaagaccugggcguaucacgggucuuacgagguuaaacccuccggaagcgccucuuccauggugaacggcgugguccggcuucugaccaagccuugggacgugauccccaugguuacacaaauugcuaugacggacaccacaccuuuuggccagcagagaguguucaaagagaaggucgauacccggacaccgcgccccaagagagggaccgcccaaaucauggaagugacagcuaaauggcucuggggauuucugagccggaauaagaaaccucgcaucuguaccagagaggaguucacgcggaagguucgcuccaacgccgcuauuggcgccguguuugucgacgagaaucaguggaacagcgcgaaagaagccguggaggaugagagauucugggaccuuguucaucgggaacgcgagcugcacaagcaggggaagugcgcuaccugcguguauaauaugaugggaaaaagagaaaagaaacucggcgaguuugggaaggccaaaggcucucgggcuaucugguacauguggcugggagcccgcuuccuggaguucgaggcccucggcuuuaugaacgaggaucauugguucagcagagaaaauucccugucuggggucgagggagaaggccuucacaagcugggguacauucuccgggacaucagcaagauucccggaggcaacauguaugcggaugacacagcugggugggauacccgcaucacagaggacgaucugcagaaugaggccaaaaucaccgacauuauggaaccugagcacgcccuucuggcuacguccaucuuuaagcucacauaccaaaacaaaguggucagagugcagcggcccgccaagucuggcaccguuauggaugugauuagcagacgcgaccagcggggauccggccaggucgggacauauggacugaacaccuucacgaauauggaagugcaacugaucagacagauggagucugaaggcauuuuuagcccguccgagcucgagaacagcaaucuggcugaacgcgugcuugacuggcuggagaaacaugggguugaacggcucaagagaauggccaucucuggagaugacuguguggucaaaccuaccgaugaccgcuucgcgacagcccugaccgcucuuaacgauaugggcaaggugcggaaggacaucccccagugggagccuuccaaaggguggaaugauuggcagcaaguucccuuuugcagccaccauuuccaccagcugauuaugaaggacggcagagaaaucguggucccuugucgcaaccaggaugagcucgugggacgggccagagucucucagggcgcuggguggucccugcgcgagacagccugccugggaaaaagcuacgcgcaaauguggcagcucauguauuuucaccggagagaccugcggcuugccgcuaaugccauuuguuccgcugugcccguuaacugggugccgaccucuagaacaaccuggagcauccaugcccaccaucaguggaugacgacagaagauaugcuguccgucuggaaucgcguguggauugaggaaaacccuuggauggaggacaagacccacguuagcucuugggaagacgugcccuaccucggcaaacgggaggaucaauggugcgggucccugaucggacuuaccgcuagagccacaugggcgaccaauauucaggucgccaucaaccaggugcgcagacugaucggcaaugagaacuaucucgacuacaugacaagcaugaagcgguucaagaaugaaucugaucccgagggggcucugugguga

SEQ ID NO: 19454 - RNA, 9879 nt, Artificial Sequence
  derived and/or modified CDS sequence (opt5) from DENV-1__GU370048__SS-prME
agcgugaccaugcugcucaugcugaugcccacagcucuugcuuuccaccugacgaccagaggcggggaaccucauaugaucgucuccaagcaagaacgggggaaaucucuccuguuuaagacaagcgccggcguuaacaugugcacccuuauugcgauggaccugggggagcucugugaagauacacugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaagacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccugaacuucaaugaaauggugcuucugacgaugaaggagaaauccuggcucguccauaagcagugguuucuggaccuuccucugcccuggacaagcggggcuuccaccacacaagagaccuggaaccgccaggaucuccuggugaccuucaaaacagcgcacgccaagaagcaggaagucgugguucugggaucucaagagggcgcuaugcacacggcccucaccggggccacagaaauucagaccagcggaacaaccacgaucuuugcuggccaucugaaaugcagacuuaagauggacaaacugacacucaaggggauguccuaugugauguguaccggcagcuucaaacuggagaaggaagucgccgagacccagcacggaacagugcugguucagauuaaguacgagggcaccgaugcgccgugcaaaaucccuuucucuacacaagacgaaaagggggugacgcagaauggacggcuuaucaccgcuaaccccauugucacagauaaagagaagccugugaauaucgaagccgagccgcccuuuggcgaguccuauauugugaucggggccggagaaaaagcucucaagcugagcugguucaagaaaggcucuagcauugggaagauguuugaggccaccgcuagaggcgcccgccggauggcgauccugggagacacagccugggauuucggcuccaucgggggaguuuuuaccucugucggcaaacucgugcaucagauuuucgggacggcuuacggagugcuguuuagcggcgucuccuggaccaugaagaucgggauuggcgugcuucugacauggcucggacugaacagcagaucuaccucccugagcaugacauguaucgccguuggccuugugacccucuaccugggggucauggugcaggcugacucuggaugcguuauuaauuggaaaggccgcgaacugaaguguggguccggaaucuucgugacaaacgagguccacaccuggacggaacaauauaaguuucaggccgauagcccucggagacucuccgcggccauuggcaaggcuugggaggagggggugugcggcauccgcucugccacacggcuggaaaacaucauguggaagcagauuagcaaugagcuuaaccauauccugcucgaaaaugacaugaaauucaccguuguggucggagacguggcuggcauucuggcccaggggaagaaaaugaucagaccgcaacccauggagcacaaguacuccuggaaaucuuggggaaaggccaagauuaucggcgcugaugugcagaacaccacauuuaucauugacgggccuaauacccccgaauguccugaugaccagcgcgcguggaacaucugggaggucgaggauuauggauucggcauuuuuacgacaaauaucuggcugaaacuucgggacagcuacacccagguuugcgaucacagacucauguccgccgcuauuaaggacagcaaagccgugcaugccgauaugggcuauuggaucgaaucugagaagaacgaaacauggaaacuggcucgcgccuccuucaucgaggugaagaccuguauuuggcccaagagccacacacuguggucuaaugggguccucgaauccgagaugaucauuccgaaaaucuacggaggcccuauuagccaacauaacuaucggcccggguacuucacccagacggcgggaccuuggcaccugggcaaacuugagcuggacuuugaucucugcgaagggaccacagugguuguggacgagcacugcggaaauagaggccccucucugcggaccacaaccgucacgggcaaaaucauccaugaaugguguugccgcagcuguacacugccuccccuuagauucagaggggaagauggaugcugguacggcauggagauucggccggugaaggaaaaagaggaaaaccucguuaaguccauggugagcgcugggucuggagaggucgacuccuuuagccugggccugcucuguaucuccauuaugaucgaagaggugaugcgcucucgguggagcagaaagaugcugauuaccgggacacuugccguuuucuuucugcucaucaugggacaggugaccuggaaugaccugauucgccugugcaucauggucggcgccaacgcuuccgauagaaugggcauggggaccacauaucuugcccugauggcgacguucaaaaugcggccuauguuugcugugggacuccuguuccgcagacucaccucucgggaggugcugcuucugacaaucggccucagccuggucgccuccguugaacugcccaauucucuugaggaacugggggacggacucgccaugggcauuaugauccugaagcuccugaccgauuuucaaccccaccagcuuugggcuacacugcucagccugaccuucauuaaaacgacauuuucccugcauuacgccuggaagaccauggcuauggugcuuagcaucgugucucuguucccucucugucuguccaccacaagccagaaaaccacauggcucccgguccugcuugggucucugggaugcaagccccugacgauguuucucauugccgagaacaagaucuggggccgcaaauccuggccucugaacgaaggcaucauggcgguggggauuguuagcauccuucugucuucccuccugaagaaugacgugccccucgccggaccucugauugcuggcgggaugcuuaucgccuguuaugucauuagcggauccagcgcugaucugucucuggagaaagccgccgaggugagcugggaagaggaagcugagcacuccggcgcgucucauaacauccucguugaagugcaggacgaugggaccaugaagaucaaagacgaggagagagaugacacacugaccauucuucugaaggccacacuccuggcugucagcggaguguacccccucuccaucccugccacccuguucgucugguauuucuggcagaagaagaagcagcggucuggcgugcuuugggauacgcccagcccgccugaaguugagcgcgccgugcuggacgauggcauuuacagaaucaugcagcgggggcugcucggacgcucccaggucggcguggggguuuuucaagaaaauguguuccacaccauguggcacgucacaagaggagcugugcugauguaucagggcaaacggcuugagcccucuugggccagcgugaagaaagaccugauuuccuacgggggaggcuggagacuccagggcagcuggaacaccggggaggaaguucaggucaucgcgguggagccuggaaagaaucccaaaaacgugcaaacagcuccgggcaccuuuaagacaccugaaggggaggucggagccauugcccuggacuucaagcccggcacgucuggguccccuaucgugaaucgcgaaggaaaaaucguuggccucuacggcaacgggguggucaccacaagcggaaccuaugugucugcuauugcccaggcgaaggcuucccaggagggcccccugcccgagaucgaagaugagguuuuucggaaaagaaaucuuaccauuauggaccugcauccugggagcggaaagacacgccgguaccugccggccaucgugagagaagccauuaaacgcaagcuccggacgcugauccuugcucccaccagagucguggccuccgagauggcugaagcccugaagggcaugccuauccgcuaucaaacaaccgcgguuaaaucugagcacacagggaaggagauuguggaucucaugugccaugccaccuucacgaugcggcugcugagccccgucagagugccuaacuacaauaugaucauuauggacgaagcucacuuuacagaucccuccagcaucgccgcucggggcuauauuucuacccgcgugggaaugggcgaggccgccgcuaucuucaugaccgcgacaccuccgggguccgucgaagccuuuccccagagcaacgcuguuauccaggacgaggaaagagauauuccugagcggucuuggaauagcggauacgaguggaucaccgacuuccccggcaaaacagugugguuugugccuuccauuaagucugggaacgauaucgccaauugucuccgcaaaaacggaaagagagucauucagcuuagccggaagaccuucgacacggaauaucagaaaacaaagaacaaugauugggacuacgugguuaccacagacaucuccgagaugggcgccaacuucagagcugaucgcgugauugacccccggagaugccugaaaccggucauccugaaggaugggccugaacgcgugauccucgccggccccaugcccguuaccguggcgucugcugcccagcggagaggacgcauuggccggaaucauaacaaagagggggaccaguacaucuauaugggacagccucugaauaacgaugaggaccacgcccacuggacggaagcuaagaugcuucuggauaauauuaacacccccgagggcaucauuccugcccucuuugaaccggagagagaaaagagcgcggccaucgacggggaguaccgccugagaggagaggcucggaaaacauucgucgaacugaugcgcagaggcgaucuccccguguggcuuuccuauaaggucgccagcgagggguuucaauacucugaccggcgcuggugcuucgauggcgaaagaaauaaccaggugcuggaggaaaauauggacguugagaucuggaccaaagagggagaacggaagaaacugagaccucgcuggcucgaugcucggacauauuccgacccccuggcccuuagagaguuuaaggaguucgcugccggccgccggagcguguccggggaccugauucucgagaucggaaaacugccucagcaucugacccagagagcgcaaaacgcccucgauaaucuugugaugcugcacaacucugaacagggcgggcgggcuuaccgccaugccauggaggagcugcccgacacaauugaaacccucaugcugcuugcucugaucgccguccucacgggaggcguuacacuguuuuuccugagcggcagagggcucggaaagaccuccauuggccuucugugugugauggccucuagcgugcugcucuggauggcuuccgucgagccgcacuggaucgcggccagcaucauucuggaauuuuuccuuauggugcugcucaucccugagcccgaucggcagcgcaccccucaggacaaucaacuggcuuauguugugauugggcugcucuuuaugauccuuacagucgccgccaacgagaugggacugcuggaaaccacaaagaaagaucucggcauugggcacguggcugucgagaaccaucaccaugccgcgaugcuggacguggaucuucaccccgccucugcuuggacgcuguacgccguugcuaccacaaucauuaccccuaugaugagacauacaaucgaaaauaccacggccaacaucucccucaccgcgauugccaaucaggcugccauccugaugggacuggacaagggcuggcccauuagcaaaauggauaucggcgugccgcuccuugcucuggggugcuacucucaggucaacccucugacacucaccgccgcugugcugaugcuuguugcccacuaugcgauuaucggacccggccugcaagccaaggcuacacgggaggcccagaaacgcaccgcugccgggaucaugaagaaucccacgguggacggaauugucgccaucgaucucgacccugugguguacgaugcgaaguucgaaaaacagcugggccagauuaugcugcucauccuuuguacaucccaaauucugcugaugagaaccacaugggcucucugcgagagcaucacccuggccaccgggccgcuuacaacgcugugggagggaucucccggcaaguuuuggaacaccacaaucgcuguuagcauggccaauauuuuccggggcuccuaucucgccggggcuggacuggccuucucucugaugaaaagccucggcgggggacgcagaggcaccggggcgcagggagaaacacuuggcgagaaguggaaacggcagcugaaccagcuguccaagagcgaauuuaauaccuacaagagauccggcaucauggaggucgaccgcucugaagccaaagaggggcucaagcggggagagacgacaaaacacgcugugagcagaggcaccgccaagcugcgcugguucguggaacggaaccuugucaaaccugaggggaagguuauugaccugggauguggcagagggggaugguccuauuacugcgcuggccucaagaaagugaccgaagugaagggcuauacaaaagggggacccggccaugaggaaccuauccccauggccaccuacggguggaaucuggucaagcugcacucuggaaaagauguguuuuucauuccuccggagaagugugacacacuccuuugcgauaucggcgagagcucccccaacccuacgauugaagaggggcgcacccugcggguucugaaaaugguggaacccuggcucagaggaaaucaauuuuguaucaagauccugaacccuuacaugcccucugucguggagacacuugagcagaugcagcgcaagcauggcggcaugcugguucggaauccgcucagcagaaacuccacccacgaaauguauugggugagcugcgggacaggaaauauugucucugcggugaacaugaccucccgcaugcugcugaaccgguucacgauggcccacagaaaaccuaccuacgagcgcgacguggaucucggcgcugggacaagacaugucgccguugaacccgagguggcuaaucuggacaucauuggacagcggaucgaaaacauuaagcacgagcauaaaagcaccuggcacuaugaugaggacaaucccuacaagacaugggccuaucauggcucuuacgaagugaaaccuuccgggagcgcuucuuccauggucaacggagugguuaaacuucugaccaagcccugggaugugaucccuauggucacacaaaucgccaugaccgacacgacaccguuuggccagcagcgcguguucaaagagaagguugauaccagaacccccaaagcgaagcggggcacagcccaaauuauggaagugacggcuagauggcucuggggguuucugagccggaauaaaaagccucgcaucuguaccagagaggaguucacacggaagguccgcuccaacgccgcuauuggagccguguuuguugacgagaaucaguggaacagcgccaaagaggcgguggaagacgagagauucugggaucuuguccaccgggaacgcgagcugcacaagcagggcaaaugcgcuaccugcguguauaauaugauggggaagagagagaaaaagcucggagaguuuggcaaggccaaagggucucgggccaucugguacauguggcugggcgcucgcuuccuggaguucgaagcccucggauuuaugaacgaggaccauugguucagcagagaaaauucccugucuggcgucgagggggagggacuucacaagcugggcuacauucuccgggauaucagcaaaauccccgggggaaacauguaugcugacgauacagccggcugggacacccgcauuacagaagaugaccugcagaaugaggcgaagaucaccgauauuauggaaccugagcaugcccuucuggcuaaagccaucuuuaagcucacguaccaaaacaaagugguuagagugcagcggcccgcuaagaaugggaccgucauggacgugauuucccgcagagaucagcggggcucuggacaggugggcacauaugggcugaacaccuucacaaacauggaagcccaacugaucagacagauggagagcgagggaaucuuuuccccgucugaacucgagaccccuaaucuggcggaacgcguucuuuacuggcuggagaaguauggcguggaacggcucaaaagaauggccauuagcggggacgauugugucgugaagcccaucgacgaccgcuucgcuacggcccugacagcucuuaacgauaugggaaaaguucggaaggacauuccucagugggagcccuccaaaggcuggaaugauuggcagcaagugccuuuuugcagccaccacuuccaucagcugaucaugaaggacgggagagagauugucgugcccugucgcaaccaggaugaacucgucggccgggccagagugucucagggagcuggcuggucccugcgcgagaccgccugccugggaaagagcuacgcgcaaauguggcagcucauguauuuucaccggagagaccugcgccuugccgcuaaugccaucuguucugccguuccgguggauugggucccuacaucccggaccacguggagcauucaugcucaccaucaguggaugaccacagaagacaugcuguccguguggaacagaguuuggaucgaggaaaaucccuggauggaggauaaaacccacaucucuagcugggaggacgugcccuaccucggaaagcgggaagaucaauggugcggcucccugauugggcuuacagccagagcgaccugggcuacaaacauccaggucgccauuaaucaggugcgccggcugaucggaaacgagaauuaccucgacuauaugaccagcaugaaaagauucaagaacgaaucugacccugagggcgcccugugguga

SEQ ID NO: 19455 - RNA, 9879 nt, Artificial Sequence
  derived and/or modified CDS sequence (opt5) from DENV-1__KM403627__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauauccagaacaccacauucauuaucgacgggccugauacccccgaauguccugacgaucagagagccuggaauauuugggaggucgaggacuauggauuuggcguuuucacgacaaacaucuggcugaaacuucgcgauagcuacacccagaugugcgaccaccggcucauguccgcugcgauuaaagauagcaaggccgugcaugcugacaugggcuauuggaucgaaucugagaaaaaugaaacauggaagcuggccagagccuccuuuaucgaggugaagaccuguauuuggccccgcagccacacacuguggucuaacgggguccucgaauccgagaugaucauuccgaaaaucuacggaggcccuauuagccaacauaauuaucggcccggguacuucacccagacggcuggaccuuggcaccugggcaaacuugagcuggauuucaaccucugcgaagggaccacagugguuguggacgagcacugcggaaauagaggccccucucugcggaccacaaccgucacgggcaaaaucauccaugaaugguguugccgcagcuguacacugccuccccuuagauuuagaggggaagauggaugcugguacggcauggagauuagaccggugaaggaaaaagaggaaaaccucguucgcuccauggugagcgccgggucuggagaggucgacuccuucagccugggccugcucuguguguccaucaugauugaagagguuaugcggucuagauggagccgcaagaugcugaugaccgggacacuugcgguguuuuuccugcucaucaugggacagcugaccuggaaugaccugauuagacuuugcaucauggucggcgcuaacguguccgaucggaugggcauggggaccacauaucuggcccucauggccacguuuaagaugcgcccuauguucgcugugggacugcucuuuagacggcugaccucucgcgagguccuucugcucacaauuggccugagccugguugccuccguggaacuucccaacucucuggaggaacucggggacggacuggcgaugggcaucaugaugcucaaacugcuuaccgauuuccaaagccaccagcuguggacaacccuccugucccugacguuuaucaagacaacccuuagccuggacuacgcuuggaaaaccauggccauggugcucucuauugucucccuguucccccucugucugagcacaaccucucagaagacaacguggcuuccugugcugcugggguccuuuggaugcaaaccgcucaccauguuccugaucacagagaauaagauuuggggcagaaagagcuggccccuuaacgaaggcaucauggccguugggauugugucuauccugcucuccagccugcucaaaaaugaugucccucuggcuggaccccuuaucgccggcgggaugcugauugcuuguuaugugaucuccggaagcucugccgaccugagccucgagcgggcggccgagguuuccugggaagaggaagcugagcauucuggcgccagccacaacauucugguggaaguccaggaugacgggaccaugaagaucaaagaugaggagcgcgacgauacacuuaccauucugcucaaggcuacgcugcucgccguguccggagucuacccuaugucuauccccgccacccuguuugugugguauuucuggcagaagaagaaacagagaagcggcguucuuugggacacaccuagcccucccgaaguggagcgggcuguccuggaugacggcaucuaccgcauucugcagagagggcuccugggacggucucaggugggcguugggguguuccaagacggagucuuucauaccauguggcacgugacaagaggcgcggugcuuauguaucaggggaagcgccuggaacccagcugggccuccguuaagaaagaucucaucagcuacggaggcggcuggcgguuccaggggucuuggaauaccggagaggagguccaggugauugcuguggaacccggcaagaacccuaaaaauguccaaacaacgcccgggaccuuuaagacaccggagggagaagugggcgccaucgcccuggacuucaaaccugggaccuccggaagccccauuguuaacagagagggcaagaucgugggccucuacgggaauggagucgugaccacaucuggcacguauguuuccgcuauugcccaggcgaaggcuagccaggaagggccucugcccgagaucgaggaugaaguguuuaaaaagcgcaaccuuaccaucauggaccugcaccccggauccggcaaaacacggagauaccugccugccauuguccgcgaggccaucaagcggaaacucagaacccugauucuugcuccgacacgcgugguugccucugaaauggcggaggcucugaaggggaugcccauccgguaucaaaccacggccgugaaguccgaacauacaggcaaagagauugucgaucucaugugccacgccaccuucaccaugagacugcuguccccugugcgggugcccaauuacaacaugaucaucauggacgaggcucauuuuacagauccugccagcauugcugcccgcggauauaucucuaccagagucggcaugggggaagcggccgcuauuuucaugacagccacacccccuggauccguugagagcuuuccgcagucuaaugcugugauccaggacgaagaacgggauauucccgaacgcagcuggaacuccggcuacgacuggaucacggauuucccugggaagacagugugguuuguccccucuaucaaaagcggaaaugacauugccaacugucucagaaagaacggcaaacgggugauccagcuuuccagaaagaccuucgacacagaguaucaaaagaccaaaaauaacgauugggacuacguugugacgaccgauauuucugagaugggggccaauuuccgcgcugaccgggucaucgauccuagacgcugccugaagcccgugauucugaaagacggcccggaacggguuauccucgcgggaccuaugcccgugacagccgcuagcgccgcccagagacgcggccggauugggagaaaccagaauaaggagggagaucaguacaucuauaugggccaaccccugaacaaugacgaagaucacgcucauuggaccgaggccaaaaugcuucuggacaacaucaauacaccugaggggauuauccccgcgcucuuugaaccugagcgcgaaaaguccgcugccauugauggagaguacagacugcggggcgaagcccgcaagaccuucgucgagcugaugagaagaggggaccucccgguguggcuuagcuauaaagucgcuucugagggcuuucaguacuccgaucgcagauggugcuucgacggagaacggaacaaucaggugcuggaggaaaacauggacguugagaucuggacaaaggaaggcgagcgcaagaagcugcgcccccgguggcucgaugccagaaccuauagcgacccucuggcgcuucgcgaguuuaaagaguucgccgcugggcggagauccgugucuggagaucugauucucgagaucggcaagcugccccagcaccugacgcuccgggcccaaaaugcucuugacaaccuggugaugcugcacaauagcgaacaagggggaaaagccuaccgccaugcuauggaggaacucccugauacaaucgagacccugaugcuucuggcccucauugcgguccugaccggcggcguuacacuguuuuuccucuccgggaagggacuuggcaagaccucuaucgggcugcugugugugauggccagcuccgugcuccuguggauggcuagcgucgagccccacuggauugccgcuucuaucauucuugaauuuuuccugauggugcuccugaucccggagccugacagacagcggacaccccaggauaaccaacuggccuauguugugaucggacuccuuuuuaugauucugacggucgccgcuaacgaaaugggccugcucgagaccaccaaaaaggaccuggggaucggacauguggucgcggagaaucaccaccaugccaccaugcuugauauugaccugcacccugcuuccgccuggacacucuacgccguggcuaccacgaucauuacccccaugaugcgccauacaaucgaaaacaccacagccaauauuagccugaccgcgaucgccaaccaggcugccauccugaugggccucgauaaaggcuggccuauuucuaagauggacaucgggguuccccuucuggcucugggaugcuacucccaggugaauccgcucacgcugacagccgcgguccuuaugcugguggcccacuaugcuauuaucggcccugggcuccaagccaaagcuaccagagaggcccagaagcggacagcugccggaauuaugaagaaccccaccguugauggcaucguggcgaucgaccuggaccccgucguguacgaugccaaauucgaaaagcagcuggggcagauuaugcuccuuauccuguguaccagccaaauucugcucaugcgcacaacgugggcucugugcgagucuaucacccuugccacaggaccucugaccacacucugggaaggcagcccgggcaaauuuuggaauaccacgauugcuguguccauggccaacaucuucagagggucuuaucuggccggagcgggccuggcuuucagccucaugaagucccuugggggaggccggcgcgggacaggagcccagggcgagacccugggcgagaaauggaagagacagcugaaucagcucagcaaguccgaauuuaacaccuacaaacggucugggaucauggagguugacagaagcgaagcuaaggagggacugaaacgcggcgaaacaaccaagcaugccgucucccgggggacagccaaacuuagaugguucguggagcgcaaucuggugaagcccgagggaaaggucauugaucucggcugugggcggggaggcuggucuuauuacugcgcuggccugaaaaagguuacggaagugaaaggguauaccaagggaggcccugggcacgaggaacccaucccuauggccacauacggauggaacauugugaaacugcacagcggcagagacgucuuuuucacacccccugagaagugugauacccuccuuugcgacaucggggaauccucuccgaaucccaccauugaggagggacgcacgcugcgggugcugaaaaugguugaaccuuggcucagaggcaaccaauuuuguaucaagauucugaaucccuacaugccuagcguggucgagacccuugaacagaugcagcgcaagcauggcgggaugcuggugcggaacccccucuccagaaauagcacacacgagauguauuggguuucuugcggaaccggcaacaucguguccgcggucaacaugacaagccgcaugcugcugaaucgguucaccauggcccauagaaaaccgacauacgagcgcgauguggaccucggggcuggaaccagacacguggccgucgaaccugagaucgcuaaccuggauauuaucggccagcggauugaaaauaucaagaacgagcacaaaucuacguggcauuaugacgaagauaaucccuacaagacaugggccuaucacggguccuacgagguuaaacccagcggaucugcguccagcauggugaacggcgugguccgccuucugaccaagccuugggacgugauucccaugguuacccaaaucgccaugacagacacgaccccuuuuggccagcagagaguguucaaggagaaagucgauacacggaccccgagacccaagcgggggacagcucaaaucauggaagugaccgccaaauggcucuggggauuucugucccgcaauaagaaaccuagaauuuguacacgggaggaguucacccgcaagguuagaagcaacgcugccaucggcgcuguguuugucgacgagaaucaguggaacucugccaaggaagcgguggaggaugagcgguucugggaccuuguucaucgcgaaagagagcugcacaaacaggggaagugcgccacgugcguguauaauaugaugggaaaacgggaaaagaaacucggcgaguuugggaaggcuaagggcagccgcgccauuugguacauguggcugggagcuagauuccuggaguucgaggcccucggcuuuaugaacgaggaucauugguucucccgggaaaauucucugagcggggucgagggagaaggccuucacaaacugggguacauccuccgcgacauuuccaagauccccggaggcaacauguaugccgaugacaccgcggggugggauacaagaaucaccgaggacgaucugcagaaugaggcuaaaauuacagacaucauggaaccugagcacgcccuucuggccaccucuauuuuuaagcucacguaccaaaacaaagugguccgggugcagcgccccgcuaagagcggcacaguuauggaugugaucuccagacgggaccagagaggaucuggccaggucgggaccuauggacugaacacauucaccaauauggaagugcaacugauucgccagauggagagcgaaggcaucuuuuccccgagcgagcucgagaacucuaaucuggccgaacgggugcuugacuggcuggagaaacaugggguugaaagacucaagcgcauggcuaucuccggagaugacuguguggucaagccuacggaugaccgguucgccaccgcgcugacagcccuuaacgauaugggcaaagugagaaaggacauuccccagugggagccuagcaaaggguggaaugauuggcagcaaguucccuuuugcucucaccauuuccaccagcugaucaugaaggacggccgcgaaauuguggucccuugucggaaccaggaugagcucgugggacgggcucgcgucucccagggcgccggguggagccugcgggagaccgcuugccugggaaaauccuacgcccaaauguggcagcucauguauuuucacagacgcgaccugcggcuugcggccaaugcuaucuguucugccgugcccguuaacugggugccgacaagcagaaccacaugguccauucaugcucaccaucaguggaugaccacggaagauaugcugagcgucuggaaucggguguggaucgaggaaaacccuuggauggaggacaagacacacguuucuuccugggaagacgugcccuaccucggcaagagagaggaucaauggugcgggagccugauuggacuuaccgcccgcgcuaccugggccacaaauauccaggucgcgaucaaccaggugcggagacugauuggcaaugagaacuaucucgacuacaugaccucuaugaaacgcuucaagaaugaaagcgaucccgagggggcccugugguga

SEQ ID NO: 19456 - RNA, 9879 nt, Artificial Sequence
  derived and/or modified CDS sequence (opt5) from DENV-1__KM403584__SS-prME
uccgugaccaugcugcucaugcugcuucccacagcccuggcuuuccaccucacgacccggggcggggaaccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgaggugcagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaagugguugugcucggaucucaagagggcgcuaugcacaccgcccugacaggggccacggaaauccagaccagcggaacaaccacaauuuuugcuggccaucuuaaaugcagacugaagauggacaaacucacccugaagggggucuccuaugugauguguacgggcagcuucaaacuggagaaggaaguugccgagacacagcacggaaccgugcuuguccaggugaaguacgagggcaccgaugcgccgugcaaaaucccuauuucuacacaagacgaaaagggggugacccagaacggacggcucaucacagcuaaucccaucguuacggauaaagagaagccugucaacauugaaaccgagccgcccuucggcgaguccuauaucgugauuggggccggagaaaaagcccugaagcugagcugguuuaagaaaggcucuagcaucgggaagauguucgaggcuacagccagaggcgcucgccggauggccauucucggagacaccgcgugggauuuuggcuccaucgggggaguguucacaucugucggcaaacuggugcaucagguuuuugggaccgccuacggagugcuuuucagcggcgucuccuggacgaugaagaucgggauuggcauccugcucaccuggcugggacugaauagcagaucuacaucccuuagcaugaccuguauugcugugggcaugguuacacucuaccugggggugaugguccaggccgacucuggaugcgugaucaacuggaaaggccgcgaacugaaguguggguccggaauuuuuguuaccaacgaggugcacacauggaccgaacaauauaaguuccaggcugauagcccuaaacggcucuccgccgcgaucggcaaggccugggaggagggggucugcggcauuagaucugcuacgcgccuggaaaauaucauguggaaacagaucagcaacgagcuuaaucauauucugcucgaaaacgacaugaaguuuacagugguggucggagacgccuacggcauccugacccaggggaaaaagaugauucggccgcaacccauggagcacaaauauuccuggaagucuuggggaaaggcuaaaaucauuggcgccgauacccagaauacaaccuucaucaucgacgggccugauacgcccgaauguccugacgaucagagagccuggaacauuugggagguugaggacuacggauuuggcguguucacaaccaauaucuggcugaaacuucgcgauagcuauacacagaugugcgaccaccggcucauguccgcugcgauuaaagauagcaaggccgugcaugcugacaugggcuacuggaucgaaucugagaaaaacgaaaccuggaagcuggccagagccuccuuuauugaggucaagacauguaucuggccccgcagccacacccuguggucuaauggggugcucgaauccgagaugaucauuccgaaaaucuauggaggcccuauuagccaacauaacuaccggcccggguacuucacgcagaccgcuggaccuuggcaccugggcaaacuugagcuggauuucaaucucugcgaagggacaaccguuguggucgacgagcacugcggaaacagaggccccucucugcggacaaccacggugacaggcaaaaucauucaugaaugguguugccgcagcuguacccugccuccccuuagauuuagaggggaagauggaugcugguauggcauggagauccggccgguuaaggaaaaagaggaaaaucucgugcgcuccauggucagcgccgggucuggagagguggacuccuucagccugggccugcucuguguuuccaucaugauugaagaggugaugcggucuagauggagccgcaagaugcugaugacagggacccuugcggucuuuuuccugcucaucaugggacagcugaccuggaacgaccugauuagacuuugcaucauggugggcgcuaauguguccgaucggaugggcauggggacaacguaccuggcccucauggccaccuuuaagaugcgcccuauguucgcugucggacugcucuuuagacggcugacaucucgcgagguucuucugcucaccauuggccugagccugguggccuccguggaacuucccaacucucuggaggaacucggggacggacuggcgaugggcaucaugaugcucaaacugcuuacagauuuccaaagccaccagcuguggaccacgcuccugucccugacauuuauuaagaccacccuuagccuggacuaugcuuggaaaacaauggccaugguccucucuaucgugucccuguucccccucugucugagcaccacaucucagaagacgaccuggcuuccuguucugcugggguccuuuggaugcaaaccgcucacaauguuccugaucaccgagaacaagauuuggggcagaaagagcuggccccuuaaugaaggcaucauggccguggggauugucucuauccugcucuccagccugcucaaaaacgaugugccucuggcuggaccccuuauugccggcgggaugcugaucgcuuguuacguuaucuccggaagcucugccgaccugagccucgagcgggcggccgagguguccugggaagaggaagcugagcauucuggcgccagccacaauauucuggucgaagugcaggaugacgggacaaugaagaucaaagaugaggagcgcgacgauacccuuacgauucugcucaaggcuacccugcucgccgucuccggaguguauccuaugucuauccccgccacacuguuuguuugguacuucuggcagaagaagaaacagagaagcggcgugcuuugggacaccccuagcccucccgaagucgagcgggcugugcuggaugacggcauuuaucgcauccugcagagagggcuccugggacggucucagguuggcgugggggucuuccaagacggaguguuucauacaauguggcacgugaccagaggcgcgguucuuauguaccaggggaaacgccuggaacccagcugggccuccgucaagaaagaucucaucagcuacggaggcggcuggcgguuccaggggucuuggaacacaggagaggaggugcaagugauugcugucgaacccggcaagaauccuaaaaacgugcaaacgacccccgggacauuuaagaccccggagggagaaguuggcgccaucgcccuggacuucaaaccugggaccuccggaagccccauugugaauagagagggcaagaucgucggccucuaugggaacggagugguuacaacgucuggcaccuacguguccgcuauugcccaggcgaaggcuagccaggaagggccucugcccgagaucgaggaugaagucuuuaaaaagcgcaaucuuacaauuauggaccugcaccccggauccggcaaaacccggagauaucugccugccaucgugcgcgaggccaucaagcggaaacucagaacacugauucuugcuccgacccgcguuguggccucugaaauggcggaggcucugaaggggaugcccauccgguaccaaacgacagccgucaagagcgaacauaccggcaaagagauuguggaucucaugugccacgccaccuucacaaugagacugcuguccccugugcggguccccaacuauaauaugaucauuauggacgaggcucauuuuaccgauccugccagcaucgcugcccgcggauacaucucuacaagaguuggcaugggggaagcggccgcuauuuucaugaccgccacgcccccuggauccguggaggcuuuuccgcagagcaacgccgugauccaggacgaagaacgggauauucccgaacgcucuuggaauagcggcuaugacuggaucacagauuucccugggaagaccgucugguuugugcccuccauuaaaucuggaaacgacaucgccaauugucucagaaagaacggcaaacggguuauccagcuuagcagaaagacauucgacaccgaguaccaaaagacgaaaaacaaugauugggacuacguggucaccacagauauuuccgagaugggggcuaacuuccgcgcggaccgggugaucgauccuagacgcugccugaagcccguuauucugaaagacggcccggaacgggugauccucgccggaccuaugcccgucaccgcugccucugccgcucagagacgcggccggauugggagaaaucagaacaaggagggagaucaguauaucuacaugggccaaccccugaauaacgacgaagaucacgcccauuggacagaggcgaaaaugcuucuggacaauauuaacaccccugaggggaucauccccgcucucuuugaaccugagcgcgaaaagagcgccgccauugauggagaguauagacugcggggcgaagcucgcaagacauucguggagcugaugagaagaggggaccucccggucuggcuuuccuacaaaguggccagcgagggcuuucaguauucugaucgcagauggugcuucgacggagaacggaauaaccagguucuggaggaaaauauggacguggagaucuggaccaaggaaggcgagcgcaagaagcugcgcccccgguggcucgaugcgagaacguacuccgacccucuggcccuucgcgaguuuaaagaguucgcugccgggcggagaagcguguccggagaucugauucucgagaucggcaagcugccccagcaccugacacuccgggcucaaaacgcccuugacaaucuggucaugcugcacaacucugaacaagggggaaaggcuuaucgccaugccauggaggaacucccugauaccauugagacccugaugcuucuggcgcucaucgccguucugacaggcggcgugacccuguuuuuccucagcgggaagggacuuggcaagacauccaucgggcugcugugugugauggcuucuagcguccuccuguggauggccuccguggagccccacuggauugcugccagcaucauucuugaauuuuuccugaugguucuccugaucccggagccugacagacagcggacgccccaggauaaucaacuggccuacguggucauuggacuccuuuuuaugauccugaccguggcugcgaacgaaaugggccugcucgagacaaccaaaaaggaccuggggaucggacaugucguggccgagaaccaccaccaugcuacaaugcuugauauugaccugcacccugccucugccuggacccucuacgcuguugccacgaccaucauuacacccaugaugcgccauaccaucgaaaauacaaccgcgaacauuucccugacggccaucgcuaaucaggccgcuauucugaugggccucgauaaaggcuggccuaucagcaagauggacaucggggugccccuucuggcccugggaugcuauucucaggucaacccgcucacacugaccgcggccgugcuuaugcugguugcucacuacgccauuaucggcccugggcuccaagcuaaagccacaagagaggcucagaagcggaccgccgcgggaauuaugaagaaucccaccguggauggcaucgucgccauugaccuggaccccgugguguaugaugcuaaauucgaaaagcagcuggggcagaucaugcuccuuauccuguguacaucccaaauucugcucaugcgcacgaccugggcccugugcgagagcaucacacuugcuaccggaccucugacaacccucugggaaggcucuccgggcagauuuuggaacacgacaauugccguuagcauggccaauaucuuccggggguccuaccuggcgggagcuggccuggccuucucucucaugaaaagccuugggggaggccgcagagggaccggagcucagggcgagacccugggcgagaaguggaaacggcagcugaaccagcucuccaagagcgaauuuaauacauauaagagauccgggauuauggaggucgaccgcucugaagccaaagagggaaugaagcggggcgaaaccacaaaacaugccgugagcagagggacggcuaagcugcgcugguucguggagcggaaccuugucaaacccgagggaaagguuaucgaucugggcugugggagaggaggcugguccuacuauugcgccggccucaagaaagugaccgaagugaagggguacacaaaaggaggcccugggcacgaggaacccaucccuauggcgaccuacggauggaauauugucaagcugcacucuggccgcgacguguuuuucacacccccugagaaaugugauacccugcucugcgacaucggggaaagcuccccgaaccccacgauugaggagggacggacccuuagaguucugaagaugguggaaccuuggcugcgcggcaaucaauuuuguaucaaaauucucaaccccuauaugccuucugucguggagacacuggaacagaugcagcggaagcauggcgggaugcuuguuagaaauccccugagccgcaacuccacccacgagauguacugggugagcugcggaacaggcaauaucgucucugccgugaacaugaccucccggaugcuccugaacagauucacaauggcucaucgcaagccgaccuaugagagagauguggaccugggggccggaacgcggcacgucgcuguugaaccugagauugccaaucucgauaucaucggccagcgcauugaaaacaucaaaaaugagcacaagagcacauggcauuacgacgaagauaaccccuauaaaaccugggcguaccacgggucuuaugaggugaagcccuccggaagcgccucuuccauggugaauggcgucgugagacugcuuaccaaaccuugggacguuauucccauggugacacaaaucgcuaugacggacaccacaccuuuuggccagcagcgggucuucaaggagaagguggauaccagaacaccgcggcccaaacgcgggaccgcccaaauuauggaaguuacagcuaaguggcuguggggauuucucagcagaaacaaaaagccucggaucuguacccgcgaggaguucacgagaaaagugcgguccaaugccgcuaucggcgccgucuuuguggacgagaaccaguggaauagcgcgaaggaagccguugaggaugagcgcuucugggaccuggugcauagagaacgggagcuucacaagcaggggaaaugcgcuaccugcgucuacaacaugaugggaaagcgcgagaagaagcugggcgaguuugggaaagccaagggcucuagagcuauuugguacauguggcucggagcccgguuccuggaguucgaggcccugggcuuuaugaaugaggaucauugguucagccgcgaaaacucccucucugggguggagggagaaggccugcacaaacuuggguauauccugagagacauuagcaaaauccccggaggcaauauguacgcggaugacacagcugggugggauacccggauuacagaggacgaucuccagaacgaggccaagaucaccgacaucauggaaccugagcacgcccugcuugcuacguccauuuuuaaacugacauaucaaaauaaggucgugcgcguucagagacccgccaaaucuggcaccgugauggaugucaucagccggagagaccagcgcggauccggccagguggggacauacggacucaacaccuucacgaacauggaagugcaacugauucggcagauggagucugaaggcaucuuuagcccguccgagcuggagaauagcaaccucgcugaaagaguucuggacuggcuugagaagcaugggguggaacgccugaaacggauggccauuucuggagaugacugugucgugaagccuaccgaugacagauucgcgacagcccucaccgcucugaaugauaugggcaagguucgcaaagacaucccccagugggagccuuccaagggguggaacgauuggcagcaagugcccuuuugcagccaccauuuccaccagcuuaucaugaaagacggccgggaaauugucgugccuuguagaaaucaggaugagcuggucggacgcgcccgggugucucagggcgcuggguggucccucagagagacagccugccugggaaagagcuaugcgcaaauguggcagcugauguacuuucaccgccgggaccucagacuggccgcuaacgccaucuguuccgcuguucccgugaauugggucccgaccucucggacaaccuggagcauucaugcccaccaucaguggaugacgacagaagauaugcuuuccguguggaacagaguuuggaucgaggaaaauccuuggauggaggacaaaacccacgugagcucuugggaagacguccccuaucugggcaagcgcgaggaucaauggugcgggucccucauuggacugaccgcucgggccacaugggcgaccaacauccagguggccauuaaucaggugagacgccuuaucggcaacgagaauuaccuggacuacaugacaagcaugaagagauucaaaaacgaaucugaucccgagggggcucucugguga

SEQ ID NO: 19457 - RNA, 9879 nt, Artificial Sequence
  derived and/or modified CDS sequence (opt5) from DENV-1__KM403633__SS-prME
agcgugaccaugcugcucaugcugcuucccacagcucuggcuuuccaccucacgaccagaggcggggaaccucauaugaucguguccaagcaggaacggggaaaaucucugcuuuuuaagacaagcgccggcguuaacaugugcacccugauugcgauggaccucggggaacugugugaagauacaaugaccuacaaaugcccgcgcaucacagaagcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugcgcgagaagucuuggcugguccauaaacagugguuucuugaccugccucuccccuggacguccggggcuagcacaucccaagagaccuggaauagacaggaucugcuggugacauucaagaccgcgcacgccaaaaagcaggaagucgugguucucggaucucaagagggcgcuaugcacaccgcccugacaggggccacggaaauucagaccagcggaacaaccacaaucuuugcuggccaucuuaagugccggcugaaaauggacaagcucacccugaaagggguguccuaugucauguguacgggcagcuucaagcuggagaaagaaguggccgagacacagcacggaaccguucuugugcaggucaaguacgagggcaccgaugcgccgugcaagauuccuaucucuacacaagacgaaaaaggggugacccagaacggaagacucaucacagcuaaucccauugugacggauaaggagaaaccuguuaacaucgaaaccgagccgcccuucggcgaguccuauauugucaucggggccggagaaaaggcccugaaacugagcugguuuaagaagggcucuagcauugggaaaauguucgaggcuacagcccgcggcgcucggagaauggccauccucggagacaccgcgugggauuuuggcuccaucgggggaguguucacaucugugggcaagcugguccaucagguguuugggaccgccuacggaguucuuuucagcggcguguccuggacgaugaaaauugggaucggcauucugcucaccuggcugggacugaauagccgcucuacaucccuuagcaugaccuguaucgcugucggcauggugacacucuaccuggggguuauggugcaggccgacucuggaugcgucauuaacuggaagggccgggaacugaaauguggguccggaaucuuugugaccaacgagguucacacauggaccgaacaauauaaguuccaggcugauagcccuaagagacucuccgccgcgauuggcaaagccugggaggagggggugugcggcauccgcucugcuacgcggcuggaaaauaucauguggaagcagauuagcaacgagcuuaaucauauccugcucgaaaacgacaugaaauuuacagucguggugggagacgccaauggcauucugacccaggggaagaaaaugaucagaccgcaacccauggagcacaaguacuccuggaaaucuuggggaaaggcuaagauuaucggcgccgauacccagaacacaaccuucaucauugacgggccugauacgcccgaauguccugacgaucagcgcgccuggaauaucugggaggucgaggacuauggauuuggcguuuucacaaccaacauuuggcugaaacuucgggauagcuacacacagaugugcgaccacagacucauguccgcugcgaucaaggauagcaaagccgugcaugcugacaugggcuauuggauugaaucugagaagaaugaaaccuggaaacuggcccgcgccuccuuuaucgaggugaagacauguaucuggccccggagccacacccuguggucuaacgggguccucgaauccgagaugauuaucccgaagauuuacggaggcccuaucagccaacauaauuauagacccggguacuucacgcagaccgcuggaccuuggcaccugggcaaacuugagcuggauuucaaccucugcgaagggacaaccgugguuguggacgagcacugcggaaaucggggccccucucugcgcacaaccacggucacaggcaagauuauccaugaaugguguugcagaagcuguacccugccuccccuucgguuuagaggggaggauggaugcugguacggcauggagauccgcccggugaaagaaaaggaggaaaaccucguucgguccauggugagcgccgggucuggagaggucgacuccuucagccugggccugcucuguguguccauuaugaucgaagagguuaugagaucucgcuggagcagaaaaaugcugaugacagggacccuugcgguguuuuuccugcucauuaugggacagcugaccuggaaugaccugauccggcuuugcauuauggucggcgcuaacguguccgaucgcaugggcauggggacaacguaucuggcccucauggccaccuuuaagaugagaccuauguucgcugugggacugcucuuucggcgccugacaucuagagagguccuucugcucaccaucggccugagccugguugccuccguggaacuucccaacucucuggaggaacucggggacggacuggcgaugggcauuaugaugcucaagcugcuuacagauuuccaaagccaccagcuguggaccacgcuccugucccugacauuuaucaaaaccacccuuagccuggacuacgcuuggaagacaauggccauggugcucucuaucgucucccuguucccccucugucugagcaccacaucucagaaaacgaccuggcuuccugugcugcugggguccuuuggaugcaagccgcucacaauguuccugauuaccgagaauaaaaucuggggccggaaguccuggccccuuaacgaaggcauuauggccguugggaucgugucuauucugcucuccagccugcucaagaaugaugucccucuggcuggaccccuuaucgccggcgggaugcugaucgcuuguuaugugauuuccggaagcucugccgaccugagccucgagcgcgcggccgagguuuccugggaagaggaagcugagcauucuggcgccagccacaacauccugguggaaguccaggaugacgggacaaugaaaauuaaggaugaggagagagacgauacccuuacgauccugcucaaagcuacccugcucgccguguccggagucuacccuaugucuauucccgccacacuguuugugugguauuucuggcaaaagaaaaagcagcggagcggcguucuuugggacaccccuagcccucccgaaguggagcgcgcuguccuggaugacggcaucuacagaauccugcagcgggggcuccugggaagaucucaggugggcguugggguguuccaagacggagucuuucauacaauguggcacgugacccgcggcgcggugcuuauguaucaggggaaacggcuggaacccagcugggccuccguuaagaaggaucucauuagcuacggaggcggcuggagauuccaggggucuuggaauacaggagaggagguccaggugaucgcuguggaacccggcaaaaacccuaagaauguccaaacgacccccgggacauuuaaaaccccggagggagaagugggcgccauugcccuggacuucaagccugggaccuccggaagccccaucguuaaccgcgagggcaaaauugugggccucuacgggaauggagucgugacaacgucuggcaccuauguuuccgcuaucgcccaggcgaaggcuagccaggaagggccucugcccgagauugaggaugaaguguuuaagaaacggaaccuuacaaucauggaccugcaccccggauccggcaagaccagacgcuaccugccugccaucguccgggaggccauuaaaagaaagcuccgcacacugauccuugcuccgacccgggugguugccucugaaauggcggaggcucugaaagggaugcccauuagauaucaaacgacagccgucaagagcgaacauaccggcaaggagaucgucgaucucaugugccacgccaccuucacaaugcggcugcuguccccugugcgcgugcccaauuacaacaugauuaucauggacgaggcucauuuuaccgauccugccagcaucgcugccagaggauauauuucuacacgggucggcaugggggaagcggccgcuaucuucaugaccgccacgcccccuggauccguugaggcuuuuccgcagagcaaugccgugauucaggacgaagaacgcgauauccccgaaagaucuuggaacagcggcuacgacuggauuacagauuucccugggaaaaccgugugguuuguccccuccaucaagucuggaaaugacaucgccaacugucuccggaaaaacggcaagagagugauucagcuuagccgcaaaacauucgacaccgaguaucaaaagacgaagaauaacgauugggacuacguugugaccacagauaucuccgagaugggggcuaauuuccgggcggacagagucauugauccucgccggugccugaaacccgugauccugaaggacggcccggaaagaguuauucucgccggaccuaugcccgugaccgcugccucugccgcucagcgccggggcagaaucgggcgcaaccagaauaaagagggagaucaguacauuuauaugggccaaccccugaacaaugacgaagaucacgcccauuggacagaggcgaagaugcuucuggacaacaucaauaccccugaggggaucauucccgcucucuuugaaccugagagagaaaagagcgccgccaucgauggagaguaccggcugcgcggcgaggcuagaaagacauucgucgagcugaugcggcgcggggaccucccgguguggcuuuccuauaaggucgccagcgagggcuuucaguacucugauagacgguggugcuucgacggagaaagaaacaaucaggugcuggaggaaaacauggacguugagauuuggaccaaagaaggcgagcgcaagaaacugcggcccagauggcucgaugcgcgcacguauuccgacccucuggcccuucgggaguuuaaggaguucgcugccgggagacggagcguguccggagaucugauccucgagauuggcaaacugccccagcaccugacacuccgcgcucaaaaugcccuugacaaccuggugaugcugcacaauucugaacaagggggaaaggcuuacagacaugccauggaggaacucccugauaccaucgagacccugaugcuucuggcgcucaucgccguccugacaggcggcguuacccuguuuuuccucagcgggaaaggacuuggcaagacauccauugggcugcugugugugauggcuucuagcgugcuccuguggauggccuccgucgagccccacuggaucgcugccagcauuauccuugaauuuuuccugauggugcuccugauuccggagccugaccggcagcgcacgccccaggauaaccaacuggccuauguugugaucggacuccuuuuuaugauccugaccgucgcugcgaacgaaaugggccugcucgagacaaccaagaaagaccuggggauuggacauguggucgccgagaaucaccaccaugcuacaaugcuugauaucgaccugcacccugccucugccuggacccucuacgcuguggccacgaccauuaucacacccaugaugagacauaccauugaaaacacaaccgcgaauaucucccugacggccauugcuaaccaggccgcuauccugaugggccucgauaagggcuggccuaucagcaaaauggacauugggguuccccuucuggcccugggaugcuacucucaggugaauccgcucacacugaccgcggccguccuuaugcugguggcucacuaugccaucauuggcccugggcuccaagcuaaggccacacgggaggcucagaaacgcaccgccgcgggaaucaugaagaaccccaccguugauggcauuguggccaucgaccuggaccccgucguguacgaugcuaaguucgaaaaacagcuggggcagaucaugcuccuuauucuguguacaucccaaauccugcucaugagaacgaccugggcccugugcgagagcauuacacuugcuaccggaccucugacaacccucugggaaggcucuccgggcaaguuuuggaauacgacaaucgccgugagcauggccaacauuuuccggggguccuaucuggcgggagcuggccuggccuucucucucaugaaaagccuugggggaggccgcagagggaccggagcucagggcgagacccugggcgagaaguggaaacggcagcugaaucagcucuccaagagcgaauuuaacacauacaagagauccgggaucauggagguugaccgcucugaagccaaagagggacugaagcggggcgaaaccacaaaacaugccgucagcagagggacggcuaaacuucgcugguucguggagcggaaucuggugaaacccgagggaaaggucaucgaucucggcugugggagaggaggcugguccuauuacugcgccggccugaagaaaguuaccgaagugaagggguauacaaaaggaggcccugggcacgaggaacccauuccuauggcgaccuacggauggaacaucgugaagcugcacucuggccgcgacgucuuuuucacacccccugagaaaugugauacccuccuuugcgacauuggggaaagcuccccgaaucccacgaucgaggagggacggacccugagagugcugaagaugguugaaccuuggcuccgcggcaaccaauuuuguauuaaaauccugaaucccuacaugccuucuguggucgagacacuugaacagaugcagcggaagcauggcgggaugcuggugagaaacccccucagccgcaauuccacccacgagauguauuggguuagcugcggaacaggcaacauugugucugccgucaacaugaccucccggaugcugcugaauagauucacaauggcucaucgcaagccgaccuacgagagagauguggaccucggggccggaacgcggcacguggcugucgaaccugagaucgccaaccuggauaucauuggccagcgcaucgaaaauauuaaaaacgagcacaagagcacauggcauuaugacgaagauaaucccuacaaaaccugggcguaucacgggucuuacgagguuaagcccuccggaagcgccucuuccauggugaacggcguggucagacuucugaccaaaccuugggacgugauccccaugguuacacaaauugcuaugacggacaccacaccuuuuggccagcagcggguguucaaggagaaggucgauaccagaacaccgcggcccaaacgcgggaccgcccaaaucauggaagugacagcuaaguggcucuggggauuucugagcagaaauaaaaagccucggaucuguacccgcgaggaguucacgagaaaaguucgguccaacgccgcuauuggcgccguguuugucgacgagaaucaguggaacagcgcgaaggaagccguggaggaugagcgcuucugggaccuuguucauagagaacgggagcugcacaagcaggggaaaugcgcuaccugcguguauaauaugaugggaaagcgcgagaaaaagcucggcgaguuugggaaagccaagggcucuagagcuaucugguacauguggcugggagcccgguuccuggaguucgaggcccucggcuuuaugaacgaggaucauugguucagccgcgaaaauucccugucuggggucgagggagaaggccuucacaagcugggguacauucucagagacaucagcaaaauucccggaggcaacauguaugcggaugacacagcugggugggauacccggaucacagaggacgaucugcagaaugaggccaagaucaccgacauuauggaaccugagcacgcccuucuggcuacguccaucuuuaaacucacauaccaaaacaaggugguccgcgugcagagacccgccaaaucuggcaccguuauggaugugauuagccggagagaccagcgcggauccggccaggucgggacauauggacugaacaccuucacgaauauggaagugcaacugauccggcagauggagucugaaggcauuuuuagcccguccgagcucgagaacagcaaucuggcugaaagagugcuugacuggcuggagaagcaugggguugaacgccucaaacggauggccaucucuggagaugacuguguggucaagccuaccgaugacagauucgcgacagcccugaccgcucuuaacgauaugggcaaggugcgcaaagacaucccccagugggagccuuccaagggguggaaugauuggcagcaaguucccuuuugcagccaccauuuccaccagcugauuaugaaagacggccgggaaaucguggucccuuguagaaaccaggaugagcucgugggacgcgcccgggucucucagggcgcuggguggucccugagagagacagccugccugggaaagagcuacgcgcaaauguggcagcucauguauuuucaccgccgggaccugagacuugccgcuaaugccauuuguuccgcugugcccguuaacugggugccgaccucucggacaaccuggagcauccaugcccaccaucaguggaugacgacagaagauaugcuguccgucuggaauagaguguggauugaggaaaacccuuggauggaggacaaaacccacguuagcucuugggaagacgugcccuaccucggcaagcgcgaggaucaauggugcgggucccugaucggacuuaccgcucgggccacaugggcgaccaauauucaggucgccaucaaccaggugagacgccugaucggcaaugagaacuaucucgacuacaugacaagcaugaagagauucaaaaaugaaucugaucccgagggggcucugugguga

SEQ ID NO: 19458 - RNA, 9879 nt, Artificial Sequence
  derived and/or modified CDS sequence (opt5) from DENV-1__KM403592__SS-prME
agcgugaccaugcugcucaugcugcuucccacagcucuggcuuuccaccucacgacccggggcggggagccucauaugaucgucuccaagcaggaacggggaaaaucucugcuuuuuaagacaagcgcuggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaaggggguggcucagaacggacggcucaucaccgccaaucccauugugacagauaaagagaagccuguuaacaucgaaacggagccgcccuucggcgaguccuauauugucaucggggccggagaaaaagcucugaagcugagcugguuuaagaaaggcucuagcauugggaagauguucgaggccaccgcuagaggcgcccgccggauggcgauccucggagacacagccugggauuuuggcuccaucgggggaguguucaccucugugggcaaacugguccaucagguguuugggacagcuuacggaguucuuuucagcggcguguccuggaccaugaagauugggaucggcauucugcucacguggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuuugugacaaacgagguucacaccuggacagaacaauauaaguuccaggccgauagcccuaaacggcucuccgcggccauuggcaaggcuugggaggagggggugugcggcaucagaucugccacccgccuggaaaauaucauguggaaacagauuagcaacgagcuuaaucauauccugcucgaaaacgacaugaaguuuacggucguggugggagacgcuaauggcauucugacacaggggaaaaagaugauccggccgcaacccauggagcacaaauacuccuggaagucuuggggaaaggccaaaauuaucggcgccgauacccagaacaccacauucaucauugacgggccugauacccccgaauguccugacgaucagagagcuuggaauaucugggaggucgaggacuauggauuuggcguuuucacgacaaacauuuggcugaaacuucgcgauagcuacacccagaugugcgaccaccggcucauguccgcggccaucaaagauagcaaggcugugcaugccgacaugggcuauuggauugaaucugagaaaaaugaaacauggaagcuggccagagcuuccuuuaucgaggugaagaccuguaucuggccccgcagccacacacuguggucuaacgggguccucgaauccgagaugauuaucccgaaaauuuacggaggcccuaucagccaacauaauuaucggcccggguacuucacccagacggccggaccuuggcaccugggcaaacuugagcuggauuucaaccucugcgaagggaccacagugguuguggacgagcacugcggaaauagaggccccucucugcggaccacaaccgucacgggcaaaauuauccaugaaugguguugccgcagcuguacacugccuccccuuagauuuagaggggaagauggaugcugguacggcauggagaucagaccggugaaggaaaaagaggaaaaccucguucgcuccauggugagcgcggggucuggagaggucgacuccuucagccugggccugcucuguguguccauuaugaucgaagagguuaugcggucuagauggagccgcaagaugcugaugaccgggacacuugcuguguuuuuccugcucauuaugggacagcugaccuggaaugaccuggucagacuuugcaucauggugggcgccaacguguccgaucggaugggcauggggaccacauaucuggcccucauggcuacguuuaagaugcgcccuauguucgccgucggacugcucuuuagacggcugaccucucgcgagguucuucugcucacaauuggccugagccugguggcguccguggaacuucccaacucucuggaggaacucggggacggacuggcuaugggcaucaugaugcucaaacugcuuaccgauuuccaaagccaccagcuguggacaacccuccugucccugacguuuauuaagacaacccuuagccuggacuacgccuggaaaaccauggccaugguccucucuaucgugucccuguucccccucugucugagcacaaccucucagaagacaacguggcuuccuguucugcugggguccuuuggaugcaaaccgcucaccauguuccugaucacagagaauaagauuuggggcagaaagagcuggccccuuaacgaaggcaucauggcuguggggauugucucuauccugcucuccagccugcucaaaaaugaugugccucuggccggaccccuuauugcuggcgggaugcugaucgccuguuauguuaucuccggaagcucugcggaccugagccucgagcgggccgcugagguguccugggaagaggaagccgagcauucuggcgcuagccacaacauucuggucgaagugcaggaugacgggaccaugaagaucaaagaugaggagcgcgacgauacacuuaccauucugcucaaggccacgcugcucgccgucuccggaguguacccuaugucuauccccgcuacccuguuuguuugguauuucuggcagaagaagaaacagagaagcggcgugcuuugggacacaccuagcccucccgaagucgagcgggcggugcuggaugacggcauuuaccgcauccugcagagagggcuccugggacggucucagguuggcgugggggucuuccaagacggaguguuucauaccauguggcacgugacaagaggcgccguucuuauguaucaggggaagcgccuggaacccagcugggcuuccgucaagaaagaucucaucagcuacggaggcggcuggcgguuccaggggucuuggaauaccggagaggaggugcaagugauugccgucgaacccggcaagaacccuaaaaaugugcaaacaaugcccgggacguuuaagaccccggagggagaaguuggcgccaucgcucuggacuucaaaccugggacauccggaagccccauugugaacagagagggcaagaucgucggccucuacgggaauggagugguuaccaccucuggcacauauguguccgccauugcgcaggcuaaggccagccaggaagggccucugcccgagaucgaggaugaagucuuuaaaaagcgcaaccuuacgauuauggaccugcaccccggauccggcaaaacccggagauaccugccugccaucgugcgcgaggcuaucaagcggaaacucagaacacugauucuugccccgacccgcguuguggcgucugaaauggcugaggcccugaaggggaugcccauccgguaucaaacaaccgccgucaagagcgaacauacgggcaaagagauuguggaucucaugugccacgcuacauucaccaugagacugcuguccccugugcggguccccaauuacaacaugaucauuauggacgaggcccauuuuaccgauccugcuagcaucgccgcgcgcggauauaucucuacaagaguuggcaugggggaagccgcugccauuuucaugaccgcuacacccccuggauccguggaggccuuuccgcagagcaaugccgugauccaggacgaagaacgggauauucccgaacgcucuuggaacagcggcuacgacuggaucaccgauuucccugggaagacggucugguuugugcccuccauuaaaucuggaaaugacaucgcuaacugucucagaaagaacggcaaacggguuauccagcuuagcagaaagacauucgacaccgaguaucaaaagaccaagaauaacgauugggacuacguggucaccacggauauuuccgagaugggggcgaauuuccgcgccgaccgggugaucgauccuagacgcugccugaagcccguuauucugaaagacggcccggaacgggugauccucgcuggaccuaugcccgucaccgccgccucugcugcccagagacgcggccggauugggagaaaccagaauaaggagggagaucaguacaucuauaugggccaaccccugaacaaugacgaagaucacgcgcauuggacagaggcuaaaaugcuucuggacaacauuaauaccccugaggggaucauccccgcccucuuugaaccugagcgcgaaaagagcgccgcuauugauggagaguacagacugcggggcgaagcccgcaagacauucguggagcugaugagaagaggggaccucccggucuggcuuuccuauaaaguggcgagcgagggcuuucaguacucugaucgcagauggugcuucgacggagaacggaacaaucagguucuggaggaaaacauggacguggagaucuggaccaaggaaggcgagcgcaaaaagcugcgcccccgguggcucgaugccagaacauauuccgacccucuggcccuucgcgaguuuaaagaguucgccgcugggcggagaagcguguccggagaucugauucucgagaucggcaagcugccccagcaccugacccuccgggcccaaaaugcucuugacaaccuggucaugcugcacaauucugaacaagggggaaaagccuaccgccaugcgauggaggaacucccugauacgauugagacacugaugcuucuggcccucaucgcuguucugaccggcggcgugacccuguuuuuccucagcgggaagggacuuggcaagacauccaucgggcugcugugugugauggccucuagcguccuccuguggauggcuuccguggagccccacuggauugccgccagcaucauucuugaauuuuuccugaugguucuccugaucccggagccugacagacagcggacaccccaggauaaccaacuggcuuauguggucauuggacuccuuuuuaugauccugacaguggcggccaacgaaaugggccugcucgagacgaccaaaaaggaccuggggaucggacaugucguggcugagaaucaccaccaugccacaaugcuugauauugaccugcacccugccucugcuuggacccucuacgccguugcgacaaccaucauuacgcccaugaugcgccauaccaucgaaaacacaaccgccaauauuucccugacagcuaucgccaaccaggcugccauucugaugggccucgauaaaggcuggccuaucagcaagauggacaucggggugccccuucuggcgcugggaugcuacucucaggucaauccgcucacccugacggccgcugugcuuaugcugguugcccacuaugcuauuaucggcccugggcuccaagccaaagcuacaagagaggcccagaagcggaccgcggccggaauuaugaagaaccccacaguggauggcaucgucgcuauugaccuggaccccgugguguacgaugccaaauucgaaaagcagcuggggcagaucaugcuccuuauccuguguaccucccaaauucugcucaugcgcaccacaugggcucugugcgagagcaucacgcuugccaccggaccucugacaacccucugggaaggcucuccgggcaaauuuuggaauacaaccauugccguuagcauggcgaacaucuucagaggguccuaucuggcuggagccggccuggcuuucucucucaugaagucccuugggggaggccggcgcgggacgggagcccagggcgagacacugggcgagaaauggaagagacagcugaaucagcucuccaagagcgaauuuaacaccuacaaacgguccgggauuauggaggucgacagaucugaagccaaggagggacugaaacgcggcgaaaccacaaagcaugcugugagccgggggaccgccaaacuuagaugguucguggagcgcaaucuggucaagcccgagggaaagguuaucgaucucggcugugggcggggaggcugguccuauuacugcgcgggccugaaaaaggugacagaagugaaaggguauacgaagggaggcccugggcacgaggaacccaucccuauggccaccuacggauggaacauugucaaacugcacucuggcagagacguguuuuucacacccccugagaagugugauacccuccuuugcgacaucggggaaagcuccccgaaucccacaauugaggagggacgcacccugcggguucugaaaaugguggaaccuuggcucagaggcaaccaauuuuguaucaagauucugaaucccuacaugccuucugucguggagacgcuugaacagaugcagcgcaagcauggcgggaugcugguucggaacccccucagcagaaauuccacccacgagauguauugggugagcugcggaacaggcaacaucgucucugcugugaacaugaccucccgcaugcugcugaaucgguucacaauggcccauagaaaaccgaccuacgagcgcgauguggaccucggggcuggaacaagacacgucgccguugaaccugagauugcgaaccuggauaucaucggccagcggauugaaaauaucaagaacgagcacaaaagcaccuggcauuaugacgaagauaaucccuacaagacgugggccuaucacgggucuuacgaggugaaacccuccggaagcgcuucuuccauggugaacggcgucgugcgccuucugacaaagccuugggacguuauucccauggugacccaaaucgccaugaccgacacaacgccuuuuggccagcagagagucuucaaggagaaaguggauacccggacaccgagacccaagcgggggaccgcucaaauuauggaaguuacagccaaauggcucuggggauuucugagccgcaauaagaaaccuagaaucuguacccgggaggaguucacacgcaaggugagauccaacgcugccaucggcgcggucuuuguggacgagaaucaguggaacagcgccaaggaagcuguugaggaugagcgguucugggaccuugugcaucgcgaaagagagcugcacaaacaggggaagugcgcuaccugcgucuauaauaugaugggaaaacgggaaaagaaacucggcgaguuugggaaggccaagggcucucgcgccauuugguacauguggcugggagccagauuccuggaguucgaggcgcucggcuuuaugaacgaggaucauugguucagccgggaaaauucccugucugggguggagggagaaggccuucacaaacugggguacauccuccgcgacauuagcaagauccccggaggcaacauguaugcugaugacacggccgggugggauaccagaauuacagaggacgaucugcagaaugaggccaaaaucaccgacaucauggaaccugagcacgcccuucuggccacauccauuuuuaagcucaccuaccaaaacaaagucgugcggguucagcgccccgcuaagucuggcacggugauggaugucaucagcagacgggaccagagaggauccggccagguggggacauauggacugaacaccuucacaaauauggaagugcaacugauucgccagauggagucugaaggcaucuuuagcccguccgagcucgagaacagcaaucuggccgaacggguucuugacuggcuggagaaacaugggguggaaagacucaagcgcauggcgauuucuggagaugacugugucgugaagccuaccgaugaccgguucgccacggcucugaccgcccuuaacgauaugggcaaaguuagaaaggacaucccccagugggagccuuccaaaggguggaaugauuggcagcaagugcccuuuugcagccaccauuuccaccagcugaucaugaaggacggccgcgaaauugucgugccuugucggaaccaggaugagcucgucggacgggcucgcgugucucagggcgccggguggucccugcgggagacagcgugccugggaaaaagcuacgcccaaauguggcagcucauguauuuucacagacgcgaccugcggcuugcugccaaugcuaucuguuccgccguucccgugaacugggucccgaccucuagaacaaccuggagcauucaugcucaccaucaguggaugacaaccgaagauaugcuguccguguggaaucggguuuggaucgaggaaaacccuuggauggaggacaagacgcacgugagcucuugggaagacguccccuaccucggcaagagagaggaucaauggugcgggucccugauuggacuuacagcccgcgcgaccugggccaccaauauccagguggcuauuaaccaggugcggagacugaucggcaaugagaacuaucucgacuacaugacaagcaugaaacgcuucaagaaugaaucugaucccgagggggcccugugguga

SEQ ID NO: 19459 - RNA, 9879 nt, Artificial Sequence
  derived and/or modified CDS sequence (opt5) from DENV-1__KM403593__SS-prME
agcgugaccaugcugcucaugcugcuucccaccgcucuggcuuuccaccucacgacccggggcggggagccucauaugaucgucuccaagcaggaacggggaaaaucucugcuuuuuaagacaagcgcuggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaaggggguggcucagaacggacggcucaucaccgccaaucccauugugacagauaaagagaagccuguuaacaucgaaacggagccgcccuucggcgaguccuauauugucaucggggccggagaaaaagcucugaagcugagcugguuuaagaaaggcucuagcauugggaagauguucgaggccaccgcuagaggcgcccgccggauggcgauccucggagacacagccugggauuuuggcuccaucgggggaguguucaccucugugggcaaacugguccaucagguguuugggacagcuuacggaguucuuuucagcggcguguccuggaccaugaagauugggaucggcauucugcucacguggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuuugugacaaacgagguucacaccuggacagaacaauauaaguuccaggccgauagcccuaaacggcucuccgcggccauuggcaaggcuugggaggagggggugugcggcaucagaucugccacccgccuggaaaauaucauguggaaacagauuagcaacgagcuuaaucauauccugcucgaaaacgacaugaaguuuacggucguggugggagacgcuaauggcauucugacacaggggaaaaagaugauccggccgcaacccauggagcacaaauacuccuggaagucuuggggaaaggccaaaauuaucggcgccgauacccagaacaccacauucaucauugacgggccugauacccccgaauguccugacgaucagagagcuuggaauaucugggaggucgaggacuauggauuuggcguuuucacgacaaacauuuggcugaaacuucgcgauagcuacacccagaugugcgaccaccggcucauguccgcggccaucaaagauagcaaggcugugcaugccgacaugggcuauuggauugaaucugagaaaaaugaaacauggaagcuggccagagcuuccuuuaucgaggugaagaccuguaucuggccccgcagccacacacuguggucuaacgggguccucgaauccgagaugauuaucccgaaaauuuacggaggcccuaucagccaacauaauuaucggcccggguacuucacccagacggccggaccuuggcaccugggcaaacuugagcuggauuucaaccucugcgaagggaccacagugguuguggacgagcacugcggaaauagaggccccucucugcggaccacaaccgucacgggcaaaauuauccaugaaugguguugccgcagcuguacacugccuccccuuagauuuagaggggaagauggaugcugguacggcauggagaucagaccggugaaggaaaaagaggaaaaccucguucgcuccauggugagcgcggggucuggagaggucgacuccuucagccugggccugcucuguguguccauuaugaucgaagagguuaugcggucuagauggagccgcaagaugcugaugaccgggacacuugcuguguuuuuccugcucauuaugggacagcugaccuggaaugaccugaucagacuuugcauuauggucggcgccaacguguccgaucggaugggcauggggaccacauaucuggcccucauggcuacguuuaagaugcgcccuauguucgccgugggacugcucuuuagacggcugaccucucgcgagguccuucugcucacaaucggccugagccugguugcguccguggaacuucccaacucucuggaggaacucggggacggacuggcuaugggcauuaugaugcucaaacugcuuaccgauuuccaaagccaccagcuguggacaacccuccugucccugacguuuaucaagacaacccuuagccuggacuacgccuggaaaaccauggccauggugcucucuaucgucucccuguucccccucugucugagcacaaccucucagaagacaacguggcuuccugugcugcugggguccuuuggaugcaaaccgcucaccauguuccugauuacagagaauaagaucuggggcagaaagagcuggccccuuaacgaaggcauuauggcuguugggaucgugucuauucugcucuccagccugcucaaaaaugaugucccucuggccggaccccuuaucgcuggcgggaugcugaucgccuguuaugugauuuccggaagcucugcggaccugagccucgagcgggccgcugagguuuccugggaagaggaagccgagcauucuggcgcuagccacaacauccugguggaaguccaggaugacgggaccaugaagauuaaagaugaggagcgcgacgauacacuuaccauccugcucaaggccacgcugcucgccguguccggagucuacccuaugucuauucccgcuacccuguuugugugguauuucuggcagaagaagaaacagagaagcggcguucuuugggacacaccuagcccucccgaaguggagcgggcgguccuggaugacggcaucuaccgcauccugcagagagggcuccugggacggucucaggugggcguugggguguuccaagacggagucuuucauaccauguggcacgugacaagaggcgccgugcuuauguaucaggggaagcgccuggaacccagcugggcuuccguuaagaaagaucucauuagcuacggaggcggcuggcgguuccaggggucuuggaauaccggagaggagguccaggugaucgccguggaacccggcaagaacccuaaaaauguccaaacaacgcccgggaccuuuaagacaccggagggagaagugggcgccauugcucuggacuucaaaccugggaccuccggaagccccaucguuaacagagagggcaagauugugggccucuacgggaauggagucgugaccacaucuggcacguauguuuccgccaucgcgcaggcuaaggccagccaggaagggccucugcccgagauugaggaugaaguguuuaaaaagcgcaaccuuaccaucauggaccugcaccccggauccggcaaaacacggagauaccugccugccaucguccgcgaggcuauuaagcggaaacucagaacccugauccuugccccgacacgcgugguugcgucugaaauggcugaggcccugaaggggaugcccauucgguaucaaaccacggccgugaaguccgaacauacaggcaaagagaucgucgaucucaugugccacgcuaccuucaccaugagacugcuguccccugugcgggugcccaauuacaacaugauuaucauggacgaggcccauuuuacagauccugcuagcaucgccgcgcgcggauauauuucuaccagagucggcaugggggaagccgcugccaucuucaugacagcuacacccccuggauccguugaggccuuuccgcagagcaaugccgugauucaggacgaagaacgggauauccccgaacgcucuuggaacagcggcuacgacuggauuacggauuucccugggaagacagugugguuuguccccuccaucaaaucuggaaaugacaucgcuaacugucucagaaagaacggcaaacgggugauucagcuuagcagaaagaccuucgacacagaguaucaaaagaccaaaaauaacgauugggacuacguugugacgaccgauaucuccgagaugggggcgaauuuccgcgccgaccgggucauugauccuagacgcugccugaagcccgugauccugaaagacggcccggaacggguuauucucgcuggaccuaugcccgugacagccgccucugcugcccagagacgcggccggaucgggagaaaccagaauaaggagggagaucaguacauuuauaugggccaaccccugaacaaugacgaagaucacgcgcauuggaccgaggcuaaaaugcuucuggacaacaucaauacaccugaggggaucauucccgcccucuuugaaccugagcgcgaaaagagcgccgcuaucgauggagaguacagacugcggggcgaagcccgcaagaccuucgucgagcugaugagaagaggggaccucccgguguggcuuuccuauaaagucgcgagcgagggcuuucaguacucugaucgcagauggugcuucgacggagaacggaacaaucaggugcuggaggaaaacauggacguugagauuuggacaaaggaaggcgagcgcaagaagcugcgcccccgguggcucgaugccagaaccuauuccgacccucuggcccuucgcgaguuuaaagaguucgccgcugggcggagaagcguguccggagaucugauccucgagauuggcaagcugccccagcaccugacgcuccgggcccaaaaugcucuugacaaccuggugaugcugcacaauucugaacaagggggaaaagccuaccgccaugcgauggaggaacucccugauacaaucgagacccugaugcuucuggcccucaucgcuguccugaccggcggcguuacacuguuuuuccucagcgggaagggacuuggcaagaccuccauugggcugcugugugugauggccucuagcgugcuccuguggauggcuuccgucgagccccacuggaucgccgccagcauuauccuugaauuuuuccugauggugcuccugauuccggagccugacagacagcggacaccccaggauaaccaacuggcuuauguugugaucggacuccuuuuuaugauccugacggucgcggccaacgaaaugggccugcucgagaccaccaagaaggaccuggggauuggacauguggucgcugagaaucaccaccaugccaccaugcuugauaucgaccugcacccugccucugcuuggacacucuacgccguggcgaccacgauuaucacccccaugaugcgccauacaauugaaaacaccacagccaauaucucccugaccgcuauugccaaccaggcugccauccugaugggccucgauaaaggcuggccuaucagcaagauggacauugggguuccccuucuggcgcugggaugcuacucucaggugaauccgcucacgcugacagccgcuguccuuaugcugguggcccacuaugcuaucauuggcccugggcuccaagccaaagcuaccagagaggcccagaagcggacagcggccggaaucaugaagaaccccaccguugauggcauuguggcuaucgaccuggaccccgucguguacgaugccaaauucgaaaagcagcuggggcagaucaugcuccuuauucuguguaccucccaaauccugcucaugcgcacaacgugggcucugugcgagagcauuacccuugccacaggaccucugaccacacucugggaaggcucuccgggcaaauuuuggaauaccacgaucgccgugagcauggcgaacauuuucagaggguccuaucuggcuggagccggccuggcuuucucucucaugaaaagccuugggggaggccggcgcgggacaggagcccagggcgagacccugggcgagaaauggaagagacagcugaaucagcucuccaagagcgaauuuaacaccuacaaacgguccgggaucauggagguugacagaucugaagccaaggagggacugaaacgcggcgaaacaaccaagcaugcugucagccgggggacagccaaacuuagaugguucguggagcgcaaucuggugaagcccgagggaaaggucaucgaucucggcugugggcggggaggcugguccuauuacugcgcgggccugaaaaagguuacggaagugaaaggguauaccaagggaggcccugggcacgaggaacccauuccuauggccacauacggauggaacaucgugaaacugcacucuggcagagacgucuuuuucacacccccugagaagugugauacccuccuuugcgacauuggggaaagcuccccgaaucccaccaucgaggagggacgcacgcugcgggugcugaaaaugguugaaccuuggcucagaggcaaccaauuuuguauuaagauccugaaucccuacaugccuucuguggucgagacccuugaacagaugcagcgcaagcauggcgggaugcuggugcggaacccccucagcagaaauuccacacacgagauguauuggguuagcugcggaaccggcaacauugugucugcugucaacaugacaucccgcaugcugcugaaucgguucaccauggcccauagaaaaccgacauacgagcgcgauguggaccucggggcuggaaccagacacguggccgucgaaccugagaucgcgaaccuggauaucauuggccagcggaucgaaaauauuaagaacgagcacaaaagcacguggcauuaugacgaagauaaucccuacaagacaugggccuaucacgggucuuacgagguuaaacccuccggaagcgcuucuuccauggugaacggcgugguccgccuucugaccaagccuugggacgugauccccaugguuacccaaauugccaugacagacacgaccccuuuuggccagcagagaguguucaaggagaaagucgauacacggaccccgagacccaagcgggggacagcucaaaucauggaagugaccgccaaauggcucuggggauuucugagccgcaauaagaaaccuagaaucuguacacgggaggaguucacccgcaagguuagauccaacgcugccauuggcgcgguguuugucgacgagaaucaguggaacagcgccaaggaagcuguggaggaugagcgguucugggaccuuguucaucgcgaaagagagcugcacaaacaggggaagugcgccacgugcguguauaauaugaugggaaaacgggaaaagaaacucggcgaguuugggaaggcuaagggcucucgcgccaucugguacauguggcugggagccagauuccuggaguucgaggcgcucggcuuuaugaacgaggaucauugguucagccgggaaaauucccugucuggggucgagggagaaggccuucacaaacugggguacauucuccgcgacaucagcaagauucccggaggcaacauguaugcugaugacaccgccgggugggauacaagaaucaccgaggacgaucugcagaaugaggccaaaaucacagacauuauggaaccugagcacgcccuucuggccaccuccaucuuuaagcucacguaccaaaacaaagugguccgggugcagcgccccgcuaagucuggcacaguuauggaugugauuagcagacgggaccagagaggauccggccaggucgggaccuauggacugaacacauucaccaauauggaagugcaacugauccgccagauggagucugaaggcauuuuuagcccguccgagcucgagaacagcaaucuggccgaacgggugcuugacuggcuggagaaacaugggguugaaagacucaagcgcauggcgaucucuggagaugacuguguggucaagccuacggaugaccgguucgccaccgcucugacagcccuuaacgauaugggcaaagugagaaaggacaucccccagugggagccuuccaaaggguggaaugauuggcagcaaguucccuuuugcagccaccauuuccaccagcugauuaugaaggacggccgcgaaaucguggucccuugucggaaccaggaugagcucgugggacgggcucgcgucucucagggcgccggguggucccugcgggagaccgcgugccugggaaaaagcuacgcccaaauguggcagcucauguauuuucacagacgcgaccugcggcuugcugccaaugcuauuuguuccgccgugcccguuaacugggugccgacaucuagaaccacauggagcauccaugcucaccaucaguggaugaccacggaagauaugcuguccgucuggaaucggguguggauugaggaaaacccuuggauggaggacaagacacacguuagcucuugggaagacgugcccuaccucggcaagagagaggaucaauggugcgggucccugaucggacuuaccgcccgcgcgaccugggccacaaauauucaggucgcuaucaaccaggugcggagacugaucggcaaugagaacuaucucgacuacaugaccagcaugaaacgcuucaagaaugaaucugaucccgagggggcccugugguga

SEQ ID NO: 19460 - RNA, 9879 nt, Artificial Sequence
  derived and/or modified CDS sequence (opt5) from DENV-1__KM403603__SS-prME
agcgugaccaugcugcucaugcugcuucccacagcccuggcuuuccaccucacgacccggggcggggagccucauaugauugucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagcugcgcccccgguggcucgaugcgagaacguauuccgacccucuggcccuucgcgaguuuaaagaguucgcugccgggcggagaagcguguccggagaucugauccucgagauuggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucaucgccguccugacaggcggcguuacccuguuuuuccucagcgggaagggacuuggcaagacauccauugggcugcugugugugauggcuucuagcgugcuccuguggauggccuccgucgagccccacuggaucgcugccagcauuauccuugaauuuuuccugauggugcuccugauuccggagccugacagacagcggacgccccaggauaaccaacuggccuauguugugaucggacuccuuuuuaugauccugaccgucgcugcgaacgaaaugggccugcucgagacaaccaaaaaggaccuggggauuggacauguggucgccgagaaucaccaccaugcuacaaugcuugauaucgaccugcacccugccucugccuggacccucuacgcuguggccacgaccauuaucacacccaugaugcgccauaccauugaaaacacaaccgcgaauaucucccugacggccauugcuaaccaggccgcuauccugaugggccucgauaaaggcuggccuaucagcaagauggacauugggguuccccuucuggcccugggaugcuacucucaggugaauccgcucacacugaccgcggccguccuuaugcugguggcucacuaugccaucauuggcccugggcuccaagcuaaagccacaagagaggcucagaagcggaccgccgcgggaaucaugaagaaccccaccguugauggcauuguggccaucgaccuggaccccgucguguacgaugcuaaauucgaaaagcagcuggggcagaucaugcuccuuauucuguguacaucccaaauccugcucaugcgcacgaccugggcccugugcgagagcauuacacuugcuaccggaccucugacaacccucugggaaggcucuccgggcaaauuuuggaauacgacaaucgccgugagcauggccaacauuuucagaggguccuaucuggcgggagcuggccuggccuucucucucaugaagacccuugggggaggccggcgcgggaccggagcucagggcgagacacugggcgagaaauggaagagacagcugaaucagcucagcaaguccgaauuuaacaccuacaaacggagcgggaucauggagguugacagauccgaagccaaggagggacugaaacgcggcgaaacaacgaagcaugccgucucucgggggaccgcuaaacuuagaugguucguggagcgcaaucuggugaagcccgagggaaaggucaucgaucucggcugugggcggggaggcuggagcuauuacugcgccggccugaaaaagguuacagaagugaaaggguauaccaagggaggcccugggcacgaggaacccauuccuauggcgacauacggauggaacaucgugaaacugcacuccggcagagacgucuuuuucacgcccccugagaagugugauacccuccuuugcgacauuggggaaucuagcccgaaucccaccaucgaggagggacgcacacugcgggugcugaaaaugguugaaccuuggcucagaggcaaccaauuuuguauuaagauccugaaucccuacaugccuuccguggucgagacccuugaacagaugcagcgcaagcauggcgggaugcuggugcggaacccccucucuagaaauagcacacacgagauguauuggguuuccugcggaaccggcaacauugugagcgccgucaacaugacaucucgcaugcugcugaaucgguucaccauggcucauagaaaaccgacguacgagcgcgauguggaccucggggccggaacaagacacguggcugucgaaccugagaucgccaaccuggauaucauuggccagcggaucgaaaauauuaagaacgagcacaaauccaccuggcauuaugacgaagauaaucccuacaagaccugggcguaucacgggagcuacgagguuaaacccucuggauccgccagcucuauggugaacggcgugguccgccuucugacaaagccuugggacgugauccccaugguuacgcaaauugcuaugaccgacacaaccccuuuuggccagcagagaguguucaaggagaaagucgauacacggaccccgagacccaagcgggggacagcccaaaucauggaagugaccgcuaaauggcucuggggauuucugucccgcaauaagaaaccuagaaucuguacgcgggaggaguucacccgcaagguuagaagcaacgccgcuauuggcgccguguuugucgacgagaaucaguggaacuccgcgaaggaagccguggaggaugagcgguucugggaccuuguucaucgcgaaagagagcugcacaaacaggggaagugcgcuacaugcguguauaauaugaugggaaaacgggaaaagaaacucggcgaguuugggaaggccaagggcagccgcgcuaucugguacauguggcugggagccagauuccuggaguucgaggcccucggcuuuaugaacgaggaucauugguucucucgggaaaauagccuguccggggucgagggagaaggccuucacaaacugggguacauucuccgcgacaucucuaagauucccggaggcaacauguaugcggaugacaccgcugggugggauacaagaaucaccgaggacgaucugcagaaugaggccaaaaucacggacauuauggaaccugagcacgcccuucuggcuacaagcaucuuuaagcucaccuaccaaaacaaagugguccgggugcagcgccccgccaaguccggcacaguuauggaugugauuucuagacgggaccagagaggaagcggccaggucgggaccuauggacugaacacguucaccaauauggaagugcaacugauccgccagauggaguccgaaggcaucuuuucuccgagcgagcucgagaacuccaaucuggcugaacgggugcuugacuggcuggagaaacaugggguugaaagacucaagcgcauggccaucagcggagaugacuguguggucaagccuacagaugaccgguucgcgaccgcccugacagcucuuaacgauaugggcaaagugagaaaggacaucccccagugggagccuucuaaaggguggaaugauuggcagcaaguucccuuuugcucccaccauuuccaccagcugauuaugaaggacggccgcgaaaucguggucccuugucggaaccaggaugagcucgugggacgggcccgcgucagccagggcgcuggguggucucugcgggagaccgccugccugggaaaauccuacgcgcaaauguggcagcucauguauuuucacagacgcgaccugcggcuugccgcuaaugccauuuguagcgcugugcccguuaacugggugccgacauccagaaccacguggucuauccaugcccaccaucaguggaugacaaccgaagauaugcugagcgucuggaaucggguguggauugaggaaaacccuuggauggaggacaagacccacguuuccagcugggaagacgugcccuaccucggcaagagagaggaucaauggugcgggucucugaucggacuuacagcucgcgccaccugggcgacaaauauucaggucgccaucaaccaggugcggagacugaucggcaaugagaacuaucucgacuacaugacguccaugaaacgcuucaagaaugaaagcgaucccgagggggcucugugguga

SEQ ID NO: 19461 - RNA, 9879 nt, Artificial Sequence
  derived and/or modified CDS sequence (opt5) from DENV-1__KM403585__SS-prME
agcgugaccaugcugcucaugcugcuucccacagcucuggcuuuccaccucacgaccagaggcggggaaccucauaugaucguguccaagcaggaacggggaaagucucugcuuuuuaagacaagcgccggcguuaacaugugcacccugauugcgauggaccucggggaacugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguugcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggacggauuguucaguacgaaaaccugaaguauucugugaucgucacggugcacaccggcgaucagcaucaaguugggaaugagacaaccgaacacggaacaaucgcuaccauuacgccccaggccccuaccuccgaggugcagcugacagacuacggcgcccucacccuggacuguagcccccgcacaggccuugauuucaacgaaaugguccugcucaccaugaaagagaagucuuggcuggugcauaaacagugguuucuugaccugccucuccccuggacguccggggcuagcacaucccaagagaccuggaauagacaggaucugcuggucacauucaagaccgcgcacgccaaaaagcaggaagugguugugcucggaucucaagagggcgcuaugcacaccgcccugacaggggccacggaaauccagaccagcggaacaaccacaauuuuugcuggccaucuuaagugccggcugaaaauggacaagcucacccugaaaggggucuccuaugugauguguacgggcagcuucaagcuggagaaagaaguugccgagacacagcacggaaccgugcuuguccaggugaaguacgagggcaccgaugcgccgugcaagaucccuauuucuacacaagacgaaaaaggggugacccagaacggaagacucaucacagcuaaucccaucguuacggauaaggagaaaccugucaacauugaaaccgagccgcccuucggcgaguccuauaucgugauuggggccggagaaaaggcccugaaacugagcugguuuaagaagggcucuagcaucgggaaaauguucgaggcuacagcccgcggcgcucggagaauggccauucucggagacaccgcgugggauuuuggcuccaucgggggaguguucacaucugucggcaagcuggugcaucagguuuuugggaccgccuacggagugcuuuucagcggcgucuccuggacgaugaaaaucgggauuggcauccugcucaccuggcugggacugaauagccgcucuacaucccuuagcaugaccuguauugcugugggcaugguuacacucuaccugggggugaugguccaggccgacucuggaugcgugaucaacuggaagggccgggaacugaaauguggguccggaauuuuuguuaccaacgaggugcacacauggaccgaacaauauaaguuccaggcugauagcccuaagagacucuccgccgcgaucggcaaagccugggaggagggggucugcggcauucgcucugcuacgcggcuggaaaauaucauguggaagcagaucagcaacgagcuuaaucauauucugcucgaaaacgacaugaaauuuacagugguggucggagacgccuacggcauccugacccaggggaagaaaaugauuagaccgcaacccauggagcacaaguauuccuggaaaucuuggggaaaggcuaagaucauuggcgccgauacccagaauacaaccuucaucaucgacgggccugauacgcccgaauguccugacgaucagcgcgccuggaacauuugggagguugaggacuacggauuuggcguguucacaaccaauaucuggcugaaacuucgggauagcuauacacagaugugcgaccacagacucauguccgcugcgauuaaggauagcaaagccgugcaugcugacaugggcuacuggaucgaaucugagaagaacgaaaccuggaaacuggcccgcgccuccuuuauugaggucaagacauguaucuggccccggagccacacccuguggucuaauggggugcucgaauccgagaugaucauuccgaagaucuauggaggcccuauuagccaacauaacuacagacccggguacuucacgcagaccgcuggaccuuggcaccugggcaaacuugagcuggauuucaaucucugcgaagggacaaccguuguggucgacgagcacugcggaaaccggggccccucucugcgcacaaccacggugacaggcaagaucauucaugaaugguguugcagaagcuguacccugccuccccuucgguuuagaggggaggauggaugcugguauggcauggagauccgcccgguuaaagaaaaggaggaaaaucucgugcgguccauggucagcgccgggucuggagagguggacuccuucagccugggccugcucuguguuuccaucaugauugaagaggugaugagaucucgcuggagcagaaaaaugcugaugacagggacccuugcggucuuuuuccugcucaucaugggacagcugaccuggaacgaccugauucggcuuugcaucauggugggcgcuaauguguccgaucgcaugggcauggggacaacguaccuggcccucauggccaccuuuaagaugagaccuauguucgcugucggacugcucuuucggcgccugacaucuagagagguucuucugcucaccauuggccugagccugguggccuccguggaacuucccaacucucuggaggaacucggggacggacuggcgaugggcaucaugaugcucaagcugcuuacagauuuccaaagccaccagcuguggaccacgcuccugucccugacauuuauuaaaaccacccuuagccuggacuaugcuuggaagacaauggccaugguccucucuaucgugucccuguucccccucugucugagcaccacaucucagaaaacgaccuggcuuccuguucugcugggguccuuuggaugcaagccgcucacaauguuccugaucaccgagaacaaaauuuggggccggaaguccuggccccuuaaugaaggcaucauggccguggggauugucucuauccugcucuccagccugcucaagaacgaugugccucuggcuggaccccuuauugccggcgggaugcugaucgcuuguuacguuaucuccggaagcucugccgaccugagccucgagcgcgcggccgagguguccugggaagaggaagcugagcauucuggcgccagccacaauauucuggucgaagugcaggaugacgggacaaugaaaaucaaggaugaggagagagacgauacccuuacgauucugcucaaagcuacccugcucgccgucuccggaguguauccuaugucuauccccgccacacuguuuguuugguacuucuggcaaaagaaaaagcagcggagcggcgugcuuugggacaccccuagcccucccgaagucgagcgcgcugugcuggaugacggcauuuauagaauccugcagcgggggcuccugggaagaucucagguuggcgugggggucuuccaagacggaguguuucauacaauguggcacgugacccgcggcgcgguucuuauguaccaggggaaacggcuggaacccagcugggccuccgucaagaaggaucucaucagcuacggaggcggcuggagauuccaggggucuuggaacacaggagaggagguccaggugauugcugucgaacccggcaaaaauccuaagaacgugcaaacgacccccgggacauuuaaaaccccggagggagaaguuggcgccaucgcccuggacuucaagccugggaccuccggaagccccauugugaaucgcgagggcaaaaucgucggccucuaugggaacggagugguuacaacgucuggcaccuacguguccgcuauugcccaggcgaaggcuagccaggaagggccucugcccgagaucgaggaugaagucuuuaagaaacggaaucuuacaauuauggaccugcaccccggauccggcaagaccagacgcuaucugccugccaucgugcgggaggccaucaaaagaaagcuccgcacacugauucuugcuccgacccggguuguggccucugaaauggcggaggcucugaaagggaugcccaucagauaccaaacgacagccgucaagagcgaacauaccggcaaggagauuguggaucucaugugccacgccaccuucacaaugcggcugcuguccccugugcgcguccccaacuauaauaugaucauuauggacgaggcucauuuuaccgauccugccagcaucgcugccagaggauacaucucuacacggguuggcaugggggaagcggccgcuauuuucaugaccgccacgcccccuggauccguggaggcuuuuccgcagagcaacgccgugauccaggacgaagaacgcgauauucccgaaagaucuuggaauagcggcuaugacuggaucacagauuucccugggaaaaccgucugguuugugcccuccauuaagucuggaaacgacaucgccaauugucuccggaaaaacggcaagagaguuauccagcuuagccgcaaaacauucgacaccgaguaccaaaagacgaagaacaaugauugggacuacguggucaccacagauauuuccgagaugggggcuaacuuccgggcggacagagugaucgauccucgccggugccugaaacccguuauucugaaggacggcccggaaagagugauccucgccggaccuaugcccgucaccgcugccucugccgcucagcgccggggcagaauugggcgcaaucagaacaaagagggagaucaguauaucuacaugggccaaccccugaauaacgacgaagaucacgcccauuggacagaggcgaagaugcuucuggacaauauuaacaccccugaggggaucauccccgcucucuuugaaccugagagagaaaagagcgccgccauugauggagaguaucggcugcgcggcgaggcuagaaagacauucguggagcugaugcggcgcggggaccucccggucuggcuuuccuacaagguggccagcgagggcuuucaguauucugauagacgguggugcuucgacggagaaagaaauaaccagguucuggaggaaaauauggacguggagaucuggaccaaagaaggcgagcgcaagaaacugcggcccagauggcucgaugcgcgcacguacuccgacccucuggcccuucgggaguuuaaggaguucgcugccgggagacggagcguguccggagaucugauucucgagaucggcaaacugccccagcaccugacacuccgcgcucaaaacgcccuugacaaucuggucaugcugcacaacucugaacaagggggaaaggcuuauagacaugccauggaggaacucccugauaccauugagacccugaugcuucuggcgcucaucgccguucugacaggcggcgugacccuguuuuuccucagcgggaaaggacuuggcaagacauccaucgggcugcugugugugauggcuucuagcguccuccuguggauggccuccguggagccccacuggauugcugccagcaucauucuugaauuuuuccugaugguucuccugaucccggagccugaccggcagcgcacgccccaggauaaucaacuggccuacguggucauuggacuccuuuuuaugauccugaccguggcugcgaacgaaaugggccugcucgagacaaccaagaaagaccuggggaucggacaugucguggccgagaaccaccaccaugcuacaaugcuugauauugaccugcacccugccucugccuggacccucuacgcuguugccacgaccaucauuacacccaugaugagacauaccaucgaaaauacaaccgcgaacauuucccugacggccaucgcuaaucaggccgcuauucugaugggccucgauaagggcuggccuaucagcaaaauggacaucggggugccccuucuggcccugggaugcuauucucaggucaacccgcucacacugaccgcggccgugcuuaugcugguugcucacuacgccauuaucggcccugggcuccaagcuaaggccacacgggaggcucagaaacgcaccgccgcgggaauuaugaagaaucccaccguggauggcaucgucgccauugaccuggaccccgugguguaugaugcuaaguucgaaaaacagcuggggcagaucaugcuccuuauccuguguacaucccaaauucugcucaugagaacgaccugggcccugugcgagagcaucacacuugcuaccggaccucugacaacccucugggaaggcucuccgggccgguuuuggaacacgacaauugccguuagcauggccaauaucuuccgcggguccuaccuggcgggagcuggccuggccuucucucucaugaaaagccuugggggaggcagacgggggaccggagcucagggcgagacccugggcgagaaauggaagagacagcugaaccagcucuccaaaagcgaauuuaauacauauaagcgcuccgggauugucgagguggaccggucugaagccaaggagggaaugaaaagaggcgaaaccacaaagcaugccgugagccgcgggacggcuaaacugcggugguucgucgagagaaaccuuguuaagcccgagggaaaagugaucgaucugggcugugggcgcggaggcugguccuacuauugcgccggccucaagaaggugaccgaagucaaaggguacacaaagggaggcccugggcacgaggaacccaucccuauggcgaccuacggauggaauauugugaaacugcacucuggccgggacgucuuuuucacacccccugagaagugugauacccugcucugcgacaucggggaaagcuccccgaaccccacgauugaggagggaagaacccuucgcgugcugaaaauggucgaaccuuggcugcggggcaaucaauuuuguaucaagauucucaaccccuauaugccuucugugguugagacacuggaacagaugcagagaaaacauggcgggaugcuugugcgcaauccccugagccggaacuccacccacgagauguacugggucagcugcggaacaggcaauaucgugucugccgugaacaugaccuccagaaugcuccugaaccgcuucacaauggcucauagaaagccgaccuaugagcgggaugucgaccugggggccggaacgcgccacguugcuguggaaccugagauugccaaucucgauaucaucggccagagaauugaaaacaucaagaaugagcacaaaagcacauggcauuacgacgaagauaaccccuauaagaccugggcguaccacgggucuuaugaggugaaacccuccggaagcgccucuuccauggucaauggcgugguucggcugcuuaccaagccuugggacgugauucccauggucacacaaaucgcuaugacggacaccacaccuuuuggccagcagagaguguucaaagagaagguugauacccggacaccgcgccccaagagagggaccgcccaaauuauggaagugacagcuaaauggcuguggggauuucucagccggaacaagaaaccucgcaucuguaccagagaggaguucacgcggaagguccgcuccaaugccgcuaucggcgccguguuuguugacgagaaccaguggaauagcgcgaaagaagccguggaggaugagagauucugggaccugguccaucgggaacgcgagcuucacaagcaggggaagugcgcuaccugcguguacaacaugaugggaaaaagagaaaagaaacugggcgaguuugggaaggccaaaggcucucgggcuauuugguacauguggcucggagcccgcuuccuggaguucgaggcccugggcuuuaugaaugaggaucauugguucagcagagaaaacucccucucuggggucgagggagaaggccugcacaaacuuggguauauccugcgggacauuagcaagauccccggaggcaauauguacgcggaugacacagcugggugggauacccgcauuacagaggacgaucuccagaacgaggccaaaaucaccgacaucauggaaccugagcacgcccugcuugcuacguccauuuuuaagcugacauaucaaaauaaagugguuagagugcagcggcccgccaagucuggcaccgucauggaugugaucagcagacgcgaccagcggggauccggccagguggggacauacggacucaacaccuucacgaacauggaaguucaacugauuagacagauggagucugaaggcaucuuuagcccguccgagcuggagaauagcaaccucgcugaacgcgugcuggacuggcuugagaaacauggggucgaacggcugaagagaauggccauuucuggagaugacugugugguuaaaccuaccgaugaccgcuucgcgacagcccucaccgcucugaaugauaugggcaaggugcggaaggacaucccccagugggagccuuccaaaggguggaacgauuggcagcaaguccccuuuugcagccaccauuuccaccagcuuaucaugaaggacggcagagaaauuguggucccuugucgcaaucaggaugagcuggugggacgggccagaguuucucagggcgcuggguggucccuccgcgagacagccugccugggaaaaagcuaugcgcaaauguggcagcugauguacuuucaccggagagaccuccggcuggccgcuaacgccaucuguuccgcugugcccgucaauugggugccgaccucuagaacaaccuggagcauucaugcccaccaucaguggaugacgacagaagauaugcuuuccguuuggaaccgcguguggaucgaggaaaauccuuggauggaggacaagacccacgucagcucuugggaagacgugcccuaucugggcaaacgggaggaucaauggugcgggucccucauuggacugaccgcuagagccacaugggcgaccaacauccagguggccauuaaucagguucgcagacuuaucggcaacgagaauuaccuggacuacaugacaagcaugaagcgguucaagaacgaaucugaucccgagggggcucucugguga

SEQ ID NO: 19462 - RNA, 9879 nt, Artificial Sequence
  derived and/or modified CDS sequence (opt5) from DENV-1__KM403595__SS-prME
agcgugaccaugcugcucaugcugcuucccacagcucuggcuuuccaccucacgacccggggcggggaaccucauaugaucgucuccaagcaggaacggggaaaaucucugcuuuuuaagaccagcgccggcguuaacaugugcacccugauugcgauggaccucggggaacugugugaagauacaaugaccuacaaaugcccgcgcaucacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaggagaaaucuuggcugguccauaagcagugguuucuugaccugccucuccccuggacguccggggcuagcacaucccaagagaccuggaaucggcaggaucugcuggugacauucaaaaccgcgcacgccaagaaacaggaagucgugguucucggaucucaagagggcgcuaugcacaccgcccugacaggggccacggaaauucagaccagcggaacaaccacaaucuuugcuggccaucuuaagugcagacugaagauggacaaacucacccugaaggggguguccuaugucauguguacgggcagcuucaaacuggagaaggaaguggccgagacacagcacggaaccguucuugugcaggucaaauacgagggcaccgaugcgccgugcaagauuccuaucucuacacaagacgaaaagggggugacccagaacggacgccucaucacagcuaaucccauugugacggauaaagagaagccuguuaacaucgaaauugagccgcccuucggcgaguccuauaucgucauuggggccggagaaaaagcccugaagcugagcugguuuaaaaagggcucuagcaucgggaagauguucgaggcuaccgcccggggcgcuagacgcauggccauccucggagacacagcgugggauuuuggcuccauugggggaguguucaccucugugggcaaacugguccaucagguguuugggacagccuacggaguucuuuucagcggcguguccuggaccaugaagaucgggauuggcauccugcucacguggcugggacugaauagccggucuaccucccuuagcaugacauguauugcugucggcauggugacccucuaccuggggguuauggugcaggccgacucuggaugcgucaucaacuggaaaggcagagaacugaaguguggguccggaauuuuugugacaaacgagguucacaccuggacagaacaauauaaauuccaggcugauagcccuaagcgccucuccgccgcgaucggcaaggccugggaggagggggugugcggcauccggucugcuaccagacuggaaaauauuauguggaaacagaucagcaacgagcuuaaucauauucugcucgaaaacgacaugaaguuuacggucguggugggagacgccaauggcauccugacacaggggaaaaagaugauucgcccgcaacccauggagcacaaauacuccuggaagucuuggggaaaagcuaagaucaucggcgccgauacccagaacaccacauucauuaucgacgggccugauacccccgaauguccugacgaucagcgggccuggaauauuugggaggucgaggacuauggauuuggcguuuucacgacaaacaucuggcugaaacuuagagauagcuacacccagaugugcgaccaccgccucauguccgcugcgauuaaagauagcaaggccgugcaugcugacaugggcuauuggaucgaaucugagaaaaaugaaacauggaagcuggcccgggccuccuuuaucgaggugaaaaccuguauuuggcccagaagccacacacuguggucuaacgggguccucgaauccgagaugaucauuccgaagaucuacggaggcccuauuagccaacauaauuaucggcccggguacuucacccagacggcuggaccuuggcaccugggcaaacuugagcuggauuucaaccucugcgaagggaccacagugguuguggacgagcacugcggaaaucgcggccccucucugagaaccacaaccgucacgggcaaaaucauccaugaaugguguugccggagcuguacacugccuccccuuagauuucgcggggaggauggaugcugguacggcauggagauucggccggugaaggaaaaagaggaaaaccucguuagauccauggugagcgccgggucuggagaggucgacuccuucagccugggccugcucuguguguccaucaugauugaagagguuaugcgcucuagauggagccggaagaugcugaugaccgggacacuugcgaucuuuuuccugcucauuaugggacagcugaccuggaaugaccugauccgccuuugcauuauggugggcgcuaacgucuccgauagaaugggcauggggaccacauaucuggcccucauggccacguuuaaaaugcggccuauguucgcugugggacugcucuuucgcagacugaccucucgggaggugcuucugcucacaaucggccugagccuggucgccuccguugaacuucccaacucucuggaggaacucggggacggacuggcgaugggcaucaugaugcucaagcugcuuaccgauuuccaaagccaccagcuguggacaacccuccugucccugacguuuauuaagacaacccuuagccuggacuacgcuuggaaaaccauggccauggugcucucuaucgugucccuguucccccucugucugagcacaaccucucagaagacaacguggcuuccuguccugcugggguccuuuggaugcaaaccgcucaccauguuccugauuacagagaauaagaucuggggccgcaaaagcuggccccuuaacgaaggcauuauggccguggggaucguuucuauccugcucuccagccugcucaagaaugaugugccucuggcuggaccccuuauugccggcgggaugcugaucgcuuguuaugucauuuccggaagcucugccgaccugagccucgagagagcggccgagguguccugggaagaggaagcugagcauucuggcgccagccacaacauccugguugaagugcaggaugacgggaccaugaagauuaaagaugaggagcgggacgauacacuuaccauccugcucaaggcuacgcugcucgccgucuccggaguguacccuaugucuauccccgccacccuguuugucugguauuucuggcagaagaagaaacagcgcagcggcgugcuuugggacacaccuagcccucccgaaguugagagagcugugcuggaugacggcauuuaccggauccugcagagagggcuccugggacgcucucaggucggcguggggguuuuccaagacggaguguuucauaccauguggcacgucacacggggcgcggugcuuauguaucaggggaaaagacuggaacccagcugggccuccgugaaaaaggaucucauuagcuacggaggcggcuggcgcuuccaggggucuuggaauaccggagaggagguucaggucaucgcuguggaacccggcaagaacccuaaaaaugugcaaacaacgcccgggaccuuuaagacaccggagggagaagucggcgccauugcccuggacuucaaaccugggaccuccggaagccccaucgugaaccgggagggcaagauuguuggccucuacgggaauggaguggucaccacaucuggcacguauguguccgcuaucgcccaggcgaaagcuagccaggaagggccucugcccgagaucgaggaugaaguuuuuaagaagagaaaccuuaccauuauggaccugcaccccggauccggcaaaacacgccgguaccugccugccaucgugagagaggccauuaagcgcaaacuccggacccugauccuugcuccgacaagagucguggccucugaaauggcggaggcucugaaggggaugcccauucgguaucaaaccacggccguuaaaagcgaacauacaggcaaggagaucguggaucucaugugccacgccaccuucaccaugcgccugcuguccccugucagagugcccaauuacaacaugaucauuauggacgaggcucauuuuacagauccugccagcaucgcugcccggggauauauuucuacccgcgugggcaugggggaagcggccgcuaucuucaugacagccacacccccuggauccgucgaggcuuuuccgcagagcaaugccguuauucaggacgaagagagagauauccccgaacggucuuggaacagcggcuacgacuggaucacggauuucccugggaagacagugugguuugugcccuccauuaaaucuggaaaugacaucgccaacugucucagaaagaacggcaaacgcgucauucagcuuagccggaagaccuucgacacagaguaucagaagaccaagaauaacgauugggacuacgugguuacgaccgauaucuccgagaugggggcuaauuucagagcggaccgcgugauugauccucggagaugccugaagcccgucauccugaaagacggcccggaacgcgugauucucgccggaccuaugcccguuacagcugccucugccgcucagcggagaggccgcaucgggagaaaccagaauaaggagggagaucaguacaucuauaugggccaaccccugaacaaugacgaagaucacgcccauuggaccgaggcgaaaaugcuucuggacaacauuaauacaccugaggggaucauucccgcucucuuugaaccugagcgggaaaagagcgccgccaucgauggagaguaccgccugagaggcgaagcucggaaaaccuucguggagcugaugcgcagaggggaccucccggucuggcuuuccuauaagguggccagcgagggcuuucaguacucugaucggagauggugcuucgacggagaacgcaacaaucagguccuggaggaaaacauggacguggagauuuggacaaaggaaggcgagcggaaaaagcugagaccccgcuggcucgaugcgcggaccuauuccgacccucuggcccuuagagaguuuaaagaguucgcugccgggcggcgcagcguuuccggagaucugauccucgagaucggcaagcugccccagcaccugacgcucagagcucaaaaugcccuugacaaccuggugaugcugcacaauucugaacaagggggaaaggcuuaccggcaugccauggaggaacucccugauacaauugagacccugaugcuucuggcgcucaucgccgugcugaccggcggcgucacacuguuuuuccucagcgggaagggacuuggcaaaaccuccauugggcugcuguguguuauggcuucuagcgugcuccuguggauggccuccguggagccccacuggaucgcugccagcauuauccuugaauuuuuccugaugguccuccugaucccggagccugaccgccagagaacaccccaggauaaccaacuggccuaugugguuauuggacuccuuuuuaugauccugacgguggcugcgaacgaaaugggccugcucgagaccacaaagaaggaccuggggauuggacaugucguggccgagaaucaccaccaugcuaccaugcuugauaucgaccugcacccugccucugccuggacacucuacgcugucgccaccacgauuaucacccccaugaugcggcauacaauugaaaacaccacagcgaauaucucccugaccgccaucgcuaaccaggccgcuauucugaugggccucgauaaaggcuggccuaucagcaagauggacauuggggugccccuucuggcccugggaugcuacucucagguuaauccgcucacgcugacagcggccgugcuuaugcuggucgcucacuaugccaucauuggcccugggcuccaagcuaaagccacccgcgaggcucagaagagaacagccgcgggaaucaugaaaaaccccaccguggauggcaucguugccauugaccuggaccccguggucuacgaugcuaaguucgaaaagcagcuggggcagaucaugcuccuuauucuguguaccucccaaauccugcucaugcggacaacgugggcccugugcgagagcauuacccuugcuacaggaccucugaccacacucugggaaggcucuccgggcaaauuuuggaauaccacgaucgccgugagcauggccaacaucuuccgcggguccuaucuggcgggagcuggccuggccuucucucucaugaagucccuugggggaggcagacgggggacaggagcucagggcgagacccugggcgagaaauggaagagacagcugaaucagcucuccaaaagcgaauuuaacaccuacaagcgcuccgggauuauggagguggaccggucugaagccaaggagggacugaaaagaggcgaaacaaccaagcaugccguuagccgcgggacagcuaaacuucggugguucgucgagagaaaucuggugaagcccgagggaaaagugaucgaucucggcugugggcgcggaggcugguccuauuacugcgccggccugaagaaggucacggaaguuaaaggguauaccaagggaggcccugggcacgaggaacccauuccuauggcgacauacggauggaacaucgugaaacugcacucuggccgggacguguuuuucacacccccugagaagugugauacccuccuuugcgacauuggggaaagcuccccgaaucccaccaucgaggagggaagaacgcugcgcguccugaaaaugguggaaccuuggcuccggggcaaccaauuuuguauuaagauccugaaucccuacaugccuucuguuguggagacccuugaacagaugcagagaaaacauggcgggaugcugguccgcaacccccucagcagaaauuccacacacgagauguauugggugagcugcggaaccggcaacaucguuucugccgugaacaugacauccagaaugcugcugaaucgcuucaccauggcucauagaaagccgacauacgagcgggaugucgaccucggggccggaacccgccacguggcuguggaaccugagacggccaaccuggauauuaucggccagagaauugaaaauaucaagaacgagcacaaaagcacauggcauuaugacgaagauaaucccuacaagaccugggcguaucacgggucuuacgaggucaaacccuccggaagcgccucuuccaugguuaacggcguggugcggcuucugaccaagccuugggacgucauucccauggugacacaaaucgcuaugacggacaccacaccuuuuggccagcagagaguuuucaaagagaagguggauacccggacaccgcgccccaagagagggaccgcccaaaucauggaagucacagcuaaauggcucuggggauuucugagccggaauaagaaaccucgcauuuguaccagagaggaguucacgcggaaggugcgcuccaacgccgcuaucggcgccguuuuuguggacgagaaucaguggaacagcgcgaaagaagccgucgaggaugagagauucugggaccuugugcaucgggaacgcgagcugcacaagcaggggaagugcgcuaccugcguuuauaauaugaugggaaaaagagaaaagaaacucggcgaguuugggaaggccaaaggcucucgggcuauuugguacauguggcugggagcccgcuuccuggaguucgaggcccucggcuuuaugaacgaggaucauugguucagcagagaaaauucccugucugggguggagggagaaggccuucacaagcugggguacauccuccgggacauuagcaagauccccggaggcaacauguaugcggaugacacagcugggugggauacccgcaucacagaggacgaucugcagaaugaggccaaaauuaccgacaucauggaaccugagcacgcccuucuggcuacguccauuuuuaagcucacauaccaaaacaaagucgugagaguccagcggcccgccaagucuggcaccgugauggauguuaucagcagacgcgaccagcggggauccggccagguggggacauauggacugaacaccuucacgaauauggaaguccaacugauuagacagauggagucugaaggcaucuuuagcccguccgagcucgagaacagcaaucuggcugaacgcgugcuugacuggcuggagaaacaugggguggaacggcucaagagaauggccaucucuggagaugacuguguugugaaaccuaccgaugaccgcuucgcgacagcccugaccgcucuuaacgauaugggcaagguccggaaggacauuccccagugggagccuuccaaaggguggaaugauuggcagcaagugcccuuuugcagccaccauuuccaccagcugaucaugaaggacggcagagaaauuguugugccuugucgcaaccaggaugagcucgucggacgggccagagugucucagggcgcuggguggucccugcgcgagacagccugccugggaaaaagcuacgcgcaaauguggcagcucauguauuuucaccggagagaccugcggcuugccgcuaaugccaucuguuccgcuguccccgugaacuggguuccgaccucuagaacaaccuggagcauucaugcccaccaucaguggaugacgacagaagauaugcuguccguguggaaucgcgucuggaucgaggaaaacccuuggauggaggacaagacccacgugagcucuugggaagacguucccuaccucggcaaacgggaggaucaauggugcgggucccugauuggacuuaccgcuagagccacaugggcgaccaauauccagguggccaucaaccagguccgcagacugauuggcaaugagaacuaucucgacuacaugacaagcaugaagcgguucaagaaugaaucugaucccgagggggcucugugguga

SEQ ID NO: 19463 - RNA, 9879 nt, Artificial Sequence
  derived and/or modified CDS sequence (opt5) from DENV-1__KM403604__SS-prME
agcgugaccaugcugcucaugcugcuucccacagcccuggcuuuccaccucacgacccggggcggggagccucauaugaucgucuccaagcaggaacggggaaagucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacagggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccacaagcaaugguuucuugaccugccucuccccuggacguccggggcuagcacaucccaggagaccuggaaucgccaggaucugcuggugacauucaaaaccgcgcaugccaagaagcaagaagucgugguucucggaucucaggagggcgcuaugcacaccgcccugacaggggccacggaaauucagaccagcggaacaaccacaaucuuugcuggccaccuuaaaugcagacugaagauggacaaacucacccugaaggggguguccuaugucauguguacgggcagcuucaaacuggagaaggaaguggccgagacacagcauggaaccguucuugugcaagucaaguacgagggcaccgaugcgccgugcaaaauuccuaucucuacacaggacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaccagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaagccgacucuggaugcgucauuaacuggaaaggccgcgaacugaaguguggguccggaaucuuugugaccaacgagguucauacauggaccgaacaguauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucacauccugcucgaaaacgacaugaaguuuacagucguggugggagacgccaauggcauucugacccaagggaaaaagaugauccggccgcagcccauggagcauaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacaaaugugcgaccaccggcucauguccgcugcgaucaaagauagcaaggccgugcacgcugacaugggcuauuggauugaaucugagaaaaaugaaaccuggaagcuggccagagccuccuuuaucgaggugaagacauguaucuggccccgcagccauacccuguggucuaacgggguccucgaauccgagaugauuaucccgaaaauuuacggaggcccuaucagccagcacaauuaucggcccggguacuucacgcagaccgcuggaccuuggcaucugggcaaacuugagcuggauuucaaccucugcgaagggacaaccgugguuguggacgagcacugcggaaauagaggccccucucugcggacaaccacggucacaggcaaaauuauccacgaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacaacugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccagagccaucagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcacucuggcgccagccauaacauccugguggaaguccaagaugacgggacaaugaagauuaaagaugaggagcgcgacgauacccuuacgauccugcucaaggcuacccugcucgccguguccggagucuacccuaugucuauucccgccacacuguuugugugguauuucuggcagaaaaagaaacagagaagcggcguucuuugggacaccccuagcccucccgaaguggagcgggcuguccuggaugacggcaucuaccgcauccugcagagagggcuccugggacggucucaagugggcguugggguguuccaggacggagucuuucacacaauguggcaugugaccagaggcgcggugcuuauguaucaggggaagcgccuggaacccagcugggccuccguuaagaaagaucucauuagcuacggaggcggcuggcgguuccaggggucuuggaauacaggagaggagguccaagugaucgcuguggaacccggcaagaacccuaaaaauguccagacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaagaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucagacgacagccgugaaguccgaacacaccggcaaagagaucgucgaucucaugugccaugccaccuucacaaugagacugcuguccccugugcgggugcccaauuacaacaugauuaucauggacgaggcucacuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucaacuuagcagaaagacauucgacaccgaguaucagaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaauacauuuauaugggccagccccugaacaaugacgaagaucaugcccacuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagcugcgcccccgguggcucgaugcgagaacguauuccgacccucuggcccuucgcgaguuuaaagaguucgcugccgggcggagaagcguguccggagaucugauccucgagauuggcaagcugccccaacaucugacacuccgggcucagaaugcccuugacaaccuggugaugcugcacaauucugaacaagggggaaaggcuuaccgccacgccauggaggaacucccugauaccaucgagacccugaugcuucuggcgcucaucgccguccugacaggcggcguuacccuguuuuuccucagcgggaagggacuuggcaagacauccauugggcugcugugugugauggcuucuagcgugcuccuguggauggccuccgucgagccccauuggaucgcugccagcauuauccuugaauuuuuccugauggugcuccugauuccggagccugacagacagcggacgccccaagauaaccagcuggccuauguugugaucggacuccuuuuuaugauccugaccgucgcugcgaacgaaaugggccugcucgagacaaccaaaaaggaccuggggauuggacacguggucgccgagaaucaucaccacgcuacaaugcuugauaucgaccugcauccugccucugccuggacccucuacgcuguggccacgaccauuaucacacccaugaugcgccacaccauugaaaacacaaccgcgaauaucucccugacggccauugcuaaccaggccgcuauccugaugggccucgauaaaggcuggccuaucagcaagauggacauugggguuccccuucuggcccugggaugcuacucucaagugaauccgcucacacugaccgcggccguccuuaugcugguggcucauuaugccaucauuggcccugggcuccaggcuaaagccacaagagaggcucagaagcggaccgccgcgggaaucaugaagaaccccaccguugauggcauuguggccaucgaccuggaccccgucguguacgaugcuaaauucgaaaagcagcuggggcaaaucaugcuccuuauucuguguacaucccagauccugcucaugcgcacgaccugggcccugugcgagagcauuacacuugcuaccggaccucugacaacccucugggaaggcucuccgggcaaauuuuggaauacgacaaucgccgugagcauggccaacauuuucagaggguccuaucuggcgggagcuggccuggccuucucucucaugaaaagccuugggggaggccggcgcgggaccggagcucagggcgagacccugggcgagaaauggaagagacagcugaaucaacucuccaagagcgaauuuaacacauacaaacgguccgggaucauggagguugacagaucugaagccaaggagggacugaaacgcggcgaaaccacaaagcacgccgucagccgggggacggcuaaacuuagaugguucguggagcgcaaucuggugaagcccgagggaaaggucaucgaucucggcugugggcggggaggcugguccuauuacugcgccggccugaaaaagguuaccgaagugaaaggguauacaaagggaggcccugggcaugaggaacccauuccuauggcgaccuacggauggaacaucgugaaacugcacucuggcagagacgucuuuuucacacccccugagaagugugauacccuccuuugcgacauuggggaaagcuccccgaaucccacgaucgaggagggacgcacccugcgggugcugaaaaugguugaaccuuggcucagaggcaaccaguuuuguauuaagauccugaaucccuacaugccuucuguggucgagacacuugaacagaugcagcgcaagcacggcgggaugcuggugcggaacccccucagcagaaauuccacccaugagauguauuggguuagcugcggaacaggcaacauugugucugccgucaacaugaccucccgcaugcugcugaaucgguucacaauggcucacagaaaaccgaccuacgagcgcgauguggaccucggggccggaacgagacauguggcugucgaaccugagaucgccaaccuggauaucauuggccaacggaucgaaaauauuaagaacgagcacaaaagcacauggcacuaugacgaagauaaucccuacaagaccugggcguaucaugggucuuacgagguuaaacccuccggaagcgccucuuccauggugaacggcgugguccgccuucugaccaagccuugggacgugauccccaugguuacacagauugcuaugacggacaccacaccuuuuggccagcaaagaguguucaaggagaaagucgauacccggacaccgagacccaagcgggggaccgcccagaucauggaagugacagcuaaauggcucuggggauuucugagccgcaauaagaaaccuagaaucuguacccgggaggaguucacgcgcaagguuagauccaacgccgcuauuggcgccguguuugucgacgagaaucaguggaacagcgcgaaggaagccguggaggaugagcgguucugggaccuuguucaccgcgaaagagagcugcauaaacaggggaagugcgcuaccugcguguauaauaugaugggaaaacgggaaaagaaacucggcgaguuugggaaggccaagggcucucgcgcuaucugguacauguggcugggagccagauuccuggaguucgaggcccucggcuuuaugaacgaggaucacugguucagccgggaaaauucccugucuggggucgagggagaaggccuucauaaacugggguacauucuccgcgacaucagcaagauucccggaggcaacauguaugcggaugacacagcugggugggauaccagaaucacagaggacgaucugcaaaaugaggccaaaaucaccgacauuauggaaccugagcacgcccuucuggcuacguccaucuuuaagcucacauaccagaacaaagugguccgggugcagcgccccgccaagucuggcaccguuauggaugugauuagcagacgggaccagagaggauccggccaagucgggacauauggacugaacaccuucacgaauauggaagugcagcugauccgccagauggagucugaaggcauuuuuagcccguccgagcucgagaacagcaaucuggcugaacgggugcuugacuggcuggagaaacacgggguugaaagacucaagcgcauggccaucucuggagaugacuguguggucaagccuaccgaugaccgguucgcgacagcccugaucgcucuuaacgauaugggcaaagugagaaaggacauuccccagugggagccuuccaaaggguggaaugauuggcaacagguucccuuuugcagccaucacuuccaucagcugaucaugaaggacggccgcgaaauuguggucccuugucggaaccaggaugagcucgugggacgggcccgcgucucucaaggcgcuggguggucccugcgggagaccgccugccugggaaaaagcuacgcgcagauguggcagcucauguauuuucacagacgcgaccugcggcuugccgcuaaugccaucuguuccgcugugcccguuaacugggugccgacaucuagaaccacauggagcauucacgcccaucaccaauggaugaccacggaagauaugcuguccgucuggaaucggguguggaucgaggaaaacccuuggauggaggacaagacacauguuagcucuugggaagacgugcccuaccucggcaagagagaggaucaguggugcgggucccugauuggacuuaccgcucgcgccaccugggcgacaaauauccaggucgccaucaaccaggugcggagacugauuggcaaugagaacuaucucgacuacaugaccagcaugaaacgcuucaagaaugaaucugaucccgagggggcucugugguga

SEQ ID NO: 19464 - RNA, 9879 nt, Artificial Sequence
  derived and/or modified CDS sequence (opt5) from DENV-1__KM403588__SS-prME
agcgugaccaugcugcucaugcugcuucccaccgcucuggcuuuccaccucacgacccggggaggggaaccucauaugaucguguccaagcaggaacggggaaaaucucugcuuuuuaagaccagcgcuggcguuaacaugugcacccugauugcgauggaccucggggaacugugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggggaaacucacccugaagggcguguccuaugucauguguacgggauccuucaaacuggagaaggaaguggccgagacacagcacggcaccguucuugugcaggucaaguacgaggggaccgacgcgccgugcaaaauuccuaucucuacacaagaugaaaagggagugacccagaacggccggcucaucacagcuaaucccauugugacggacaaagagaagccuguuaacaucgaaaccgagccgcccuucggggaguccuauauugucaucggagccggcgaaaaagcccugaagcugagcugguuuaagaaagggucuagcauuggcaagauguucgaggcuacagccagaggagcucgccggauggccauccucggcgauaucgcgugggacuuuggguccauuggaggcguguucaccucuguggggaaacugguccaucagguguuuggaacagccuacggcguucuuuucagcgggguguccuggaccaugaagaucggcauuggaauccugcucacguggcugggccugaauagcagaucuaccucccuuagcaugacauguauugcugucgggauggugacccucuaccugggaguuauggugcaggccgauucuggcugcgucaucaacuggaaagggcgcgaacugaaguguggauccggcauuuuugugacaaacgagguucacaccuggacagaacaauauaaguuccaggcugacagcccuaaacggcucuccgccgcgaucgggaaggccugggaggagggcgugugcggaaucagaucugcuacccgccuggaaaauauuauguggaaacagaucagcaacgagcuuaaucauauucugcucgaaaacgauaugaaguuuacggucguggugggcgacgccaaugggauccugacacagggcaagaagaugauucggccgcaacccauggagcacaaauacuccuggaagucuuggggcaaggcuaaaaucaucggggccgacacccagaacaccacauucauuaucgauggaccugacacccccgaauguccugaugaccagagagccuggaauauuugggaggucgaggauuauggcuuuggcguuuucacgacaaacaucuggcugaaacuucgcgacagcuacacccagaugugcgaucaccggcucauguccgcugcgauuagagacagcaaagccgugcaugcugauaugggguauuggaucgaaucugagaagaaugaaacauggaaacuggcccgcgccuccuuuaucgaggugaagaccuguauuuggccccggagccacacacuguggucuaacggaguccucgaauccgagaugaucauuccgaagaucuacggcgggccuauuagccaacauaauuauagacccggauacuucacccagacggcuggcccuuggcaccuggggaaacuugagcuggacuucaaccucugcgaaggaaccacagugguuguggaugagcacugcggcaaucggggccccucucugcgcaccacaaccgucacggggaagaucauccaugaaugguguugcagaagcuguacacugccuccccuucgguuuagaggagaggacggcugcugguacgggauggagauucgcccggugaaagaaaaggaggaaaaccucguucgguccauggugagcgccggaucuggcgaggucgauuccuucagccuggggcugcucuguguguccaucaugauugaagagguuaugagaucucgcuggagcagaaaaaugcugaugaccggaacacuugcgguguuuuuccugcucaucaugggccagcugaccuggaaugaccugauucggcuuugcaucauggucggcgcuaacguguccgaccgcauggggaugggaaccacauaucuggcccucauggccacguuuaagaugagaccuauguucgcugugggccugcucuuucggcgccugaccucuagagagguccuucugcucacaauugggcugagccugguugccuccguggaacuucccaacucucuggaggaacucggagauggccuggcgauggggaucaugaugcucaagcugcuuaccgacuuccaaagccaccagcuguggacaacccuccugucccugacguuuaucaaaacaacccuuagccuggauuacgcuuggaagaccauggccauggugcucucuauugucucccuguucccccucugucugagcacaaccucucagaaaacaacguggcuuccugugcugcugggauccuuuggcugcaagccgcucaccauguuccugaucacagagaauaaaauuuggggcagaaagagcuggccccuuaacgaagggaucauggccguuggaauugugucuauccugcucuccagccugcucaagaaugacgucccucuggcuggcccccuuaucgccgggggaaugcugauugcuuguuaugugaucuccggcagcucugccgaucugagccucgagcgcgcggccgagguuuccugggaagaggaagcugagcauucuggggccagccacaacauucugguggaaguccaggacgauggaaccaugaaaaucaaggacgaggagagagaugacacacuuaccauucugcucaaagcuacgcugcucgccguguccggcgucuacccuaugucuauccccgccacccuguuugugugguauuucuggcaaaagaaaaagcagcggagcggcguucuuugggauacaccuagcccucccgaaguggagcgcgcuguccuggacgaugggaucuaccggauucugcagcggggacuccugggcagaucucagguggggguuggaguguuccaagacggcgucuuucauaccauguggcacgugacacgcggggcggugcuuauguaucagggaaaacggcuggaacccagcugggccuccguuaagaaggaccucaucagcuacggcggcggguggagauuccagggaucuuggaauaccggcgaggagguccaggugauugcuguggaacccgggaaaaacccuaagaauguccaaacaacgcccggaaccuuuaaaacaccggagggcgaagugggggccaucgcccuggauuucaagccuggaaccuccggcagccccauuguuaaccgcgagggcaaaaucguggggcucuacggaaauggcgucgugaccacaucugggacguauguuuccgcuauugcccaggcgaaggcuagccaggaaggaccucugcccgagaucgaggacgaaguguuuaagaaacggaaccuuaccaucauggaucugcaccccggcuccgggaagacaagacgcuaccugccugccauuguccgggaggccaucaaaagaaagcuccgcacccugauucuugcuccgacacgggugguugccucugaaauggcggaggcucugaaaggcaugcccaucagauaucaaaccacggccgucaagagcgaacauacaggaaaggagauugucgaccucaugugccacgccaccuucaccaugcggcugcuguccccugugcgcgugcccaauuacaacaugaucaucauggaugaggcucauuuuacagacccugccagcauugcugccagaggcuauaucucuacccgggucgggaugggagaagcggccgcuauuuucaugacagccacacccccuggcuccguugaggcuuuuccgcagagcaaugccgugauccaggaugaagaacgcgacauucccgaaagaucuuggaacagcggguacgauuggaucacggacuucccuggaaaaacagugugguuuguccccuccaucaagucuggcaaugauauugccaacugucuccggaaaaacgggaagagagugauccagcuuagccgcaaaaccuucgacacagaguaucaaaagaccaagaauaacgacugggauuacguugugacgaccgacauuuccgagaugggcgcuaauuuccgggcggauagagucaucgacccucgccggugccugaaacccgugauucugaaggauggaccggaaagaguuauccucgccggcccuaugcccguggcugccgccucugcugcccagcgccgggggagaauuggacgcaaccagaauaaagagggcgaccaguacaucuauauggggcaaccccugaacaaugaugaagaccacgcgcauuggacagaggcuaagaugcuucuggauaacaucaauaccccugagggaauuauccccgcccucuuugaaccugagagagaaaagagcgccgcuauugacggcgaguaccggcugcgcggggaggccagaaagacauucgucgagcugaugcggcgcggcgaucucccgguguggcuuuccuauaaggucgcgagcgagggauuucaguacucugacagacgguggugcuucgauggcgaaagaaacaaucaggugcuggaggaaaacauggacguugagaucuggaccaaagaaggggagcgcaagaaacugcggcccagauggcucgacgcccgcacauauuccgauccucuggcccuucgggaguuuaaggaguucgccgcuggaagacggagcguguccggcgaccugauucucgagaucgggaaacugccccagcaccugacccuccgcgcccaaaaugcucuugauaaccuggugaugcugcacaauucugaacagggaggcaaggccuacagacaugcgauggaggaacucccugacacgaucgagacacugaugcuucuggcccucauugcuguccugaccggcgggguuacccuguuuuuccucagcggaaaaggccuugggaagacauccaucggacugcugugugugauggccucuagcgugcuccuguggauggcuuccgucgagccccacuggauugccgccagcaucauucuugaauuuuuccugauggugcuccugaucccggagccugaucggcagcgcacaccccaggacaaccaacuggcuuauguugugaucggccuccuuuuuaugauucugacagucgcggccaacgaaauggggcugcucgagacgaccaagaaagaucugggaaucggccauguggucgcugagaaucaccaccaugccacaaugcuugacauugaucugcacccugccucugcuuggacccucuacgccguggcgacaaccaucauuacgcccaugaugagacauaccaucgaaaacacaaccgccaauauuucccugacagcuaucgccaaccaggcugccauccugaugggccucgacaagggguggccuauuagcaaaauggauaucggaguuccccuucuggcgcugggcugcuacucucaggugaauccgcucacccugacggccgcuguccuuaugcugguggcccacuaugcuauuaucgggccuggacuccaagccaaggcuacacgggaggcccagaaacgcaccgcggccggcauuaugaagaaccccacaguugacgggaucguggcuaucgaucuggaccccgucguguacgacgccaaguucgaaaaacagcugggacagauuaugcuccuuauccuguguaccucccaaauucugcucaugagaaccacaugggcucugugcgagagcaucacgcuugccaccggcccucugacaacccucugggaaggcucuccggggaaguuuuggaauacaaccauugccgugagcauggcgaacaucuuccggggauccuaucuggcuggcgccgggcuggcuuucucucucaugaaaagccuuggaggcgggcgcagaggaacgggcgcccagggcgagacacugggggagaaguggaaacggcagcugaaucagcucuccaagagcgaauuuaacaccuacaagagauccggaaucauggagguugaucgcucugaagccaaagagggccugaagagaggggaaaccacaaaacaugcugucagcagaggaaccgccaaacuucgcugguucguggagcggaaucuggugaaacccgagggcaaggucauugaccucggguguggaagaggcggcugguccuauuacugcgcggggcugaagaaaguuacagaagugaagggauauacgaaaggcgggccuggacacgaggaacccaucccuauggccaccuacggcuggaacauugugaagcugcacucugggcgcgaugucuuuuucacacccccugagaaaugugacacccuccuuugcgauaucggagaaagcuccccgaaucccacaauugaggagggccggacccugagagugcugaagaugguugaaccuuggcuccgcggcaaccaauuuuguaucaaaauucugaaucccuacaugccuucuguggucgagacgcuugaacagaugcagcggaagcaugggggaaugcuggugagaaacccccucagccgcaauuccacccacgagauguauuggguuagcugcggcacagggaacaucgugucugcugucaacaugaccucccggaugcugcugaauagauucacaauggcccaucgcaagccgaccuacgagagagacguggaucucggagcuggcacacggcacguggccgucgaaccugagaucgcgaaccuggacauuaucgggcagcgcauugaaaauaucaaaaacgagcacaagagcaccuggcauuaugaugaagacaaucccuacaaaacgugggccuaucacggaucuuacgagguuaagcccuccggcagcgcuucuuccauggugaacggcguggucagacuucugacaaaaccuugggaugugauucccaugguuacccaaaucgccaugaccgacacaacgccuuuugggcagcagcggguguucaaggagaaggucgacaccagaacaccgcggcccaaacgcggaaccgcucaaaucauggaagugacagccaaguggcucuggggcuuucugagcagaaauaaaaagccucggauuuguacccgcgaggaguucacaagaaaaguucgguccaacgcugccaucggggcgguguuugucgaugagaaucaguggaacagcgccaaggaagcuguggaggacgagcgcuucugggaucuuguucauagagaacgggagcugcacaagcagggaaaaugcgcuaccugcguguauaauaugaugggcaagcgcgagaaaaagcucggggaguuuggcaaagcuaagggaucuagagccauuugguacauguggcugggcgcccgguuccuggaguucgaggcgcucggguuuaugaacgaggaccauugguucagccgcgaaaauucccugucuggagucgagggcgaagggcuucacaagcugggauacauccucagagauauuagcaaaauccccggcgggaacauguaugcugacgauacggccggcugggacacccggaucacagaggaugaccugcagaaugaggccaagauuaccgauaucauggaaccugagcacgcccuucuggccacauccauuuuuaaacucaccuaccaaaacaaggugguccgcgugcagagacccgcuaaaucuggaacgguuauggacgugaucagccggagagaucagcgcggcuccgggcaggucggaacauauggccugaacaccuucacaaauauggaagugcaacugauucggcagauggagucugaagggaucuuuagcccguccgagcucgagaacagcaaucuggccgaaagagugcuugacuggcuggagaagcauggaguugaacgccucaaacggauggcgaucucuggcgacgauuguguggucaagccuaccgacgauagauucgccacggcucugaccgcccuuaacgacauggggaaggugcgcaaagauauuccccagugggagccuuccaagggcuggaaugacuggcagcaaguucccuuuugcagccaccauuuccaccagcugaucaugaaagauggacgggaaauuguggucccuuguagaaaccaggacgagcucgugggccgcgcucgggucucucagggggccggauggucccugagagagacagcgugccugggcaagagcuacgcccaaauguggcagcucauguauuuucaccgccgggaucugagacuugcugccaaugcuaucuguuccgccgugcccguuaacugggugccgaccucucggacaaccuggagcauucaugcucaccaucaguggaugacaaccgaagacaugcuguccgucuggaauagaguguggaucgaggaaaacccuuggauggaggauaaaacgcacguuagcucuugggaagacgugcccuaccucgggaagcgcgaggaccaauggugcggaucccugauuggccuuacagcccgggcgaccugggccaccaauauccaggucgcuaucaaccaggugagacgccugauugggaaugagaacuaucucgauuacaugacaagcaugaagagauucaaaaaugaaucugaccccgagggcgcccugugguga

SEQ ID NO: 19465 - RNA, 9879 nt, Artificial Sequence
  derived and/or modified CDS sequence (opt5) from DENV-1__KM403605__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuauccaagacgaaaagggggugacacagaacggacggcucauuaccgcuaaucccaucgugacagauaaagagaagccuguuaacauugaaacggagccgcccuucggcgaguccuauaucgucauuggggccggagaaaaagcccugaagcugagcugguuuaagaaaggcucuagcaucgggaagauguucgaggcuaccgccagaggcgcucgccggauggccauccucggagacacagcgugggauuuuggcuccauugggggaguguucaccucugugggcaaacugguccaucagguguuugggacagccuacggaguucuuuucagcggcguguccuggaccaugaagaucgggauuggcauccugcucacguggcugggacugaauagcagaucuaccucccuuagcaugacauguauugcugucggcauggugacccucuaccuggggguuauggugcaggccgacucuggaugcgucaucaacuggaaaggccgcgaacugaaguguggguccggaauuuuugugacaaacgagguucacaccuggacagaacaauauaaguuccaggcugauagcccuaaacggcucuccgccgcgaucggcaaggccugggaggagggggugugcggcaucagaucugcuacccgccuggaaaauauuauguggaaacagaucagcaacgagcuuaaucauauucugcucgaaaacgacaugaaguuuacggucguggugggagacgccaauggcauccugacacaggggaaaaagaugauucggccgcaacccauggagcacaaauacuccuggaagucuuggggaaaggcuaaaaucaucggcgccgauacccagaacaccacauucauuaucgacgggccugauacccccgaauguccugacgaucagagagccuggaauauuugggaggucgaggacuauggauuuggcguuuucacgacaaacaucuggcugaaacuucgcgauagcuacacccagaugugcgaccaccggcucauguccgcugcgauuaaagauagcaaggccgugcaugcugacaugggcuauuggaucgaaucugagaaaaaugaaacauggaagcuggccagagccuccuuuaucgaggugaagaccuguauuuggccccgcagccacacacuguggucuaacgggguccucgaauccgagaugaucauuccgaaaaucuacggaggcccuauuagccaacauaauuaucggcccggguacuucacccagacggcuggaccuuggcaccugggcaaacuugagcuggauuucaaccucugcgaagggaccacagugguuguggacgagcacugcggaaauagaggccccucucugcggaccacaaccgucacgggcaaaaucauccaugaaugguguugccgcagcuguacacugccuccccuuagauuuagaggggaagauggaugcugguacggcauggagauuagaccggugaaggaaaaagaggaaaaccucguucgcuccauggugagcgccgggucuggagaggucgacuccuucagccugggccugcucuguguguccaucaugauugaagagguuaugcggucuagauggagccgcaagaugcugaugaccgggacacuugcgguguuuuuccugcucaucaugggacagcugaccuggaaugaccugauuagacuuugcaucauggucggcgcuaacguguccgaucggaugggcauggggaccacauaucuggcccucauggccacguuuaagaugcgcccuauguucgcugugggacugcucuuuagacggcugaccucucgcgagguccuucugcucacaauuggccugagccugguugccuccguggaacuucccaacucucuggaggaacucggggacggacuggcgaugggcaucaugaugcucaaacugcuuaccgauuuccaaagccaccagcuguggacaacccuccugucccugacguuuaucaagacaacccuuagccuggacuacgcuuggaaaaccauggccauggugcucucuauugucucccuguucccccucugucugagcacaaccucucagaagacaacguggcuuccugugcugcugggguccuuuggaugcaaaccgcucaccauguuccugaucacagagaauaagauuuggggcagaaagagcuggccccuuaacgaaggcaucauggccguugggauugugucuauccugcucuccagccugcucaaaaaugaugucccucuggcuggaccccuuaucgccggcgggaugcugauugcuuguuaugugaucuccggaagcucugccgaccugagccucgagcgggcggccgagguuuccugggaagaggaagcugagcauucuggcgccagccacaacauucugguggaaguccaggaugacgggaccaugaagaucaaagaugaggagcgcgacgauacacuuaccauucugcucaaggcuacgcugcucgccguguccggagucuacccuaugucuauccccgccacccuguuugugugguauuucuggcagaagaagaaacagagaagcggcguucuuugggacacaccuagcccucccgaaguggagcgggcuguccuggaugacggcaucuaccgcauucugcagagagggcuccugggacggucucaggugggcguugggguguuccaagacggagucuuucauaccauguggcacgugacaagaggcgcggugcuuauguaucaggggaaacgccuggaacccagcugggccuccguuaagaaagaucucaucagcuacggaggcggcuggcgguuccaggggucuuggaauaccggagaggagguccaggugauugcuguggaacccggcaagaacccuaaaaauguccaaacaacgcccgggaccuuuaagacaccggagggagaagugggcgccaucgcccuggacuucaaaccugggaccuccggaagccccauuguuaacagagagggcaagaucgugggccucuacgggaauggagucgugaccacaucuggcacguauguuuccgcuauugcccaggcgaaggcuagccaggaagggccucugcccgagaucgaggaugaaguguuuaaaaagcgcaaccuuaccaucauggaccugcaccccggauccggcaaaacacggagauaccugccugccauuguccgcgaggccaucaagcggaaacucagaacccugauucuugcuccgacacgcgugguugccucugaaauggcggaggcucugaaggggaugcccauccgguaucaaaccacggccgugaaguccgaacauacaggcaaagagauugucgaucucaugugccacgccaccuucaccaugagacugcuguccccugugcgggugcccaauuacaacaugaucaucauggacgaggcucauuuuacagauccugccagcauugcugcccgcggauauaucucuaccagagucggcaugggggaagcggccgcuauuuucaugacagccacacccccuggauccguugaggcuuuuccgcagagcaaugccgugauccaggacgaagaacgggauauucccgaacgcucuuggaacagcggcuacgacuggaucacggauuucccugggaagacagugugguuuguccccuccaucaaaucuggaaaugacauugccaacugucucagaaagaacggcaaacgggugauccagcuuagcagaaagaccuucgacacagaguaucaaaagaccaaaaauaacgauugggacuacguugugacgaccgauauuuccgagaugggggcuaauuuccgcgcggaccgggucaucgauccuagacgcugccugaagcccgugauucugaaagacggcccggaacggguuauccucgccggaccuaugcccgugacagcugccucugccgcucagagacgcggccggauugggagaaaccagaauaaggagggagaucaguacaucuauaugggccaaccccugaacaaugacgaagaucacgcccauuggaccgaggcgaaaaugcuucuggacaacaucaauacaccugaggggauuauccccgcucucuuugaaccugagcgcgaaaagagcgccgccauugauggagaguacagacugcggggcgaagcucgcaagaccuucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagaucuggacaaaggaaggcgagcgcaagaagcugcgcccccgguggcucgaugcgagaaccuauuccgacccucuggcccuucgcgaguuuaaagaguucgcugccgggcggagaagcguguccggagaucugauucucgagaucggcaagcugccccagcaccugacgcuccgggcucaaaaugcccuugacaaccuggugaugcugcacaauucugaacaagggggaaaggcuuaccgccaugccauggaggaacucccugauacaaucgagacccugaugcuucuggcgcucauugccguccugaccggcggcguuacacuguuuuuccucagcgggaagggacuuggcaagaccuccaucgggcugcugugugugauggcuucuagcgugcuccuguggauggccuccgucgagccccacuggauugcugccagcaucauucuugaauuuuuccugauggugcuccugaucccggagccugacagacagcggacaccccaggauaaccaacuggccuauguugugaucggacuccuuuuuaugauucugacggucgcugcgaacgaaaugggccugcucgagaccaccaaaaaggaccuggggaucggacauguggucgccgagaaucaccaccaugcuaccaugcuugauauugaccugcacccugccucugccuggacacucuacgcuguggccaccacgaucauuacccccaugaugcgccauacaaucgaaaacaccacagcgaauauuucccugaccgccaucgcuaaccaggccgcuauccugaugggccucgauaaaggcuggccuauuagcaagauggacaucgggguuccccuucuggcccugggaugcuacucucaggugaauccgcucacgcugacagcggccguccuuaugcugguggcucacuaugccauuaucggcccugggcuccaagcuaaagccaccagagaggcucagaagcggacagccgcgggaauuaugaagaaccccaccguugauggcaucguggccaucgaccuggaccccgucguguacgaugcuaaauucgaaaagcagcuggggcagauuaugcuccuuauccuguguaccucccaaauucugcucaugcgcacaacgugggcccugugcgagagcaucacccuugcuacaggaccucugaccacacucugggaaggcucuccgggcaaauuuuggaauaccacgauugccgugagcauggccaacaucuucagaggguccuaucuggcgggagcuggccuggccuucucucucaugaagacacuugggggaggccggcgcgggaccggagcucagggcgagacccugggcgagaaauggaagagacagcugaaucagcucagcaaguccgaauuuaacacauacaaacggagcgggaucauggagguugacagauccgaagccaaggagggacugaaacgcggcgaaaccacaaagcaugccgucucucgggggacggcuaaacuuagaugguucguggagcgcaaucuggugaagcccgagggaaaggucauugaucucggcugugggcggggaggcuggagcuauuacugcgccggccugaaaaagguuaccgaagugaaaggguauacaaagggaggcccugggcacgaggaacccaucccuauggcgaccuacggauggaacauugugaaacugcacuccggcagagacgucuuuuucacacccccugagaagugugauacccuccuuugcgacaucggggaaucuagcccgaaucccacgauugaggagggacgcacccugcgggugcugaaaaugguugaaccuuggcucagaggcaaccaauuuuguaucaagauucugaaucccuacaugccuuccguggucgagacacuugaacagaugcagcgcaagcauggcgggaugcuggugcggaacccccucucuagaaauagcacccacgagauguauuggguuuccugcggaacaggcaacaucgugagcgccgucaacaugaccucucgcaugcugcugaaucgguucacaauggcucauagaaaaccgaccuacgagcgcgauguggaccucggggccggaacgagacacguggcugucgaaccugagaucgccaaccuggauauuaucggccagcggauugaaaauaucaagaacgagcacaaauccacauggcauuaugacgaagauaaucccuacaagaccugggcguaucacgggagcuacgagguuaaacccucuggauccgccagcucuauggugaacggcgugguccgccuucugaccaagccuugggacgugauucccaugguuacacaaaucgcuaugacggacaccacaccuuuuggccagcagagaguguucaaggagaaagucgauacccggacaccgagacccaagcgggggaccgcccaaaucauggaagugacagcuaaauggcucuggggauuucugucccgcaauaagaaaccuagaauuuguacccgggaggaguucacgcgcaagguuagaagcaacgccgcuaucggcgccguguuugucgacgagaaucaguggaacuccgcgaaggaagccguggaggaugagcgguucugggaccuuguucaucgcgaaagagagcugcacaaacaggggaagugcgcuaccugcguguauaauaugaugggaaaacgggaaaagaaacucggcgaguuugggaaggccaagggcagccgcgcuauuugguacauguggcugggagccagauuccuggaguucgaggcccucggcuuuaugaacgaggaucauugguucucucgggaaaauagccuguccggggucgagggagaaggccuucacaaacugggguacauccuccgcgacauuucuaagauccccggaggcaacauguaugcggaugacacagcugggugggauaccagaaucacagaggacgaucugcagaaugaggccaaaauuaccgacaucauggaaccugagcacgcccuucuggcuacgagcauuuuuaagcucacauaccaaaacaaagugguccgggugcagcgccccgccaaguccggcaccguuauggaugugaucucuagacgggaccagagaggaagcggccaggucgggacauauggacugaacaccuucacgaauauggaagugcaacugauucgccagauggaguccgaaggcaucuuuucuccgagcgagcucgagaacuccaaucuggcugaacgggugcuugacuggcuggagaaacaugggguugaaagacucaagcgcauggccaucagcggagaugacugugaggugaagccuaccgaugaccgguucgcgacagcccugaccgcucuuaacgauaugggcaaagucagaaaggacauuccccagugggaaccuucuaaaggguggaaugauuggcagcaagugcccuuuugcucccaccauuuccaccagcugaucaugaaggacggccgcgagauuguugugccuugucggaaccaggaugagcucgucggacgggcccgcgugagccagggcgcuggguggucucugcgggaaacagccugccugggaaaauccuacgcgcaaauguggcagcucauguauuuucacagacgcgaccugcggcuugccgcuaaugccaucuguagcgcuguccccgugaacuggguuccgaccuccagaacaaccuggucuauucaugcccaccaucaguggaugacgacagaggauaugcugagcguguggaaucgggucuggaucgaagagaacccuuggauggaagacaagacccacguguccagcugggaggacguucccuaccucggcaagagagaggaucaauggugcgggucucugauuggacuuaccgcucgcgccacaugggcgaccaauauccagguggccaucaaccagguccggagacugauuggcaaugaaaacuaucucgacuacaugacauccaugaaacgcuucaagaaugagagcgaucccgaaggggcucugugguga

SEQ ID NO: 19466 - RNA, 9879 nt, Artificial Sequence
  derived and/or modified CDS sequence (opt5) from DENV-1__KM403606__SS-prME
agcgugaccaugcugcugaugcugcuucccacagcccuggcuuuccaccucacgacccggggcggggagccucauaugauugucuccaagcaggaacggggaaaaucucugcuuuuuaagaccagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuacccuggagauccagcucacagacuacggcgcccugacccuugacuguagcccccggacaggccuggauuucaacgaaauggugcuccugaccaugaaggagaaaagcuggcuuguccauaagcagugguuucuggaccucccucugcccuggacgucuggggcuuccacaagccaagagaccuggaaucgccaggaucugcucgugacauucaaaaccgcgcacgccaagaagcaggaagucgugguucugggaucccaagagggcgcuaugcacaccgcccuuacaggggccacggaaauucagaccucuggaacaaccacaaucuuugcuggccaucugaaaugcagacucaagauggacaaacugacccugaagggggugagcuaugucauguguacgggcuccuucaaacuugagaaggaaguggccgagacacagcacggaaccguucucgugcaggucaaguacgagggcaccgaugcgccgugcaaaauuccuaucagcacacaagacgaaaagggggugacccagaacggacggcugaucacagcuaaucccauugugacggauaaagagaagccuguuaacaucgaaaccgagccgcccuucggcgagucuuauauugucaucggggccggagaaaaagcccugaagcucuccugguuuaagaaaggcagcucuauugggaagauguucgaggcuacagccagaggcgcucgccggauggccauccugggagacaccgcgugggauuuuggcagcaucgggggaguguucacauccgugggcaaacuuguccaucagguguuugggaccgccuacggaguucuguucucuggcgugagcuggacgaugaagauugggaucggcauucuccugaccuggcugggacuuaauuccagaagcacaucucucuccaugaccuguaucgcugucggcauggugacacuguaccuggggguuauggugcaggccgacagcggaugcgucauuaacuggaaaggccgcgaacucaagugugggucuggaaucuuugugaccaacgagguucacacauggaccgaacaauauaaguuccaggcugauuccccuaaacggcugagcgccgcgauuggcaaggccugggaggagggggugugcggcaucagauccgcuacgcgccuugaaaauaucauguggaaacagauuucuaacgagcugaaucauauccuccuggaaaacgacaugaaguuuacagucguggugggagacgccaauggcauucugacccaggggaaaaagaugauccggccgcaacccauggagcacaaauacagcuggaaguccuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcuuaagcuccgcgauucuuacacacagaugugcgaccaccggcugaugagcgcugcgaucaaagauuccaaggccgugcaugcugacaugggcuauuggauugaaagcgagaaaaaugaaaccuggaagcuggccagagccucuuuuaucgaggugaagacauguaucuggccccgcucccacacccucuggagcaacgggguccuggaaucugagaugauuaucccgaaaauuuacggaggcccuaucucccaacauaauuaucggcccggguacuucacgcagaccgcuggaccuuggcaccuuggcaagcuggagcucgauuucaaccugugcgaagggacaaccgugguuguggacgagcacugcggaaauagaggccccagccugcggacaaccacggucacaggcaaaauuauccaugaaugguguugccgcucuuguacccuuccuccccucagauuuagaggggaagauggaugcugguacggcauggagaucagaccggugaaggaaaaagaggaaaaccugguucgcagcaugguguccgccgggagcggagaggucgacucuuucucccugggccuccugugugugagcauuaugaucgaagagguuaugcgguccagauggucucgcaagaugcuuaugacagggacccuggcgguguuuuuccuccugauuaugggacagcugaccuggaaugaccuuaucagacugugcauuauggucggcgcuaacgugagcgaucggaugggcauggggacaacguaucucgcccugauggccaccuuuaagaugcgcccuauguucgcugugggacuccuguuuagacggcuuacaucccgcgagguccugcuccugaccaucggccugucucuuguugccagcguggaacugcccaacucccucgaggaacugggggacggacucgcgaugggcauuaugaugcugaaacuucugacagauuuccaaucucaccagcucuggaccacgcugcugagccuuacauuuaucaagaccacccugucccucgacuacgcuuggaaaacaauggccauggugcugagcaucgucucucucuucccccugugucuuuccaccacaagccagaagacgaccuggcugccugugcugcucgggucuuuuggaugcaaaccgcugacaauguuccuuauuaccgagaauaagaucuggggcagaaaguccuggccccugaacgaaggcauuauggccguugggaucgugagcauucuccugucuucccuccugaaaaaugaugucccucuugcuggaccccugaucgccggcgggaugcugaucgcuuguuaugugauuagcggauccagcgccgaccucucucuggagcgggcggccgagguuagcugggaagaggaagcugagcauuccggcgccucucacaacauccuuguggaaguccaggaugacgggacaaugaagauuaaagaugaggagcgcgacgauacccugacgauccuccugaaggcuacccuccuggccgugagcggagucuacccuauguccauucccgccacacuuuuugugugguauuucuggcagaaaaagaaacagagaucuggcguucugugggacaccccuuccccucccgaaguggagcgggcuguccuggaugacggcaucuaccgcauccuccagagagggcugcuuggacggucccaggugggcguugggguguuccaagacggagucuuucauacaauguggcacgugaccagaggcgcggugcugauguaucaggggaaacgccucgaacccucuugggccagcguuaagaaagaucugauuuccuacggaggcggcuggcgguuccaggggagcuggaauacaggagaggagguccaggugaucgcuguggaacccggcaagaacccuaaaaauguccaaacgacccccgggacauuuaagaccccggagggagaagugggcgccauugcccucgacuucaaaccugggaccucuggaucccccaucguuaacagagagggcaagauugugggccuguacgggaauggagucgugacaacgagcggcaccuauguuucugcuaucgcccaggcgaaggcuucccaggaagggccucuucccgagauugaggaugaaguguuuaaaaagcgcaaccugacaaucauggaccugcaccccggaagcggcaaaacccggagauaccucccugccaucguccgcgaggccauuaagcggaaacugagaacacuuauccuggcuccgacccgcgugguugccuccgaaauggcggaggcucucaaggggaugcccauucgguaucaaacgacagccgugaagucugaacauaccggcaaagagaucgucgaucugaugugccacgccaccuucacaaugagacugcucagcccugugcgggugcccaauuacaacaugauuaucauggacgaggcucauuuuaccgauccugccuccaucgcugcccgcggauauauuagcacaagagucggcaugggggaagcggccgcuaucuucaugaccgccacgcccccuggaucuguugaggcuuuuccgcaguccaaugccgugauucaggacgaagaacgggauauccccgaacgcagcuggaacucuggcuacgacuggauuacagauuucccugggaagaccgugugguuuguccccagcaucaaauccggaaaugacaucgccaacugucuuagaaagaacggcaaacgggugauucagcugucuagaaagacauucgacaccgaguaucaaaagacgaaaaauaacgauugggacuacguugugaccacagauaucagcgagaugggggcuaauuuccgcgcggaccgggucauugauccuagacgcugccugaagcccgugauccucaaagacggcccggaacggguuauucuggccggaccuaugcccgugaccgcugccuccgccgcucagagacgcggccggaucgggagaaaccagaauaaggagggagaucaguacauuuauaugggccaaccccuuaacaaugacgaagaucacgcccauuggacagaggcgaaaaugcugcucgacaacaucaauaccccugaggggaucauucccgcucuguuugaaccugagcgcgaaaagucugccgccaucgauggagaguacagacugcggggcgaagcucgcaagacauucgucgagcucaugagaagaggggaccuuccgguguggcugagcuauaaagucgccuccgagggcuuucaguacagcgaucgcagauggugcuucgacggagaacggaacaaucaggugcuggaggaaaacauggacguugagauuuggaccaaggaaggcgagcgcaaaaagcuccgcccccgguggcuggaugcgagaacguauucugacccucuugcccugcgcgaguuuaaagaguucgcugccgggcggagauccgugagcggagaucucauccuggagauuggcaagcugccccagcaccucacacuucgggcucaaaaugcccuggacaaccuggugaugcuccacaauuccgaacaagggggaaaggcuuaccgccaugccauggaggaacugccugauaccaucgagacccuuaugcugcucgcgcugaucgccguccugacaggcggcguuacccucuuuuuccuuucugggaagggacugggcaagacaagcauugggcugcucugugugauggcuuccucugugcugcuuuggauggccagcgucgagccccacuggaucgcugccuccauuauccuggaauuuuuccucauggugcugcugauuccggagccugacagacagcggacgccccaggauaaccaacucgccuauguugugaucggacuucuguuuaugauccugaccgucgcugcgaacgaaaugggccuccuggagacaaccaaaaaggaccuugggauuggacauguggucgccgagaaucaccaccaugcuacaaugcuggauaucgaccuccacccugccagcgccuggacccuguacgcuguggccacgaccauuaucacacccaugaugcgccauaccauugaaaacacaaccgcgaauaucucucugacggccauugcuaaccaggccgcuauccucaugggccuugauaaaggcuggccuaucuccaagauggacauugggguuccccugcuggcccucggaugcuacagccaggugaauccgcugacacuuaccgcggccguccugaugcucguggcucacuaugccaucauuggcccugggcugcaagcuaaagccacaagagaggcucagaagcggaccgccgcgggaaucaugaagaaccccaccguugauggcauuguggccaucgaccuggaccccgucguguacgaugcuaaauucgaaaagcagcucgggcagaucaugcuucugauucuguguacaucucaaauccuccugaugcgcacgaccugggcccuuugcgaguccauuacacuggcuaccggaccucucacaacccugugggaaggcagcccgggcaaauuuuggaauacgacaaucgccgugucuauggccaacauuuucagagggagcuaucuggcgggagcuggccucgccuucucccuuaugaagacccucgggggaggccggcgcgggaccggagcucagggcgagacacugggcgagaaauggaagagacagcucaaucagcugucuaagagcgaauuuaacaccuacaaacgguccgggaucauggagguugacagaagcgaagccaaggagggacuuaaacgcggcgaaacaacgaagcaugccgucucccgggggaccgcuaaacugagaugguucguggagcgcaaucucgugaagcccgagggaaaggucaucgaucugggcugugggcggggaggcuggucuuauuacugcgccggccugaaaaagguuacagaagugaaaggguauaccaagggaggcccugggcacgaggaacccauuccuauggcgacauacggauggaacaucgugaaacuccacagcggcagagacgucuuuuucacacccccugagaagugugauacgcuucugugcgacauuggggaauccucuccgaaucccaccaucgaggagggacgcacacugcgggugcucaaaaugguugaaccuuggcugagaggcaaccaauuuuguauuaagauccuuaaucccuacaugccuagcguggucgagacccuggaacagaugcagcgcaagcauggcgggaugcucgugcggaacccccuguccagaaauucuacacacgagauguauuggguuagcugcggaaccggcaacauuguguccgccgucaacaugacaagccgcaugcugcucaaucgguucaccauggcucauagaaaaccgacguacgagcgcgauguggaccugggggccggaacaagacacguggcugucgaaccugagaucgccaaccuugauaucauuggccagcggaucgaaaauauuaagaacgagcacaaaucuaccuggcauuaugacgaagauaaucccuacaagaccugggcguaucacggguccuacgagguuaaacccagcggaucugccuccagcauggugaacggcgugguccgccugcucacaaagccuugggacgugauccccaugguuacgcaaauugcuaugaccgacacaaccccuuuuggccagcagagaguguucaaggagaaagucgauacacggaccccgagacccaagcgggggacagcccaaaucauggaagugaccgcuaaauggcuguggggauuucuuucucgcaauaagaaaccuagaaucuguacgcgggaggaguucacccgcaagguuagauccaacgccgcuauuggcgccguguuugucgacgagaaucaguggaacagcgcgaaggaagccguggaggaugagcgguucugggaccugguucaucgcgaaagagagcuccacaaacaggggaagugcgcuacaugcguguauaauaugaugggaaaacgggaaaagaaacugggcgaguuugggaaggccaagggcucccgcgcuaucugguacauguggcugggagccagauuccucgaguucgaggcccugggcuuuaugaacgaggaucauugguucagccgggaaaauucucuuagcggggucgagggagaaggccugcacaaacucggguacauucugcgcgacaucuccaagauucccggaggcaacauguaugcggaugacaccgcugggugggauacaagaaucaccgaggacgaucuucagaaugaggccaaaaucacggacauuauggaaccugagcacgcccugcucgcuacaucuaucuuuaagcugaccuaccaaaacaaagugguccgggugcagcgccccgccaagagcggcacaguuauggaugugauuuccagacgggaccagagaggaucuggccaggucgggaccuauggacugaacacguucaccaauauggaagugcaacucauccgccagauggagagcgaaggcaucuuuuccccgucugagcuggagaacagcaaucuugcugaacgggugcuggacuggcucgagaaacaugggguugaaagacugaagcgcauggccaucuccggagaugacuguguggucaagccuacagaugaccgguucgcgaccgcccuuacagcucugaacgauaugggcaaagugagaaaggacaucccccagugggagccuagcaaaggguggaaugauuggcagcaaguucccuuuugcucucaccauuuccaccagcucauuaugaaggacggccgcgaaaucguggucccuugucggaaccaggaugagcuggugggacgggcccgcgucucccagggcgcuggguggagccugcgggagaccgccugccucggaaaaucuuacgcgcaaauguggcagcugauguauuuucacagacgcgaccuucggcuggccgcuaaugccauuuguuccgcugugcccguuaacugggugccgacaagcagaaccacgugguccauccaugcccaccaucaguggaugacaaccgaagauaugcucucugucuggaaucggguguggauugaggaaaacccuuggauggaggacaagacccacguuagcuccugggaagacgugcccuaccugggcaagagagaggaucaauggugcgggagccuuaucggacugacagcucgcgccaccugggcgacaaauauucaggucgccaucaaccaggugcggagacucaucggcaaugagaacuaucuggacuacaugacgucuaugaaacgcuucaagaaugaauccgaucccgagggggcucugugguga

SEQ ID NO: 19467 - RNA, 9879 nt, Artificial Sequence
  derived and/or modified CDS sequence (opt5) from DENV-1__KM403591__SS-prME
agcgugaccaugcugcucaugcugcuucccacagcucuggcuuuccaccucacgacccggggaggggaaccucauaugaucgucuccaagcaagaacggggaaaaucucugcuuuuuaagacaagcgccggaguuaacaugugcacccugauugcgauggaccucggggaacugugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaagaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggggaaacucacccugaagggcguguccuaugucauguguacgggauccuucaaacuggagaaggaaguggccgagacacagcacggcaccguucuugugcaggucaaguacgaggggaccgacgcgccgugcaaaauuccuaucucuacacaagaugaaaagggagugacccagaacggccggcucaucacagcuaaucccauugugacggacaaagagaagccuguuaacaucgaaaccgagccgcccuucggggaguccuauauugucaucggagccggcgaaaaagcccugaagcugagcugguuuaagaaagggucuagcauuggcaagauguucgaggcuacagccagaggagcucgccggauggccauccucggcgauaccgcgugggacuuuggguccaucggaggcguguucacaucuguggggaaacugguccaucagguguuuggaaccgccuacggcguucuuuucagcgggguguccuggacgaugaagauuggcaucggcauucugcucaccuggcugggccugaauagcagaucuacaucccuuagcaugaccuguaucgcugucgggauggugacacucuaccugggaguuauggugcaggccgauucuggcugcgucauuaacuggaaagggcgcgaacugaaguguggauccggcaucuuugugaccaacgagguucacacauggaccgaacaauauaaguuccaggcugacagcccuaaacggcucuccgccgcgauugggaaggccugggaggagggcgugugcggaaucagaucugcuacgcgccuggaaaauaucauguggaaacagauuagcaacgagcuuaaucauauccugcucgaaaacgauaugaaguuuacagucguggugggcgacgccaaugggauucugacccagggcaagaagaugauccggccgcaacccauggagcacaaauacuccuggaagucuuggggcaaggcuaaaauuaucggggccgacacccagaacacaaccuucaucauugauggaccugacacgcccgaauguccugaugaccagagagccuggaauaucugggaggucgaggauuauggcuuuggcguuuucacaaccaacauuuggcugaaacuucgcgacagcuacacacagaugugcgaucaccggcucauguccgcugcgaucaaagacagcaaggccgugcaugcugauaugggguauuggauugaaucugagaaaaaugaaaccuggaagcuggccagagccuccuuuaucgaggugaagacauguaucuggccccgcagccacacccuguggucuaacggaguccucgaauccgagaugauuaucccgaaaauuuacggcgggccuaucagccaacauaauuaucggcccggauacuucacgcagaccgcuggcccuuggcaccuggggaaacuugagcuggacuucaaccucugcgaaggaacaaccgugguuguggaugagcacugcggcaauagaggccccucucugcggacaaccacggucacagggaaaauuauccaugaaugguguugccgcagcuguacccugccuccccuuagauuucggggagaggacggcugcugguacgggauggagaucagaccggugaaggaaaaagaggaaaaccucguucgcuccauggugagcgccggaucuggcgaggucgauuccuucagccuggggcugcucuguguguccauuaugaucgaagagguuaugcggucuagauggagccgcaagaugcugaugacaggaacccuugcgguguuuuuccugcucauuaugggccagcugaccuggaaugaccugaucagacuuugcauuauggucggcgcuaacguguccgaccggauggggaugggaacaacguaucuggcccucauggccaccuuuaagaugcgcccuauguucgcugugggccugcucuuuagacggcugacaucucgcgagguccuucugcucaccaucgggcugagccugguugccuccguggaacuucccaacucucuggaggaacucggagauggccuggcgauggggauuaugaugcucaaacugcuuacagacuuccaaagccaccagcuguggaccacgcuccugucccugacauuuaucaagaccacccuuagccuggauuacgcuuggaaaacaauggccauggugcucucuaucgucucccuguucccccucugucugagcaccacaucucagaagacgaccuggcuuccugugcugcugggauccuuuggcugcaaaccgcucacaauguuccugauuaccgagaauaagaucuggggcagaaagagcuggccccuuaacgaagggauuauggccguuggaaucgugucuauucugcucuccagccugcucaaaaaugacgucccucuggcuggcccccuuaucgccgggggaaugcugaucgcuuguuaugugauuuccggcagcucugccgaucugagccucgagcgggcggccgagguuuccugggaagaggaagcugagcauucuggggccagccacaacauccugguggaaguccaggacgauggaacaaugaagauuaaagacgaggagcgcgaugacacccuuacgauccugcucaaggcuacccugcucgccguguccggcgucuacccuaugucuauucccgccacacuguuugugugguauuucuggcagaagaagaaacagagaagcggcguucuuugggauaccccuagcccucccgaaguggagcgggcuguccuggacgaugggaucuaccgcauccugcagagaggacuccugggccggucucagguggggguuggaguguuccaagacggcgucuuucauacaauguggcacgugaccagaggggcggugcuuauguaucagggaaagcgccuggaacccagcugggccuccguuaagaaagaccucauuagcuacggcggcggguggcgguuccagggaucuuggaauacaggcgaggagguccaggugaucgcuguggaacccgggaagaacccuaaaaauguccaaacgacccccggaacauuuaagaccccggagggcgaagugggggccauugcccuggauuucaaaccuggaaccuccggcagccccaucguuaacagagagggcaagauuguggggcucuacggaaauggcgucgugacaacgucugggaccuauguuuccgcuaucgcccaggcgaaggcuagccaggaaggaccucugcccgagauugaggacgaaguguuuaaaaagcgcaaccuuacaaucauggaucugcaccccggcuccgggaaaaccaagcgguaccugccugccaucgucagagaggccauuaaacgcaagcuccggacacugauccuugcuccgaccagagugguugccucugaaauggcggaggcucugaagggcaugcccauucgcuaucaaacgacagccgugaaaagcgaacauaccggaaaggagaucgucgaccucaugugccacgccaccuucacaaugcggcugcuguccccugugagagugcccaauuacaacaugauuaucauggaugaggcucauuuuaccgacccugccagcaucgcugcccggggcuauauuucuacacgcgucgggaugggagaagcggccgcuaucuucaugaccgccacgcccccuggcuccguugaggcuuuuccgcagagcaaugccgugauucaggaugaagagagagacauccccgaacggucuuggaacagcggguacgauuggauuacagacuucccuggaaaaaccgugugguuuguccccuccaucaagucuggcaaugauaucgccaacugucuccgcaaaaacgggaagagagugauucagcuuagccggaagacauucgacaccgaguaucagaagacgaagaauaacgacugggauuacguugugaccacagacaucuccgagaugggcgcuaauuucagagcggaucgcgucauugacccucggagaugccugaaacccgugauccugaaggauggaccggaacgcguuauucucgccggcccuaugcccgugaccgcugccucugccgcucagcggagagggcgcaucggacggaaccagaauaaagagggcgaccaguacauuuauauggggcaaccccugaacaaugaugaagaccacgcccauuggacagaggcgaagaugcuucuggauaacaucaauaccccugagggaaucauucccgcucucuuugaaccugagagagaaaagagcgccgccaucgacggcgaguaccgccugagaggggaagcucggaaaacauucgucgagcugaugcgcagaggcgaucucccgguguggcuuuccuauaaggucgccagcgagggauuucaguacucugaccggcgcuggugcuucgauggcgaaagaaacaaucaggugcuggaggaaaacauggacguugagauuuggaccaaagaaggggagcggaagaaacugagaccccgcuggcucgacgcgcggacguauuccgauccucuggcccuuagagaguuuaaggaguucgcugccggacgccggagcguguccggcgaccugauccucgagauugggaaacugccccagcaccugacacucagagcucaaaaugcccuugauaaccuggugaugcugcacaauucugaacagggaggcaaggcuuaccggcaugccauggaggaacucccugacaccaucgagacccugaugcuucuggcgcucaucgccguccugacaggcgggguuacccuguuuuuccucagcggaaagggccuugggaaaacauccauuggacugcugugugugauggcuucuagcgugcuccuguggauggccuccgucgagccccacuggaucgcugccagcauuauccuugaauuuuuccugauggugcuccugauuccggagccugaucgccagagaacgccccaggacaaccaacuggccuauguugugaucggccuccuuuuuaugauccugaccgucgcugcgaacgaaauggggcugcucgagacaaccaagaaagaucugggaauuggccauguggucgccgagaaucaccaccaugcuacaaugcuugacaucgaucugcacccugccucugccuggacccucuacgcuguggccacgaccauuaucacacccaugaugcggcauaccauugaaaacacaaccgcgaauaucucccugacggccauugcuaaccaggccgcuauccugaugggccucgacaagggguggccuaucagcaaaauggauauuggaguuccccuucuggcccugggcugcuacucucaggugaauccgcucacacugaccgcggccguccuuaugcugguggcucacuaugccaucauugggccuggacuccaagcuaaggccacacgcgaggcucagaagagaaccgccgcgggcaucaugaaaaaccccaccguugacgggauuguggccaucgaucuggaccccgucguguacgacgcuaaguucgaaaaacagcugggacagaucaugcuccuuauucuguguacaucccaaauccugcucaugcggacgaccugggcccugugcgagagcauuacacuugcuaccggcccucugacaacccucugggaaggcucuccggggaaguuuuggaauacgacaaucgccgugagcauggccaacauuuuccgcggauccuaucuggcgggcgcugggcuggccuucucucucaugaaaagccuuggaggcgggagacggggaaccggcgcucagggcgagacccugggggagaaguggaagcgccagcugaaucagcucuccaaaagcgaauuuaacacauacaagagauccggaaucauggagguugaucggucugaagccaaagagggccugaagagaggggaaaccacaaaacaugccgucagccgcggaacggcuaaacuucggugguucguggagagaaaucuggugaagcccgagggcaaagucaucgaccucggguguggacgcggcggcugguccuauuacugcgccgggcugaagaaaguuaccgaagugaagggauauacaaaaggcgggccuggacacgaggaacccauuccuauggcgaccuacggcuggaacaucgugaagcugcacucugggcgggaugucuuuuucacacccccugagaaaugugacacccuccuuugcgauauuggagaaagcuccccgaaucccacgaucgaggagggcagaacccugcgcgugcugaagaugguugaaccuuggcuccggggcaaccaauuuuguauuaagauccugaaucccuacaugccuucuguggucgagacacuugaacagaugcagagaaaacaugggggaaugcuggugcgcaacccccucagcagaaauuccacccacgagauguauuggguuagcugcggcacagggaacauugugucugccgucaacaugaccuccagaaugcugcugaaucgcuucacaauggcucaucggaagccgaccuacgagagagacguggaucucggagccggcacgcgccacguggcugucgaaccugagaucgccaaccuggacaucauugggcagagaaucgaaaauauuaaaaacgagcacaagagcacauggcauuaugaugaagacaaucccuacaaaaccugggcguaucacggaucuuacgagguuaagcccuccggcagcgccucuuccauggugaacggcgugguccggcuucugaccaagccuugggaugugauccccaugguuacacaaauugcuaugacggacaccacaccuuuugggcagcagcgcguguucaaagagaaggucgacaccagaacaccgcggcccaaaagaggaaccgcccaaaucauggaagugacagcuaaguggcucuggggcuuucugagccggaauaaaaagccucgcaucuguaccagagaggaguucacgcggaagguucgcuccaacgccgcuauuggggccguguuugucgaugagaaucaguggaacagcgcgaaagaagccguggaggacgagagauucugggaucuuguucaucgggaacgcgagcugcacaagcagggaaaaugcgcuaccugcguguauaauaugaugggcaagagagagaaaaagcucggggaguuuggcaaggccaaaggaucucgggcuaucugguacauguggcugggcgcccgcuuccuggaguucgaggcccucggguuuaugaacgaggaccauugguucagcagagaaaauucccugucuggagucgagggcgaagggcuucacaagcugggauacauucuccgggauaucagcaaaauucccggcgggaacauguaugcggacgauacagcuggcugggacacccgcaucacagaggaugaccugcagaaugaggccaagaucaccgauauuauggaaccugagcacgcccuucuggcuacguccaucuuuaaacucacauaccaaaacaagguggucagagugcagcggcccgccaaaucuggaaccguuauggacgugauuagccgcagagaucagcggggcuccgggcaggucggaacauauggccugaacaccuucacgaauauggaagugcaacugaucagacagauggagucugaagggauuuuuagcccguccgagcucgagaacagcaaucuggcugaacgcgugcuugacuggcuggagaagcauggaguugaacggcucaagagaauggccaucucuggcgacgauuguguggucaaaccuaccgacgaucgcuucgcgacagcccugaccgcucuuaacgacauggggaaggugcggaaagauaucccccagugggagccuuccaagggcuggaaugacuggcagcaaguucccuuuugcagccaccauuuccaccagcugauuaugaaagauggaagagaaaucguggucccuugucgcaaccaggacgagcucgugggccgggccagagucucucagggggcuggauggucccugcgcgagacagccugccugggcaagagcuacgcgcaaauguggcagcucauguauuuucaccggagagaucugcgccuugccgcuaaugccauuuguuccgcugugcccguuaacugggugccgaccucucggacaaccuggagcauccaugcccaccaucaguggaugacgacagaagacaugcuguccgucuggaauagaguguggauugaggaaaacccuuggauggaggauaagacccacguuagcucuugggaagacgugcccuaccucgggaaacgggaggaccaauggugcggaucccugaucggccuuaccgcuagagccacaugggcgaccaauauucaggucgccaucaaccaggugcgccggcugaucgggaaugagaacuaucucgauuacaugacaagcaugaagagauucaaaaaugaaucugaccccgagggcgcucugugguga

SEQ ID NO: 19468 - RNA, 9879 nt, Artificial Sequence
  derived and/or modified CDS sequence (opt5) from DENV-1__KM403607__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuauccaagacgaaaagggggugacacagaacggacggcucauuaccgcuaaucccaucgugacagauaaagagaagccuguuaacauugaaacggagccgcccuucggcgaguccuauaucgucauuggggccggagaaaaagcccugaagcugagcugguuuaagaaaggcucuagcaucgggaagauguucgaggcuaccgccagaggcgcucgccggauggccauccucggagacacagcgugggauuuuggcuccauugggggaguguucaccucugugggcaaacugguccaucagguguuugggacagccuacggaguucuuuucagcggcguguccuggaccaugaagaucgggauuggcauccugcucacguggcugggacugaauagcagaucuaccucccuuagcaugacauguauugcugucggcauggugacccucuaccuggggguuauggugcaggccgacucuggaugcgucaucaacuggaaaggccgcgaacugaaguguggguccggaauuuuugugacaaacgagguucacaccuggacagaacaauauaaguuccaggcugauagcccuaaacggcucuccgccgcgaucggcaaggccugggaggagggggugugcggcaucagaucugcuacccgccuggaaaauauuauguggaaacagaucagcaacgagcuuaaucauauucugcucgaaaacgacaugaaguuuacggucguggugggagacgccaauggcauccugacacaggggaaaaagaugauucggccgcaacccauggagcacaaauacuccuggaagucuuggggaaaggcuaaaaucaucggcgccgauacccagaacaccacauucauuaucgacgggccugauacccccgaauguccugacgaucagagagccuggaauauuugggaggucgaggacuauggauuuggcguuuucacgacaaacaucuggcugaaacuucgcgauagcuacacccagaugugcgaccaccggcucauguccgcugcgauuaaagauagcaaggccgugcaugcugacaugggcuauuggaucgaaucugagaaaaaugaaacauggaagcuggccagagccuccuuuaucgaggugaagaccuguauuuggccccgcagccacacacuguggucuaacgggguccucgaauccgagaugaucauuccgaaaaucuacggaggcccuauuagccaacauaauuaucggcccggguacuucacccagacggcuggaccuuggcaccugggcaaacuugagcuggauuucaaccucugcgaagggaccacagugguuguggacgagcacugcggaaauagaggccccucucugcggaccacaaccgucacgggcaaaaucauccaugaaugguguugccgcagcuguacacugccuccccuuagauuuagaggggaagauggaugcugguacggcauggagauuagaccggugaaggaaaaagaggaaaaccucguucgcuccauggugagcgccgggucuggagaggucgacuccuucagccugggccugcucuguguguccaucaugauugaagagguuaugcggucuagauggagccgcaagaugcugaugaccgggacacuugcgguguuuuuccugcucaucaugggacagcugaccuggaaugaccugauuagacuuugcaucauggucggcgcuaacguguccgaucggaugggcauggggaccacauaucuggcccucauggccacguuuaagaugcgcccuauguucgcugugggacugcucuuuagacggcugaccucucgcgagguccuucugcucacaauuggccugagccugguugccuccguggaacuucccaacucucuggaggaacucggggacggacuggcgaugggcaucaugaugcucaaacugcuuaccgauuuccaaagccaccagcuguggacaacccuccugucccugacguuuaucaagacaacccuuagccuggacuacgcuuggaaaaccauggccauggugcucucuauugucucccuguucccccucugucugagcacaaccucucagaagacaacguggcuuccugugcugcugggguccuuuggaugcaaaccgcucaccauguuccugaucacagagaauaagauuuggggcagaaagagcuggccccuuaacgaaggcaucauggccguugggauugugucuauccugcucuccagccugcucaaaaaugaugucccucuggcuggaccccuuaucgccggcgggaugcugauugcuuguuaugugaucuccggaagcucugccgaccugagccucgagcgggcggccgagguuuccugggaagaggaagcugagcauucuggcgccagccacaacauucugguggaaguccaggaugacgggaccaugaagaucaaagaugaggagcgcgacgauacacuuaccauucugcucaaggcuacgcugcucgccguguccggagucuacccuaugucuauccccgccacccuguuugugugguauuucuggcagaagaagaaacagagaagcggcguucuuugggacacaccuagcccucccgaaguggagcgggcuguccuggaugacggcaucuaccgcauucugcagagagggcuccugggacggucucaggugggcguugggguguuccaagacggagucuuucauaccauguggcacgugacaagaggcgcggugcuuauguaucaggggaaacgccuggaacccagcugggccuccguuaagaaagaucucaucagcuacggaggcggcuggcgguuccaggggucuuggaauaccggagaggagguccaggugauugcuguggaacccggcaagaacccuaaaaauguccaaacaacgcccgggaccuuuaagacaccggagggagaagugggcgccaucgcccuggacuucaaaccugggaccuccggaagccccauuguuaacagagagggcaagaucgugggccucuacgggaauggagucgugaccacaucuggcacguauguuuccgcuauugcccaggcgaaggcuagccaggaagggccucugcccgagaucgaggaugaaguguuuaaaaagcgcaaccuuaccaucauggaccugcaccccggauccggcaaaacacggagauaccugccugccauuguccgcgaggccaucaagcggaaacucagaacccugauucuugcuccgacacgcgugguugccucugaaauggcggaggcucugaaggggaugcccauccgguaucaaaccacggccgugaaguccgaacauacaggcaaagagauugucgaucucaugugccacgccaccuucaccaugagacugcuguccccugugcgggugcccaauuacaacaugaucaucauggacgaggcucauuuuacagauccugccagcauugcugcccgcggauauaucucuaccagagucggcaugggggaagcggccgcuauuuucaugacagccacacccccuggauccguugaggcuuuuccgcagagcaaugccgugauccaggacgaagaacgggauauucccgaacgcucuuggaacagcggcuacgacuggaucacggauuucccugggaagacagugugguuuguccccuccaucaaaucuggaaaugacauugccaacugucucagaaagaacggcaaacgggugauccagcuuagcagaaagaccuucgacacagaguaucaaaagaccaaaaauaacgauugggacuacguugugacgaccgauauuuccgagaugggggcuaauuuccgcgcggaccgggucaucgauccuagacgcugccugaagcccgugauucugaaagacggcccggaacggguuauccucgccggaccuaugcccgugacagcugccucugccgcucagagacgcggccggauugggagaaaccagaauaaggagggagaucaguacaucuauaugggccaaccccugaacaaugacgaagaucacgcccauuggaccgaggcgaaaaugcuucuggacaacaucaauacaccugaggggauuauccccgcucucuuugaaccugagcgcgaaaagagcgccgccauugauggagaguacagacugcggggcgaagcucgcaagaccuucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagaucuggacaaaggaaggcgagcgcaagaagcugcgcccccgguggcucgaugcgagaaccuauuccgacccucuggcccuucgcgaguuuaaagaguucgcugccgggcggagaagcguguccggagaucugauucucgagaucggcaagcugccccagcaccugacgcuccgggcucaaaaugcccuugacaaccuggugaugcugcacaauucugaacaagggggaaaggcuuaccgccaugccauggaggaacucccugauacaaucgagacccugaugcuucuggcgcucauugccguccugaccggcggcguuacacuguuuuuccucagcgggaagggacuuggcaagaccuccaucgggcugcugugugugauggcuucuagcgugcuccuguggauggccuccgucgagccccacuggauugcugccagcaucauucuugaauuuuuccugauggugcuccugaucccggagccugacagacagcggacaccccaggauaaccaacuggccuauguugugaucggacuccuuuuuaugauucugacggucgcugcgaacgaaaugggccugcucgagaccaccaaaaaggaccuggggaucggacauguggucgccgagaaucaccaccaugcuaccaugcuugauauugaccugcacccugccucugccuggacacucuacgcuguggccaccacgaucauuacccccaugaugcgccauacaaucgaaaacaccacagcgaauauuucccugaccgccaucgcuaaccaggccgcuauccugaugggccucgauaaaggcuggccuauuagcaagauggacaucgggguuccccuucuggcccugggaugcuacucucaggugaauccgcucacgcugacagcggccguccuuaugcugguggcucacuaugccauuaucggcccugggcuccaagcuaaagccaccagagaggcucagaagcggacagccgcgggaauuaugaagaaccccaccguugauggcaucguggccaucgaccuggaccccgucguguacgaugcuaaauucgaaaagcagcuggggcagauuaugcuccuuauccuguguaccucccaaauucugcucaugcgcacaacgugggcccugugcgagagcaucacccuugcuacaggaccucugaccacacucugggaaggcucuccgggcaaauuuuggaauaccacgauugccgugagcauggccaacaucuucagaggguccuaucuggcgggagcuggccuggccuucucucucaugaagacacuugggggaggccggcgcgggaccggagcucagggcgagacccugggcgagaaauggaagagacagcugaaucagcucagcaaguccgaauuuaacacauacaaacggagcgggaucauggagguugacagauccgaagccaaggagggacugaaacgcggcgaaaccacaaagcaugccgucucucgggggacggcuaaacuuagaugguucguggagcgcaaucuggugaagcccgagggaaaggucauugaucucggcugugggcggggaggcuggagcuauuacugcgccggccugaaaaagguuaccgaagugaaaggguauacaaagggaggcccugggcacgaggaacccaucccuauggcgaccuacggauggaacauugugaaacugcacuccggcagagacgucuuuuucacacccccugagaagugugauacccuccuuugcgacaucggggaaucuagcccgaaucccacgauugaggagggacgcacccugcgggugcugaaaaugguugaaccuuggcucagaggcaaccaauuuuguaucaagauucugaaucccuacaugccuuccguggucgagacacuugaacagaugcagcgcaagcauggcgggaugcuggugcggaacccccucucuagaaauagcacccacgagauguauuggguuuccugcggaacaggcaacaucgugagcgccgucaacaugaccucucgcaugcugcugaaucgguucacaauggcucauagaaaaccgaccuacgagcgcgauguggaccucggggccggaacgagacacguggcugucgaaccugagaucgccaaccuggauauuaucggccagcggauugaaaauaucaagaacgagcacaaauccacauggcauuaugacgaagauaaucccuacaagaccugggcguaucacgggagcuacgagguuaaacccucuggauccgccagcucuauggugaacggcgugguccgccuucugaccaagccuugggacgugauucccaugguuacacaaaucgcuaugacggacaccacaccuuuuggccagcagagaguguucaaggagaaagucgauacccggacaccgagacccaagcgggggaccgcccaaaucauggaagugacagcuaaauggcucuggggauuucugucccgcaauaagaaaccuagaauuuguacccgggaggaguucacgcgcaagguuagaagcaacgccgcuaucggcgccguguuugucgacgagaaucaguggaacuccgcgaaggaagccguggaggaugagcgguucugggaccuuguucaucgcgaaagagagcugcacaaacaggggaagugcgcuaccugcguguauaauaugaugggaaaacgggaaaagaaacucggcgaguuugggaaggccaagggcagccgcgcuauuugguacauguggcugggagccagauuccuggaguucgaggcccucggcuuuaugaacgaggaucauugguucucucgggaaaauagccuguccggggucgagggagaaggccuucacaaacugggguacauccuccgcgacauuucuaagauccccggaggcaacauguaugcggaugacacagcugggugggauaccagaaucacagaggacgaucugcagaaugaggccaaaauuaccgacaucauggaaccugagcacgcccuucuggcuacgagcauuuuuaagcucacauaccaaaacaaagugguccgggugcagcgccccgccaaguccggcaccguuauggaugugaucucuagacgggaccagagaggaagcggccaggucgggacauauggacugaacaccuucacgaauauggaagugcaacugauucgccagauggaguccgaaggcaucuuuucuccgagcgagcucgagaacuccaaucuggcugaacgggugcuugacuggcuggagaaacaugggguugaaagacucaagcgcauggccaucagcggagaugacuguguggucaagccuaccgaugaccgguucgcgacagcccugaccgcucuuaacgauaugggcaaagugagaaaggacauuccccagugggagccuucuaaaggguggaaugauuggcagcaaguucccuuuugcucccaccauuuccaccagcugaucaugaaggacggccgcgaaauuguggucccuugucggaaccaggaugagcucgugggacgggcccgcgucagccagggcgcuggguggucucugcgggagacagccugccugggaaaauccuacgcgcaaauguggcagcucauguauuuucacagacgcgaccugcggcuugccgcuaaugccaucuguagcgcugugcccguuaacugggugccgaccuccagaacaaccuggucuauucaugcccaccaucaguggaugacgacagaagauaugcugagcgucuggaaucggguguggaucgaggaaaacccuuggauggaggacaagacccacguuuccagcugggaagacgugcccuaccucggcaagagagaggaucaauggugcgggucucugauuggacuuaccgcucgcgccacaugggcgaccaauauccaggucgccaucaaccaggugcggagacugauuggcaaugagaacuaucucgacuacaugacauccaugaaacgcuucaagaaugaaagcgaucccgagggggcucugugguga

SEQ ID NO: 19469 - RNA, 9879 nt, Artificial Sequence
  derived and/or modified CDS sequence (opt5) from DENV-1__KM403581__SS-prME
agcgugaccaugcugcugaugcugcuucccacagcucuggcuuuccaccucacgacccggggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccgcgcauuacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaggagaaaucuuggcugguccauaagcagugguuucuugaccugccucuccccuggacguccggggcuagcacaucccaagagaccuggaaucggcaggaucugcuggugacauucaaaaccgcgcacgccaagaaacaggaagucgugguucucggaucucaagagggcgcuaugcacaccgcccugacaggggccacggaaauucagaccagcggaacaaccacaaucuuugcuggccaucuuaagugcagacugaagauggacaaacucacccugaaggggguguccuaugucauguguacgggcagcuucaaacuggagaaggaaguggccgagacacagcacggaaccguucuugugcaggucaaauacgagggcaccgaugcgccgugcaagauuccuaucucuacacaagacgaaaagggggugacccagaacggacgccucaucacagcuaaucccauugugacggauaaagagaagccuguuaacaucgaaaccgagccgcccuucggcgaguccuauauugucaucggggccggagaaaaagcccugaagcugagcugguuuaaaaagggcucuagcauugggaagauguucgaggcuacagcccggggcgcuagacgcauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagccggucuacaucccuuagcaugaccuguaucgcugucggcauggugacacucuaccuggggguuauggugcaggccgacucuggaugcgucauuaacuggaaaggcagagaacugaaguguggguccggaaucuuugugaccaacgagguucacacauggaccgaacaauauaaauuccaggcugauagcccuaagcgccucuccgccgcgauuggcaaggccugggaggagggggugugcggcauccggucugcuacgagacuggaaaauaucauguggaaacagauuagcaacgagcuuaaucauauccugcucgaaaacgacaugaaguuuacagucguggugggagacgccaauggcauucugacccaggggaaaaagaugauccgcccgcaacccauggagcacaaauacuccuggaagucuuggggaaaagcuaagauuaucggcgccgauacccagaacacaaccuucaucauugacgggccugauacgcccgaauguccugacgaucagcgggccuggaauaucugggaggucgaggacuauggauuuggcguuuucacaaccaacauuuggcugaaacuuagagauagcuacacacagcucugcgaccaccgccugauguccgcugcgaucaaagauagcaaggccgugcaugcugacaugggcuauuggauugaaucugagaaaaaugaaaccuggaagcuggcccgggccuccuuuaucgaggugaaaacauguaucuggcccagaagccacacccucuggucuaacgggguccuggaauccgagaugauuaucccgaagauuuacggaggcccuaucagccaacauaauuaucggcccggguacuucacgcagaccgcuggaccuuggcaccuuggcaagcuggagcucgauuucaaccugugcgaagggacaaccgugguuguggacgagcacugcggaaaucgcggccccucucugagaacaaccacggucacaggcaaaauuauccaugaaugguguugccggagcuguacccuuccuccccucagauuucgcggggaggauggaugcugguacggcauggagauccggccggugaaggaaaaagaggaaaaccugguuagauccauggugagcgccgggucuggagaggucgacuccuucagccugggccuccuguguguguccauuaugaucgaagagguuaugcgcucuagauggagccggaagaugcuuaugacagggacccuggcgaucuuuuuccuccugaucaugggacagcugaccuggaaugaccuuauucgccugugcaucauggugggcgcuaacgucuccgauagaaugggcauggggacaacguaucucgcccugauggccaccuuuaaaaugcggccuauguucgcugugggacuccuguuucgcagacuuacaucucgggaggugcugcuccugaccauuggccugagccuugucgccuccguugaacugcccaacucucucgaggaacugggggacggacucgcgaugggcaucaugaugcugaaacuucugacagauuuccaaagccaccagcucuggaccacgcugcugucccuuacauuuaucaagaccacccugagccucgacuacgcuuggaaaacaauggccauggugcugucuauugugucccucuucccccugugucuuagcaccacaucucagaagacgaccuggcugccuguccugcucggguccuuuggaugcaaaccgcugacaauguuccuuaucaccgagaauaagauuuggggccgcaaaagcuggccccugaacgaaggcaucauggccguggggauuguuucuauccuccuguccagccuccugaagaaugaugugccucuugcuggaccccugaucgccggcgggaugcugauugcuuguuaugucaucuccggaagcucugccgaccucagccuggagagagcggccgagguguccugggaagaggaagcugagcauucuggcgccagccacaacauucuuguugaagugcaggaugacgggacaaugaagaucaaagaugaggagcgggacgauacccugacgauucuccugaaggcuacccuccuggccgucuccggaguguacccuaugucuauccccgccacacuuuuugucugguauuucuggcagaagaagaaacagcgcagcggcgugcugugggacaccccuagcccucccgaaguugagagagcugugcuggaugacggcaucuaccggauucuccagagagggcugcuuggacgcucucaggucggcguggggguuuuccaagacggaguguuucauacaauguggcacgucacccggggcgcggugcugauguaucaggggaaaagacucgaacccagcugggccuccgugaaaaaggaucugaucagcuacggaggcggcuggcgcuuccaggggucuuggaauacaggagaggagguucaggucauugcuguggaacccggcaagaacccuaaaaaugugcaaacgacccccgggacauuuaagaccccggagggagaagucggcgccaucgcccucgacuucaaaccugggaccuccggaagccccauugugaaccgggagggcaagaucguuggccuguacgggaauggaguggucacaacgucuggcaccuauguguccgcuauugcccaggcgaaagcuagccaggaagggccucuucccgagaucgaggaugaaguuuuuaagaagagaaaccugacaaucauggaccugcaccccggauccggcaaaacccgccgguaccucccugccauugugagagaggccaucaagcgcaaacugcggacacuuauucuggcuccgaccagagucguggccucugaaauggcggaggcucucaaggggaugcccauccgguaucaaacgacagccguuaaaagcgaacauaccggcaaggagauuguggaucugaugugccacgccaccuucacaaugcgccugcucuccccugucagagugcccaauuacaacaugaucaucauggacgaggcucauuuuaccgauccugccagcauugcugcccggggauauaucucuacacgcgugggcaugggggaagcggccgcuauuuucaugaccgccacgcccccuggauccgucgaggcuuuuccgcagagcaaugccguuauccaggacgaagagagagauauucccgaacggucuuggaacagcggcuacgacuggaucacagauuucccugggaagaccgugugguuugugcccuccaucaaaucuggaaaugacauugccaacugucuuagaaagaacggcaaacgcgucauccagcugagccggaagacauucgacaccgaguaucagaagacgaagaauaacgauugggacuacgugguuaccacagauauuuccgagaugggggcuaauuucagagcggaccgcgugaucgauccucggagaugccugaagcccgucauucucaaagacggcccggaacgcgugauccuggccggaccuaugcccguuaccgcugccucugccgcucagcggagaggccgcauugggagaaaccagaauaaggagggagaucaguacaucuauaugggccaaccccuuaacaaugacgaagaucacgcccauuggacagaggcgaaaaugcugcucgacaacaucaauaccccugaggggauuauccccgcucuguuugaaccugagcgggaaaagagcgccgccauugauggagaguaccgccugagaggcgaagcucggaaaacauucguggagcucaugcgcagaggggaccuuccggucuggcuguccuauaagguggccagcgagggcuuucaguacucugaucggagauggugcuucgacggagaacgcaacaaucagguccuggaggaaaacauggacguggagaucuggaccaaggaaggcgagcggaaaaagcucagaccccgcuggcuggaugcgcggacguauuccgacccucuugcccugagagaguuuaaagaguucgcugccgggcggcgcagcguuuccggagaucucauucuggagaucggcaagcugccccagcaccucacacuuagagcucaaaaugcccuggacaaccuggugaugcuccacaauucugaacaagggggaaaggcuuaccggcaugccauggaggaacugccugauaccaucgagacccuuaugcugcucgcgcugauugccgugcugacaggcggcgucacccucuuuuuccuuagcgggaagggacugggcaaaacauccaucgggcugcucuguguuauggcuucuagcgugcugcuuuggauggccuccguggagccccacuggauugcugccagcaucauucuggaauuuuuccucaugguccugcugaucccggagccugaccgccagagaacgccccaggauaaccaacucgccuaugugguuaucggacuucuguuuaugauucugaccguggcugcgaacgaaaugggccuccuggagacaaccaagaaggaccuugggaucggacaugucguggccgagaaucaccaccaugcuacaaugcuggauauugaccuccacccugccucugccuggacccuguacgcugucgccacgaccaucauuacacccaugaugcggcauaccaucgaaaacacaaccgcgaauauuucccugacggccaucgcuaaccaggccgcuauccucaugggccuugauaaaggcuggccuauuagcaagauggacaucggggugccccugcuggcccucggaugcuacucucagguuaauccgcugacacuuaccgcggccgugcugaugcucgucgcucacuaugccauuaucggcccugggcugcaagcuaaagccacacgcgaggcucagaagagaaccgccgcgggaauuaugaaaaaccccaccguggauggcaucguugccaucgaccuggaccccguggucuacgaugcuaaguucgaaaagcagcucgggcagauuaugcuucugauccuguguacaucccaaauucuccugaugcggacgaccugggcccuuugcgagagcaucacacuggcuaccggaccucucacaacccugugggaaggcucuccgggcaaauuuuggaauacgacaauugccgugagcauggccaacaucuuccgcggguccuaucuggcgggagcuggccucgccuucucucuuaugaagucccucgggggaggcagacgggggaccggagcucagggcgagacccugggcgagaaauggaagagacagcucaaucagcuguccaaaagcgaauuuaacacauacaagcgcuccgggaucauggagguggaccggucugaagccaaggagggacuuaaaagaggcgaaaccacaaagcaugccguuagccgcgggacggcuaaacugcggugguucgucgagagaaaucucgugaagcccgagggaaaagugauugaucugggcugugggcgcggaggcugguccuauuacugcgccggccugaagaaggucaccgaaguuaaaggguauacaaagggaggcccugggcacgaggaacccaucccuauggcgaccuacggauggaacauugugaaacuccacucuggccgggacguguuuuucacacccccugagaagugugauacccuucugugcgacaucggggaaagcuccccgaaucccacgauugaggagggaagaacccugcgcguccucaaaaugguggaaccuuggcugcggggcaaccaauuuuguaucaagauucuuaaucccuacaugccuucuguuguggagacacuggaacagaugcagagaaaacauggcgggaugcucguccgcaacccccugagcagaaauuccacccacgagauguauugggugagcugcggaacaggcaacaucguuucugccgugaacaugaccuccagaaugcugcucaaucgcuucacaauggcucauagaaagccgaccuacgagcgggaugucgaccugggggccggaacgcgccacguggcuguggaaccugagaucgccaaccuugauauuaucggccagagaauugaaaauaucaagaacgagcacaaaagcacauggcauuaugacgaagauaaucccuacaagaccugggcguaucacgggucuuacgaggucaaacccuccggaagcgccucuuccaugguuaacggcguggugcggcugcucaccaagccuugggacgucauucccauggugacacaaaucgcuaugacggacaccacaccuuuuggccagcagagaguuuucaaagagaagguggauacccggacaccgcgccccaagagagggaccgcccaaaucauggaagucacagcuaaauggcuguggggauuucuuagccggaauaagaaaccucgcauuuguaccagagaggaguucacgcggaaggugcgcuccaacgccgcuaucggcgccguuuuuguggacgagaaucaguggaacagcgcgaaagaagccgucgaggaugagagauucugggaccuggugcaucgggaacgcgagcuccacaagcaggggaagugcgcuaccugcguuuauaauaugaugggaaaaagagaaaagaaacugggcgaguuugggaaggccaaaggcucucgggcuauuugguacauguggcugggagcccgcuuccucgaguucgaggcccugggcuuuaugaacgaggaucauugguucagcagagaaaauucccuuucugggguggagggagaaggccugcacaagcucggguacauccugcgggacauuagcaagauccccggaggcaacauguaugcggaugacacagcugggugggauacccgcaucacagaggacgaucuucagaaugaggccaaaauuaccgacaucauggaaccugagcacgcccugcucgcuacguccauuuuuaagcugacauaccaaaacaaagucgugagaguccagcggcccgccaagucuggcaccgugauggauguuaucagcagacgcgaccagcggggauccggccagguggggacauauggacugaacaccuucacgaauauggaaguccaacucauuagacagauggagucugaaggcaucuuuagcccguccgagcuggagaacagcaaucuugcugaacgcgugcuggacuggcucgagaaacaugggguggaacggcugaagagaauggccaucucuggagaugacuguguugugaaaccuaccgaugaccgcuucgcgacagcccuuaccgcucugaacgauaugggcaagguccggaaggacauuccccagugggagccuuccaaaggguggaaugauuggcagcaagugcccuuuugcagccaccauuuccaccagcucaucaugaaggacggcagagaaauuguugugccuugucgcaaccaggaugagcuggucggacgggccagagugucucagggcgcuggguggucccugcgcgagacagccugccucggaaaaagcuacgcgcaaauguggcagcugauguauuuucaccggagagaccuucggcuggccgcuaaugccaucuguuccgcuguccccgugaacuggguuccgaccucuagaacaaccuggagcauucaugcccaccaucaguggaugacgacagaagauaugcucuccguguggaaucgcgucuggaucgaggaaaacccuuggauggaggacaagacccacgugagcucuugggaagacguucccuaccugggcaaacgggaggaucaauggugcgggucccuuauuggacugaccgcuagagccacaugggcgaccaauauccagguggccaucaaccagguccgcagacucauuggcaaugagaacuaucuggacuacaugacaagcaugaagcgguucaagaaugaaucugaucccgagggggcucugugguga

SEQ ID NO: 19470 - RNA, 9879 nt, Artificial Sequence
  derived and/or modified CDS sequence (opt5) from DENV-1__KM403597__SS-prME
agcgugaccaugcugcucaugcugcuucccacagcucuggcuuuccaccucacgacccggggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccgcgcauuacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaggagaaaucuuggcugguccauaagcagugguuucuugaccugccucuccccuggacguccggggcuagcacaucccaagagaccuggaaucggcaggaucugcuggugacauucaaaaccgcgcacgccaagaaacaggaagucgugguucucggaucucaagagggcgcuaugcacaccgcccugacaggggccacggaaauucagaccagcggaacaaccacaaucuuugcuggccaucuuaagugcagacugaagauggacaaacucacccugaaggggguguccuaugucauguguacgggcagcuucaaacuggagaaggaaguggccgagacacagcacggaaccguucuugugcaggucaaauacgagggcaccgaugcgccgugcaagauuccuaucucuacacaagacgaaaagggggugacccagaacggacgccucaucacagcuaaucccauugugacggauaaagagaagccuguuaacaucgaaaccgagccgcccuucggcgaguccuauauugucaucggggccggagaaaaagcccugaagcugagcugguuuaaaaagggcucuagcauugggaagauguucgaggcuacagcccggggcgcuagacgcauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagccggucuacaucccuuagcaugaccuguaucgcugucggcauggugacacucuaccuggggguuauggugcaggccgacucuggaugcgucauuaacuggaaaggcagagaacugaaguguggguccggaaucuuugugaccaacgagguucacacauggaccgaacaauauaaauuccaggcugauagcccuaagcgccucuccgccgcgauuggcaaggccugggaggagggggugugcggcauccggucugcuacgagacuggaaaauaucauguggaaacagauuagcaacgagcuuaaucauauccugcucgaaaacgacaugaaguuuacagucguggugggagacgccaauggcauucugacccaggggaaaaagaugauccgcccgcaacccauggagcacaaauacuccuggaagucuuggggaaaagcuaagauuaucggcgccgauacccagaacacaaccuucaucauugacgggccugauacgcccgaauguccugacgaucagcgggccuggaauaucugggaggucgaggacuauggauuuggcguuuucacaaccaacauuuggcugaaacuuagagauagcuacacacagaugugcgaccaccgccucauguccgcugcgaucaaagauagcaaggccgugcaugcugacaugggcuauuggauugaaucugagaaaaaugaaaccuggaagcuggcccgggccuccuuuaucgaggugaaaacauguaucuggcccagaagccacacccuguggucuaacgggguccucgaauccgagaugauuaucccgaagauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaaucgcggccccucucugagaacaaccacggucacaggcaaaauuauccaugaaugguguugccggagcuguacccugccuccccuuagauuucgcggggaggauggaugcugguacggcauggagauccggccggugaaggaaaaagaggaaaaccucguuagauccauggugagcgccgggucuggagaggucgacuccuucagccugggccugcucuguguguccauuaugaucgaagagguuaugcgcucuagauggagccggaagaugcugaugacagggacccuugcgaucuuuuuccugcucaucaugggacagcugaccuggaaugaccugauucgccuuugcaucauggugggcgcuaacgucuccgauagaaugggcauggggacaacguaucuggcccucauggccaccuuuaaaaugcggccuauguucgcugugggacugcucuuucgcagacugacaucucgggaggugcuucugcucaccauuggccugagccuggucgccuccguugaacuucccaacucucuggaggaacucggggacggacuggcgaugggcaucaugaugcucaagcugcuuacagauuuccaaagccaccagcuguggaccacgcuccugucccugacauuuaucaagaccacccuuagccuggacuacgcuuggaaaacaauggccauggugcucucuauugugucccuguucccccucugucugagcaccacaucucagaagacgaccuggcuuccuguccugcugggguccuuuggaugcaaaccgcucacaauguuccugaucaccgagaauaagauuuggggccgcaaaagcuggccccuuaacgaaggcaucauggccguggggauuguuucuauccugcucuccagccugcucaagaaugaugugccucuggcuggaccccuuaucgccggcgggaugcugauugcuuguuaugucaucuccggaagcucugccgaccugagccucgagagagcggccgagguguccugggaagaggaagcugagcauucuggcgccagccacaacauucugguugaagugcaggaugacgggacaaugaagaucaaagaugaggagcgggacgauacccuuacgauucugcucaaggcuacccugcucgccgucuccggaguguacccuaugucuauccccgccacacuguuugucugguauuucuggcagaagaagaaacagcgcagcggcgugcuuugggacaccccuagcccucccgaaguugagagagcugugcuggaugacggcaucuaccggauucugcagagagggcuccugggacgcucucaggucggcguggggguuuuccaagacggaguguuucauacaauguggcacgucacccggggcgcggugcuuauguaucaggggaaaagacuggaacccagcugggccuccgugaaaaaggaucucaucagcuacggaggcggcuggcgcuuccaggggucuuggaauacaggagaggagguucaggucauugcuguggaacccggcaagaacccuaaaaaugugcaaacgacccccgggacauuuaagaccccggagggagaagucggcgccaucgcccuggacuucaaaccugggaccuccggaagccccauugugaaccgggagggcaagaucguuggccucuacgggaauggaguggucacaacgucuggcaccuauguguccgcuauugcccaggcgaaagcuagccaggaagggccucugcccgagaucgaggaugaaguuuuuaagaagagaaaccuuacaaucauggaccugcaccccggauccggcaaaacccgccgguaccugccugccauugugagagaggccaucaagcgcaaacuccggacacugauucuugcuccgaccagagucguggccucugaaauggcggaggcucugaaggggaugcccauccgguaucaaacgacagccguuaaaagcgaacauaccggcaaggagauuguggaucucaucugccacgccaccuucacaaugcgccugcuguccccugucagagugcccaauuacaacaugaucauuauggacgaggcucauuuuaccgauccugccagcaucgcugcccggggauauauuucuacacgcgugggcaugggggaagcggccgcuaucuucaugaccgccacgcccccuggauccgucgaggcuuuuccgcagagcaaugccguuauucaggacgaagagagagauauccccgaacggucuuggaacagcggcuacgacuggaucacagauuucccugggaagaccgugugguuugugcccuccauuaaaucuggaaaugacaucgccaacugucucagaaagaacggcaaacgcgucauucagcuuagccggaagacauucgacaccgaguaucagaagacgaagaauaacgauugggacuacgugguuaccacagauaucuccgagaugggggcuaauuucagagcggaccgcgugauugauccucggagaugccugaagcccgucauccugaaagacggcccggaacgcgugauucucgccggaccuaugcccguuaccgcugccucugccgcucagcggagaggccgcaucgggagaaaccagaauaaggagggagaucaguacaucuauaugggccaaccccugaacaaugacgaagaucacgcccauuggacagaggcgaaaaugcuucuggacaacauuaauaccccugaggggaucauucccgcucucuuugaaccugagcgggaaaagagcgccgccaucgauggagaguaccgccugagaggcgaagcucggaaaacauucguggagcugaugcgcagaggggaccucccggucuggcuuuccuauaagguggccagcgagggcuuucaguacucugaucggagauggugcuucgacggagaacgcaacaaucagguccuggaggaaaacauggacguggagauuuggaccaaggaaggcgagcggaaaaagcugagaccccgcuggcucgaugcgcggacguauuccgacccucuggcccuuagagaguuuaaagaguucgcugccgggcggcgcagcguuuccggagaucugauccucgagaucggcaagcugccccagcaccugacacucagagcucaaaaugcccuugacaaccuggugaugcugcacaauucugaacaagggggaaaggcuuaccggcaugccauggaggaacucccugauaccauugagacccugaugcuucuggcgcucaucgccgugcugacaggcggcgucacccuguuuuuccucagcgggaagggacuuggcaaaacauccauugggcugcuguguguuauggcuucuagcgugcuccuguggauggccuccguggagccccacuggaucgcugccagcauuauccuugaauuuuuccugaugguccuccugaucccggagccugaccgccagagaacgccccaggauaaccaacuggccuaugugguuauuggacuccuuuuuaugauccugaccguggcugcgaacgaaaugggccugcucgagacaaccaagaaggaccuggggauuggacaugucguggccgagaaucaccaccaugcuacaaugcuugauaucgaccugcacccugccucugccuggacccucuacgcugucgccacgaccauuaucacacccaugaugcggcauaccauugaaaacacaaccgcgaauaucucccugacggccaucgcuaaccaggccgcuauucugaugggccucgauaaaggcuggccuaucagcaagauggacauuggggugccccuucuggcccugggaugcuacucucagguuaauccgcucacacugaccgcggccgugcuuaugcuggucgcucacuaugccaucauuggcccugggcuccaagcuaaagccacacgcgaggcucagaagagaaccgccgcgggaaucaugaaaaaccccaccguggauggcaucguugccauugaccuggaccccguggucuacgaugcuaaguucgaaaagcagcuggggcagaucaugcuccuuauucuguguacaucccaaauccugcucaugcggacgaccugggcccugugcgagagcauuacacuugcuaccggaccucugacaacccucugggaaggcucuccgggcaaauuuuggaauacgacaaucgccgugagcauggccaacaucuuccgcggguccuaucuggcgggagcuggccuggccuucucucucaugaagucccuugggggaggcagacgggggaccggagcucagggcgagacccugggcgagaaauggaagagacagcugaaucagcucuccaaaagcgaauuuaacacauacaagcgcuccgggauuauggagguggaccggucugaagccaaggagggacugaaaagaggcgaaaccacaaagcaugccguuagccgcgggacggcuaaacuucggugguucgucgagagaaaucuggugaagcccgagggaaaagugaucgaucucggcugugggcgcggaggcugguccuauuacugcgccggccugaagaaggucaccgaaguuaaaggguauacaaagggaggcccugggcacgaggaacccauuccuauggcgaccuacggauggaacaucgugaaacugcacucuggccgggacguguuuuucacacccccugagaagugugauacccuccuuugcgacauuggggaaagcuccccgaaucccacgaucgaggagggaagaacccugcgcguccugaaaaugguggaaccuuggcuccggggcaaccaauuuuguauuaagauccugaaucccuacaugccuucuguuguggagacacuugaacagaugcagagaaaacauggcgggaugcugguccgcaacccccucagcagaaauuccacccacgagauguauugggugagcugcggaacaggcaacaucguuucugccgugaacaugaccuccagaaugcugcugaaucgcuucacaauggcucauagaaagccgaccuacgagcgggaugucgaccucggggccggaacgcgccacguggcuguggaaccugagauugccaaccuggauaucauuggccagagaaucgaaaauauuaagaacgagcacaaaagcacauggcauuaugacgaagauaaucccuacaagaccugggcguaucacgggucuuacgaggucaaacccuccggaagcgccucuuccaugguuaacggcguggugcggcuucugaccaagccuugggacgucauccccauggugacacaaaucgcuaugacggacaccacaccuuuuggccagcagagaguuuucaaagagaagguggauacccggacaccgcgccccaagagagggaccgcccaaauuauggaagucacagcuaaauggcucuggggauuucugagccggaauaagaaaccucgcaucuguaccagagaggaguucacgcggaaggugcgcuccaacgccgcuauuggcgccguuuuuguggacgagaaucaguggaacagcgcgaaagaagccgucgaggaugagagauucugggaccuugugcaucgggaacgcgagcugcacaagcaggggaagugcgcuaccugcguuuauaauaugaugggaaaaagagaaaagaaacucggcgaguuugggaaggccaaaggcucucgggcuaucugguacauguggcugggagcccgcuuccuggaguucgaggcccucggcuuuaugaacgaggaucauugguucagcagagaaaauucccugucugggguggagggagaaggccuucacaagcugggguacauucuccgggacaucagcaagauccccggaggcaacauguaugcggaugacacagcugggugggauacccgcauuacagaggacgaucugcagaaugaggccaaaaucaccgacauuauggaaccugagcacgcccuucuggcuacguccaucuuuaagcucacauaccaaaacaaagucgugagaguccagcggcccgccaagucuggcaccgugauggauguuauuagcagacgcgaccagcggggauccggccagguggggacauauggacugaacaccuucacgaauauggaaguccaacugaucagacagauggagucugaaggcaucuuuagcccguccgagcucgagaacagcaaucuggcugaacgcgugcuugacuggcuggagaaacaugggguggaacggcucaagagaauggccauuucuggagaugacuguguugugaaaccuaccgaugaccgcuucgcgacagcccugaccgcucuuaacgauaugggcaagguccggaaggacaucccccagugggagccuuccaaaggguggaaugauuggcagcaagugcccuuuugcagccaccauuuccaccagcugauuaugaaggacggcagagaaaucguugugccuugucgcaaccaggaugagcucgucggacgggccagagugucucagggcgcuggguggucccugcgcgagacagccugccugggaaaaagcuacgcgcaaauguggcagcucauguauuuucaccggagagaccugcggcuugccgcuaaugccauuuguuccgcuguccccgugaacuggguuccgaccucuagaacaaccuggagcauccaugcccaccaucaguggaugacgacagaagauaugcuguccguguggaaucgcgucuggauugaggaaaacccuuggauggaggacaagacccacgugagcucuugggaagacguucccuaccucggcaaacgggaggaucaauggugcgggucccugaucggacuuaccgcuagagccacaugggcgaccaauauccagguggccauuaaccagguccgcagacugaucggcaaugagaacuaucucgacuacaugacaagcaugaagcgguucaagaaugaaucugaucccgagggggcucugugguga

SEQ ID NO: 19471 - RNA, 9879 nt, Artificial Sequence
  derived and/or modified CDS sequence (opt5) from DENV-1__KM403610__SS-prME
agcgugaccaugcugcucaugcugcuucccacagcucuggcuuuccaccucacgaccagaggcggggaaccucauaugaucgucuccaagcaggaacggggaaaaucucugcuuuuuaagacaagcgccggcguuaauaugugcacccugauugcgauggaccucggggaacugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguugcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaagaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacgauccacaccggcgaucagcaucaaguggggaaugagacaaccgaacacggaacaauugcuaccaucacgccccaggccccuaccuccgagauucagcugacagacuacggcgcccucacccuggacuguagcccccggacaggccuugauuucaacgaaaugguucugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaaguggucgugcucggaucucaagagggcgcuaugcacaccgcccugacaggggccacggaaauccagaccagcggaacaaccacaauuuuugcuggccaucuuaaaugcagacugaagauggacaaacucacccugaaggggguuuccuaugugauguguacgggcagcuucaaacuggagaaggaagucgccgagacacagcacggaaccgugcuuguucaggugaaguacgagggcaccgaugcgccgugcaaaaucccuaucucuacacaagacgaaaagggggucacccagaacggacggcucauuacagcuaaucccaucgugacggauaaagagaagccugugaacauugaaaccgagccgcccuucggcgaguccuauaucguuauuggggccggagaaaaagcccugaagcugagcugguuuaagaaaggcucuagcaucgggaagauguucgaggcuacagccagaggcgcucgccggauggccauccucggagacaccgcgugggauuuuggcuccauugggggagucuucacaucugugggcaaacuggugcaucaggucuuugggaccgccuacggagugcuuuucagcggcguuuccuggacgaugaagaucgggauuggcauccugcucaccuggcugggacugaauagcagaucuacaucccuuagcaugaccuguauugcugugggcauggucacacucuaccugggggugaugguucaggccgacucuggaugcgugaucaacuggaaaggccgcgaacugaaguguggguccggaauuuuugucaccaacgaggugcacacauggaccgaacaauauaaguuccaggcugauagcccuaaacggcucuccgccgcgaucggcaaggccugggaggaggggguuugcggcaucagaucugcuacgcgccuggaaaauauuauguggaaacagaucagcuccgagcuuaaccauauucugcucgaaaaugacaugaaguuuacaguggucgugggagacgccaacggcauccugacccaggggaaaaagaugauucggccgcaacccauggagcacaaauacucuuggaaaagcuggggaaaggcuaagaucaucggcgccgauacccagaauacaaccuucauuaucgacgggccugauacgcccgaauguccugacgaucagagagccuggaacauuugggagguggaggacuauggauuuggcgucuucacaaccaauaucuggcugaaacuucgcgauuccuacacacagaugugcgaccaccggcucaugagcgcugcgauuaaagauucuaaggccguucaugcugacaugggcuauuggaucgaauccgagaaaaacgaaaccuggaagcuggccagagccagcuuuaucgaggugaagacauguauuuggccccgcucucacacccugugguccaauggggugcucgaaagcgagaugaucauuccgaaaaucuacggaggcccuauuucucaacauaacuaucggcccggguacuucacgcagaccgcuggaccuuggcaccugggcaaacuugagcuggauuucaaucucugcgaagggacaaccgucgugguugacgagcacugcggaaacagaggccccagccugcggacaaccacggugacaggcaaaaucauccaugaaugguguugccgcuccuguacccugccuccccuuagauuuagaggggaagauggaugcugguacggcauggagauucggccggucaaggaaaaagaggaaaaucucgugcgcagcaugguuucugccggguccggagagguggacagcuucucccugggccugcucugugucucuaucaugauugaagaggugaugcggagcagaugguccaagaagaugcugaugacagggacccuugcggucuuuuuccugcucaucaugggacagcugaccuggaacgaccugauucgccuuugcaucauggugggcgcuaaugucucugauagaaugggcauggggacaacguaucuggcccucauggccaccuuuaaaaugcggccuauguucgcugugggacugcucuuucgcagacugacaagccgggaggugcuucugcucaccauuggccugucccuggucgccucuguugaacuucccaacagccuggaggaacucggggacggacuggcgaugggcaucaugaugcucaagcugcuuacagauuuccaaucccaccagcuguggaccacgcuccugagccugacauuuaucaaaaccacccuuucucuggacuacgcuuggaagacaauggccauggugcucuccauugugagccuguucccccucugucugucuaccacaucccagaaaacgaccuggcuuccuguccugcuggggagcuuuggaugcaagccgcucacaauguuccugaucaccgagaacaagauuuggggccgcaaaucuuggccccuuaaugaaggcaucauggccguggggauuguuuccauccugcucagcucccugcucaagaacgaugugccucuggcuggaccccuuaucgccggcgggaugcugauugcuuguuaugucaucagcggaucuagcgccgaccugucccucgagagagcggccgaggugucuugggaagaggaagcugagcauagcggcgccucccacaauauucugguugaagugcaggaugacgggacaaugaaaaucaaggaugaggagcgggacgauacccuuacgauucugcucaaagcuacccugcucgccgucucuggaguguacccuaugagcauccccgccacacuguuugucugguauuucuggcaaaagaaaaagcagcgcuccggcgugcuuugggacaccccuucucccccggaaguugagagagcugugcuggaugacggcaucuaccggauucugcagcgcgggcuccugggaagaagccaggucggcguggggguuuuccaagacggaguguuucauacaauguggcacgucacccggggcgcggugcuuauguaucaggggaagagacuggaaccuuccugggccagcgugaaaaaggaucucaucucuuacggaggcggcuggcgcuuccagggguccuggaacacaggagaggagguucaggucauugcuguggaacccggcaaaaauccuaagaacgugcaaacgacccccgggacauuuaaaaccccggagggagaagucggcgccaucgcccuggacuucaagccugggaccagcggaucucccauugugaaucgggagggcaagaucguuggccucuacgggaacggaguggucacaacguccggcaccuaugugagcgcuauugcccaggcgaaggcuucccaggaagggccucugcccgagaucgaggaugaaguuuuuaagaaaagaaaucuuacaaucauggaccugcaccccggaucuggcaagacccgccgguaccugccugccauugugagagaggccaucaaacgcaagcuccggacacugauucuugcuccgaccagagucguggccagcgaaauggcggaggcucugaaggggaugcccauccgcuaucaaacgacagccguuaaauccgaacauaccggcaaggagauuguggaucucaugugccacgccaccuucacaaugcggcugcugagcccugucagagugcccaacuacaauaugaucaucauggacgaggcucauuuuaccgauccugccucuauugcugcccggggauauaucuccacacgcgugggcaugggggaagcggccgcuauuuucaugaccgccacgcccccuggaagcgucgaggcuuuuccgcagucuaacgccguuauccaggacgaagagagagauauucccgaacggagcuggaacuccggcuacgacuggaucacagauuucccugggaaaaccgugugguuugugcccucuaucaagagcggaaacgacauugccaauugucuccgcaaaaacggcaagagagucauccagcuuucccggaagacauucgacaccgaguaucagaagacgaagaacaaugauugggacuacgugguuaccacagauauuucugagaugggggcuaacuucagagcggaccgcgugaucgauccucggagaugccugaaacccgucauucugaaggacggcccggaacgcgugauccucgccggaccuaugcccguuaccgcugccagcgccgcucagcggagaggccgcauugggcggaaucagaacaaagagggagaucaguacaucuauaugggccaaccccugaauaacgacgaagaucacgcccauuggacagaggcgaagaugcuucuggacaauaucaacaccccugaggggauuauccccgcucucuuugaaccugagagagaaaaguccgccgccauugauggagaguaccgccugagaggcgaagcucggaaaacauucguggagcugaugcgcagaggggaccucccggucuggcuuagcuauaagguggccucugagggcuuucaguacuccgaucggcgcuggugcuucgacggagaaagaaauaaccagguccuggaggaaaauauggacguggagaucuggaccaaagaaggcgagcggaagaaacugagaccccgcuggcucgaugcgcggacguauagcgacccucuggcccuuagagaguuuaaggaguucgcugccgggcgccgguccguuucuggagaucugauucucgagaucggcaaacugccccagcaccugacacucagagcucaaaacgcccuugacaaucuggugaugcugcacaacagcgaacaagggggaaaggcuuaccggcaugccauggaggaacucccugauaccaucgagacccugaugcuucuggcgcucauugccgugcugacaggcggcgucacccuguuuuuccucuccgggaagggacuuggcaaaacaucuaucgggcugcuguguguuauggcuagcuccgugcuccuguggauggccagcguggagccccacuggauugcugccucuaucauucuugaauuuuuccugaugguccuccugaucccggagccugaccgccagagaacgccccaggauaaucaacuggccuaugugguuaucggacuccuuuuuaugauucugaccguggcugcgaacgaaaugggccugcucgagacaaccaagaaagaccuggggaucggacaugucguggccgagaaccaccaccaugcuacaaugcuugauauugaccugcacccugccuccgccuggacccucuacgcugucgccacgaccaucauuacacccaugaugcggcauaccaucgaaaauacaaccgcgaacauuagccugacggccaucgcuaaucaggccgcuauccugaugggccucgauaagggcuggccuauuucuaaaauggacaucggggugccccuucuggcccugggaugcuacucccagguuaacccgcucacacugaccgcggccgugcuuaugcuggucgcucacuaugccauuaucggcccugggcuccaagcuaaggccacacgcgaggcucagaagagaaccgccgcgggaauuaugaaaaaucccaccguggauggcaucguugccaucgaccuggaccccguggucuacgaugcuaaguucgaaaaacagcuggggcagauuaugcuccuuauccuguguacaagccaaauucugcucaugcggacgaccugggcccugugcgagucuaucacacuugcuaccggaccucugacaacccucugggaaggcagcccgggcaaguuuuggaacacgacaauugccguguccauggccaauaucuuccgcgggucuuaucuggcgggagcuggccuggccuucagccucaugaaaucccuugggggaggcagacgggggaccggagcucagggcgagacccugggcgagaaguggaagcgccagcugaaccagcucagcaaauccgaauuuaauacauacaagagaucugggaucauggagguggaccggagcgaagccaaagagggacugaagagaggcgaaaccacaaaacaugccguuucccgcgggacggcuaaacuucggugguucgucgagagaaaccuggugaagcccgagggaaaagugauugaucucggcugugggcgcggaggcuggucuuauuacugcgccggccugaagaaagucaccgaaguuaagggguauacaaaaggaggcccugggcacgaggaacccaucccuauggcgaccuacggauggaauauugugaagcugcacagcggccgggacguguuuuucacacccccugagaaaugugauacccuccuuugcgacaucggggaauccucuccgaaccccacgauugaggagggaagaacccugcgcguccugaagaugguggaaccuuggcuccggggcaaucaauuuuguaucaagauucugaaccccuacaugccuagcguuguggagacacuugaacagaugcagagaaaacauggcgggaugcugguccgcaauccccucucccggaacagcacccacgagauguauugggugucuugcggaacaggcaauaucguuuccgccgugaacaugaccagcagaaugcugcugaaccgcuucacaauggcucaucggaagccgaccuacgagagagaugucgaccucggggccggaacgcgccacguggcuguggaaccugagaucgccaaucuggauauuaucggccagagaauugaaaacaucaaaaaugagcacaagucuacauggcauuaugacgaagauaaccccuacaaaaccugggcguaucacggguccuacgaggucaagcccagcggaucugccuccagcaugguuaauggcguggugcggcuucugaccaagccuugggacgucauucccauggugacacaaaucgcuaugacggacaccacaccuuuuggccagcagcgcguuuucaaagagaagguggauaccagaacaccgcggcccaaaagagggaccgcccaaaucauggaagucacagcuaaguggcucuggggauuucugucccggaacaaaaagccucgcauuuguaccagagaggaguucacgcggaaggugcgcagcaaugccgcuaucggcgccguuuuuguggacgagaaccaguggaacucugcgaaagaagccgucgaggaugagagauucugggaccuugugcaucgggaacgcgagcugcacaagcaggggaaaugcgcuaccugcguuuauaacaugaugggaaagagagagaagaagcucggcgaguuugggaaggccaaaggcagccgggcuauuugguacauguggcugggagcccgcuuccuggaguucgaggcccucggcuuuaugaaugaggaucauugguucuccagagaaaacucucugagcgggguggagggagaaggccuucacaagcugggguacauccuccgggacauuuccaaaauccccggaggcaauauguaugcggaugacacagcugggugggauacccgcaucacagaggacgaucugcagaacgaggccaagauuaccgacaucauggaaccugagcacgcccuucuggcuacgucuauuuuuaaacucacauaccaaaauaaggucgugagaguccagcggcccgccaaaagcggcaccgugauggauguuaucucccgcagagaccagcggggaucuggccagguggggacauauggacugaacaccuucacgaacauggaaguccaacugauuagacagauggagagcgaaggcaucuuucucccguccgagcuggagaauagcaaccuugcugaacgcgugcuggacuggcucgagaagcaugggguggaacggcugaagagaauggccaucucuggagaugacuguguugugaaaccuaccgaugaccgcuucgcgacagcccuuaccgcucugaaugauaugggcaagguccggaaagacauuccccagugggagccuuccaagggguggaacgauuggcagcaagugcccuuuugcagccaccauuuccaccagcucaucaugaaagacggcagagaaauuguugugccuugucgcaaucaggaugagcuggucggacgggccagagugucucagggcgcuggguggucccugcgcgagacagccugccucggaaagagcuacgcgcaaauguggcagcugauguauuuucaccggagagaccuucgccuggccgcuaacgccaucuguuccgcuguccccgugaauuggguuccgaccucucggacaaccuggagcauucaugcccaccaucaguggaugacgacagaagauaugcucuccguguggaacagagucuggaucgaggaaaauccuuggauggaggacaagacccacgugagcucuugggaagacguucccuaccugggcaaacgggaggaucaauggugcgggucccuuauuggacugaccgcuagagccacaugggcgaccaacauccagguggccaucaaucagguccgccggcucauuggcaacgagaauuaucuggacuacaugacaagcaugaagagauucaaaaacgaaucugaucccgagggggcucugugguga

SEQ ID NO: 19472 - RNA, 9879 nt, Artificial Sequence
  derived and/or modified CDS sequence (opt5) from DENV-1__KM403596__SS-prME
agcgugaccaugcugcugaugcugcuucccacagcucuggcuuuccaccucacgaccagaggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccccgcaucacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucagccuggacuguucucccagaaccggccuugauuucaacgaaauggugcugcucacaaugaaggagaaauccuggcugguccauaagcagugguuucuugaccugccucuccccuggaccagcggggcuuccacgucucaagagacauggaaucggcaggaucugcuggugaccuucaaaacagcgcacgccaagaaacaggaagucgugguucucggaagccaagagggcgcuaugcacaccgcccugaccggggccacagaaauucagacguccggaaccacaaccaucuuugcuggccaucuuaagugcagacugaagauggacaaacucacacugaagggggugagcuaugucauguguaccggcucuuucaaacuggagaaggaaguggccgagacgcagcacggaacaguucuugugcaggucaaauacgagggcaccgaugcgccgugcaagauuccuaucuccacccaagacgaaaagggggugacacagaacggacgccucaucaccgcuaaucccauugugacagauaaagagaagccuguuaacaucgaaauugagccgcccuucggcgagagcuauaucgucauuggggccggagaaaaagcccugaagcugucuugguuuaaaaagggcagcuccaucgggaagauguucgaggcuacggcccggggcgcuagacgcauggccauccucggagacaccgcgugggauuuuggcucuauugggggaguguucacaagcgugggcaaacugguccaucagguguuugggaccgccuacggaguucuuuucuccggcgugagcuggacaaugaagaucgggauuggcauccugcucaccuggcugggacucaauucucgguccacgagccuuucuaugaccuguauugcugucggcauggugacacucuaccuggggguuauggugcaggccgacuccggaugcgucaucaacuggaaaggcagagaacugaagugugggagcggaauuuuugugaccaacgagguucacacauggaccgaacaauauaaauuccaggcugauuccccuaagcgccucucugccgcgaucggcaaggccugggaggagggggugugcggcauccggagcgcuacaagacuggaaaauauuauguggaaacagaucuccaacgagcuuaaucauauucugcucgaaaacgacaugaaguuuaccgucguggugggagacgccaauggcauccugacgcaggggaaaaagaugauucgcccgcaacccauggagcacaaauacucuuggaaaagcuggggaaaagcuaagaucaucggcgccgauacacagaacaccaccuucauuaucgacgggccugauacacccgaauguccugacgaucagcgggccuggaauauuugggaggucgaggacuauggauuuggcguuuucaccacgaacaucuggcugaaacuuagagauuccuacacacagaugugcgaccaccgccucaugagcgcugcgauuaaagauucuaaggccgugcaugcugacaugggcuauuggaucgaauccgagaaaaaugaaaccuggaagcuggcccgggccagcuuuaucgaggugaaaacauguauuuggcccagaucucacacccugugguccaacgggguccucgaaagcgagaugaucauuccgaagaucuacggaggcccuauuucucaacauaauuaucggcccggguacuucacacagaccgcuggaccuuggcaccugggcaaacuugagcuggauuucaaccucugcgaagggacgaccgugguuguggacgagcacugcggaaaucgcggccccagccugagaacaaccacagucaccggcaaaaucauccaugaaugguguugccgguccuguacgcugccuccccuuagauuucgcggggaggauggaugcugguacggcauggagauucggccggugaaggaaaaagaggaaaaccucguuagaagcauggugucugccggguccggagaggucgacagcuucucccugggccugcucugugugucuaucaugauugaagagguuaugcgcagcagauggucccggaagaugcugaugacagggacccuugcgaucuuuuuccugcucauuaugggacagcugacauggaaugaccugauccgccuuugcauuauggugggcgcuaacgucucugauagaaugggcauggggaccaccuaucuggcccucauggccacauuuaaaaugcggccuauguucgcugugggacugcucuuucgcagacugacgagccgggaggugcuucugcucaccaucggccugucccuggucgccucuguugaacuucccaacagccuggaggaacucggggacggacuggcgaugggcaucaugaugcucaagcugcuuacagauuuccaaucccaccagcuguggaccacacuccugagccugaccuuuauuaagacgacacuuucucuggacuacgcuuggaaaaccauggccauggugcucuccaucgugagccuguucccccucugucugucuaccacaucccagaagaccacauggcuuccuguccugcuggggagcuuuggaugcaaaccgcucacgauguuccugauuaccgagaauaagaucuggggccgcaaaucuuggccccuuaacgaaggcauuauggccguggggaucguuuccauccugcucagcucccugcucaagaaugaugugccucuggcuggaccccuuauugccggcgggaugcugaucgcuuguuaugucauuagcggaucuagcgccgaccugucccucgagagagcggccgaggugucuugggaagaggaagcugagcauagcggcgccucccacaacauccugguugaagugcaggaugacgggacaaugaagauuaaagaugaggagcgggacgauacccuuacaauccugcucaaggcuacccugcucgccgucucuggaguguacccuaugagcauccccgccacgcuguuugucugguauuucuggcagaagaagaaacagcgcuccggcgugcuuugggacaccccuucucccccggaaguugagagagcugugcuggaugacggcauuuaccggauccugcagagagggcuccugggacgcagccaggucggcguggggguuuuccaagacggaguguuucauacaauguggcacgucacccggggcgcggugcuuauguaucaggggaagagacuggaaccuuccugggccagcgugaaaaaggaucucauuucuuacggaggcggcuggcgcuuccagggguccuggaauacaggagaggagguucaggucaucgcuguggaacccggcaagaacccuaaaaaugugcaaaccacacccgggacguuuaagaccccggagggagaagucggcgccauugcccuggacuucaaaccugggacaagcggaucucccaucgugaaccgggagggcaagauuguuggccucuacgggaauggaguggucaccaccuccggcacauaugugagcgcuaucgcccaggcgaaggcuucccaggaagggccucugcccgagaucgaggaugaaguuuuuaagaagagaaaccuuacgauuauggaccugcaccccggaucuggcaaaacccgccgguaccugccugccaucgugagagaggccauuaagcgcaaacuccggacacugauccuugcuccgaccagagucguggccagcgaaauggcggaggcucugaaggggaugcccauucgguaucaaacaaccgccguuaaauccgaacauacgggcaaggagaucguggaucucaugugccacgccacauucaccaugcgccugcugagcccugucagagugcccaauuacaacaugaucauuauggacgaggcucauuuuaccgauccugccucuaucgcugcccggggauauauuuccacacgcgugggcaugggggaagcggccgcuaucuucaugaccgccacacccccuggaagcgucgaggcuuuuccgcagucuaaugccguuauucaggacgaagagagagauauccccgaacggagcuggaacuccggcuacgacuggaucaccgauuucccugggaagacggugugguuugugcccucuauuaaaagcggaaaugacaucgccaacugucucagaaagaacggcaaacgcgucauucagcuuucccggaagacauucgacaccgaguaucagaaaaccaagaauaacgauugggacuacgugguuaccacggauaucucugagaugggggcuaauuucagagcggaccgcgugauugauccucggagaugccugaagcccgucauccugaaagacggcccggaacgcgugauucucgccggaccuaugcccguuaccgcugccagcgccgcucagcggagaggccgcaucgggagaaaccagaauaaggagggagaucaguacaucuauaugggccaaccccugaacaaugacgaagaucacgcccauuggacagaggcgaaaaugcuucuggacaacauuaauaccccugaggggaucauucccgcucucuuugaaccugagcgggaaaaguccgccgccaucgauggagaguaccgccugagaggcgaagcucggaaaacauucguggagcugaugcgcagaggggaccucccggucuggcuuagcuauaagguggccucugagggcuuucaguacuccgaucggagauggugcuucgacggagaacgcaacaaucagguccuggaggaaaacauggacguggagauuuggaccaaggaaggcgagcggaaaaagcugagaccccgcuggcucgaugcgcggacauauagcgacccucuggcccuuagagaguuuaaagaguucgcugccgggcggcgcuccguuucuggagaucugauccucgagaucggcaagcugccccagcaccugacccucagagcucaaaaugcccuugacaaccuggugaugcugcacaauagcgaacaagggggaaaggcuuaccggcaugccauggaggaacucccugauacgauugagacacugaugcuucuggcgcucaucgccgugcugaccggcggcgucacccuguuuuuccucuccgggaagggacuuggcaaaacaucuauugggcugcuguguguuauggcuagcuccgugcuccuguggauggccagcguggagccccacuggaucgcugccucuauuauccuugaauuuuuccugaugguccuccugaucccggagccugaccgccagagaacaccccaggauaaccaacuggccuaugugguuauuggacuccuuuuuaugauccugacaguggcugcgaacgaaaugggccugcucgagacgaccaagaaggaccuggggauuggacaugucguggccgagaaucaccaccaugcuacaaugcuugauaucgaccugcacccugccuccgccuggacccucuacgcugucgccacaaccauuaucacgcccaugaugcggcauaccauugaaaacacaaccgcgaauaucagccugacagccaucgcuaaccaggccgcuauucugaugggccucgauaaaggcuggccuaucucuaagauggacauuggggugccccuucuggcccugggaugcuacucccagguuaauccgcucacccugacggcggccgugcuuaugcuggucgcucacuaugccaucauuggcccugggcuccaagcuaaagccacacgcgaggcucagaagagaaccgccgcgggaaucaugaaaaaccccacaguggauggcaucguugccauugaccuggaccccguggucuacgaugcuaaguucgaaaagcagcuggggcagaucaugcuccuuauucuguguaccagccaaauccugcucaugcggaccacaugggcccugugcgagucuauuacgcuugcuaccggaccucugacaacccucugggaaggcagcccgggcaaauuuuggaauacaaccaucgccguguccauggccaacaucuuccgcgggucuuaucuggcgggagcuggccuggccuucagccucaugaagucccuugggggaggcagacgggggacgggagcucagggcgagacacugggcgagaaauggaagagacagcugaaucagcucagcaaauccgaauuuaacaccuacaagcgcucugggauuauggagguggaccggagcgaagccaaggagggacugaaaagaggcgaaaccacaaagcaugccguuucccgcgggaccgcuaaacuucggugguucgucgagagaaaucuggugaagcccgagggaaaagugaucgaucucggcugugggcgcggaggcuggucuuauuacugcgccggccugaagaaggucacagaaguuaaaggguauacgaagggaggcccugggcacgaggaacccauuccuauggcgaccuacggauggaacaucgugaaacugcacagcggccgggacguguuuuucacacccccugagaagugugauacccuccuuugcgacauuggggaauccucuccgaaucccacaaucgaggagggaagaacccugcgcguccugaaaaugguggaaccuuggcuccggggcaaccaauuuuguauuaagauccugaaucccuacaugccuagcguuguggagacgcuugaacagaugcagagaaaacauggcgggaugcugguccgcaacccccucucccggaauagcacccacgagauguauugggugucuugcggaacaggcaacaucguuuccgccgugaacaugaccagcagaaugcugcugaaucgcuucacaauggcucauagaaagccgaccuacgagcgggaugucgaccucggggccggaacacgccacguggcuguggaaccugagaccgccaaccuggauauuaucggccagagaauugaaaauaucaagaacgagcacaaaucuacguggcauuaugacgaagauaaucccuacaagacaugggcguaucacggguccuacgaggucaaacccagcggaucugccuccagcaugguuaacggcguggugcggcuucugaccaagccuugggacgucauucccauggugacccaaaucgcuaugacagacacgaccccuuuuggccagcagagaguuuucaaagagaagguggauacacggaccccgcgccccaagagagggacagcccaaaucauggaagucaccgcuaaauggcucuggggauuucugucccggaauaagaaaccucgcauuuguacaagagaggaguucacccggaaggugcgcagcaacgccgcuaucggcgccguuuuuguggacgagaaucaguggaacucugcgaaagaagccgucgaggaugagagauucugggaccuugugcaucgggaacgcgagcugcacaagcaggggaagugcgcuacgugcguuuauaauaugaugggaaaaagagaaaagaaacucggcgaguuugggaaggccaaaggcagccgggcuauuugguacauguggcugggagcccgcuuccuggaguucgaggcccucggcuuuaugaacgaggaucauugguucuccagagaaaauucucugagcgggguggagggagaaggccuucacaagcugggguacauccuccgggacauuuccaagauccccggaggcaacauguaugcggaugacaccgcugggugggauacacgcaucaccgaggacgaucugcagaaugaggccaaaauuacagacaucauggaaccugagcacgcccuucuggcuaccucuauuuuuaagcucacguaccaaaacaaagucgugagaguccagcggcccgccaagagcggcacagugauggauguuaucuccagacgcgaccagcggggaucuggccagguggggaccuauggacugaacacauucaccaauauggaaguccaacugauuagacagauggagagcgaaggcaucuuuuccccgagcgagcucgagaacucuaaucuggcugaacgcgugcuugacuggcuggagaaacaugggguggaacggcucaagagaauggccaucuccggagaugacuguguugugaaaccuacggaugaccgcuucgcgaccgcccugacagcucuuaacgauaugggcaagguccggaaggacauuccccagugggagccuagcaaaggguggaaugauuggcagcaagugcccuuuugcucucaccauuuccaccagcugaucaugaaggacggcagagaaauuguugugccuugucgcaaccaggaugagcucgucggacgggccagagugucccagggcgcuggguggagccugcgcgagaccgccugccugggaaaauccuacgcgcaaauguggcagcucauguauuuucaccggagagaccugcggcuugccgcuaaugccaucuguucugcuguccccgugaacuggguuccgacaagcagaaccacaugguccauucaugcccaccaucaguggaugaccacggaagauaugcugagcguguggaaucgcgucuggaucgaggaaaacccuuggauggaggacaagacacacgugucuuccugggaagacguucccuaccucggcaaacgggaggaucaauggugcgggagccugauuggacuuaccgcuagagccaccugggcgacaaauauccagguggccaucaaccagguccgcagacugauuggcaaugagaacuaucucgacuacaugaccucuaugaagcgguucaagaaugaaagcgaucccgagggggcucugugguga

SEQ ID NO: 19473 - RNA, 9879 nt, Artificial Sequence
  derived and/or modified CDS sequence (opt5) from DENV-1__KM403616__SS-prME
agcgugaccaugcugcucaugcugcuucccacagcucuggcuuuccaccucacgacccggggcggggagccucauaugaucgucuccaagcaggaacggggaaagucucugcuuuuuaagacaagcgcuggcguuaacaugugcacccugauugcgauggaccucggggagcugugugaagauacaaugaccuacaaaugcccgcgcaucacagaggcugaacccgacgauguggacuguuggugcaaugcuaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucuguggucgugacgguucacaccggcgaucagcaucaaguggggaaugagacaaccgaacacggaacaaucgcuaccaucacgccccaggccccuaccuccgagauucagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaagugguugugcucggaucucaagagggcgcuaugcacaccgcccugacaggggccacggaaauccagaccagcggaacaaccacaauuuuugcuggccaucuuaaaugcagacugaagauggacaaacucacccugaagggggucuccuaugugauguguacgggcagcuucaaacuggagaaggaaguugccgagacacagcacggaaccgugcuuguccaggugaaguacgagggcaccgaugcgccgugcaaaaucccuauuucuacacaagacgaaaagggggugacccagaacggacggcucaucacagcuaaucccaucguuacggauaaagagaagccugucaacauugaaaccgagccgcccuucggcgaguccuauaucgugauuggggccggagaaaaagcccugaagcugagcugguuuaagaaaggcucuagcaucgggaagauguucgaggcuacagccagaggcgcucgccggauggccauucucggagacaccgcgugggauuuuggcuccaucgggggaguguucacaucugucggcaaacuggugcaucagguuuuugggaccgccuacggagugcuuuucagcggcgucuccuggacgaugaagaucgggauuggcauccugcucaccuggcugggacugaauagcagaucuacaucccuuagcaugaccuguauugcugugggcaugguuacacucuaccugggggugaugguccaggccgacucuggaugcgugaucaacuggaaaggccgcgaacugaaguguggguccggaauuuuuguuaccaacgaggugcacacauggaccgaacaauauaaguuccaggcugauagcccuaaacggcucuccgccgcgaucggcaaggccugggaggagggggucugcggcauuagaucugcuacgcgccuggaaaauaucauguggaaacagaucagcaacgagcuuaaucauauucugcucgaaaacgacaugaaguuuacagugguggucggagacgccaauggcauccugacccaggggaaaaagaugauucggccgcaacccauggagcacaaauacuccuggaagucuuggggaaaggcuaaaaucauuggcgccgauacccagaacacaaccuucaucaucgacgggccugauacgcccgaauguccugacgaucagagagccuggaauauuugggagguugaggacuauggauuuggcguguucacaaccaacaucuggcugaaacuucgcgauagcuacacacagaugugcgaccaccggcucauguccgcugcgauuaaagauagcaaggccgugcaugcugacaugggcuauuggaucgaaucugagaaaaaugaaaccuggaagcuggccagagccuccuuuauugaggucaagacauguaucuggccccgcagccacacccuguggucuaacggggugcucgaauccgagaugaucauuccgaaaaucuacggaggcccuauuagccaacauaauuaucggcccggguacuucacgcagaccgcuggaccuuggcaccugggcaaacuugagcuggauuucaaccucugcgaagggacaaccguuguggucgacgagcacugcggaaauagaggccccucucugcggacaaccacggugacaggcaaaaucauucaugaaugguguugccgcagcuguacccugccuccccuuagauuuagaggggaagauggaugcugguacggcauggagaucagaccgguuaaggaaaaagaggaaaaccucgugcgcuccauggucagcgccgggucuggagagguggacuccuucagccugggccugcucuguguuuccaucaugauugaagaggugaugcggucuagauggagccgcaagaugcugaugacagggacccuugcggccuuuuuccugcucaucaugggacagcugaccuggaaugaccugauuagacuuugcaucauggucggcgccaacguguccgaucggaugggcauggggacaacguaucuggcccucauggcuaccuuuaagaugcgcccuauguucgccgugggacugcucuuuagacggcugacaucucgcgagguccuucugcucaccauuggccugagccugguugcguccguggaacuucccaacucucuggaggaacucggggacggacuggcuaugggcaucaugaugcucaaacugcuuacagauuuccaaagccaccagcuguggaccacgcuccugucccugacauuuauuaagaccacccuuagccuggacuacgccuggaaaacaauggccauggugcucucuaucgucucccuguucccccucugucugagcaccacaucucagaagacgaccuggcuuccugugcugcugggguccuuuggaugcaaaccgcucacaauguuccugaucaccgagaauaagauuuggggcagaaagagcuggccccuuaacgaaggcaucauggcuguugggauugugucuauccugcucuccagccugcucaaaaaugaugucccucuggccggaccccuuauugcuggcgggaugcugaucgccuguuaugugaucuccggaagcucugcggaccugagccucgagcgggccgcugagguuuccugggaagaggaagccgagcauucuggcgcuagccacaacauucugguggaaguccaggaugacgggacaaugaagaucaaagaugaggagcgcgacgauacccuuacgauucugcucaaggccacccugcucgccguguccggagucuacccuaugucuauccccgcuacacuguuugugugguauuucuggcagaagaagaaacagagaagcggcguucuuugggacaccccuagcccucccgaaguggagcgggcgguccuggaugacggcauuuaccgcauccugcagagagggcuccugggacggucucaggugggcguugggguguuccaagacggagucuuucauacaauguggcacgugaccagaggcgccgugcuuauguaucaggggaagcgccuggaacccagcugggcuuccguuaagaaagaucucaucagcuacggaggcggcuggcgguuccaggggucuuggaauacaggagaggagguccaggugauugccguggaacccggcaagaacccuaaaaauguccaaacgacccccgggacauuuaagaccccggagggagaagugggcgccaucgcucuggacuucaaaccugggaccuccggaagccccauuguuaacagagagggcaagaucgugggccucuacgggaauggagucgugacaacgucuggcaccuauguuuccgccauugcgcaggcuaaggccagccaggaagggccucugcccgagaucgaggaugaaguguuuaaaaagcgcaaccuuacaauuauggaccugcaccccggauccggcaaaacccggagauaccugccugccaucguccgcgaggcuaucaagcggaaacucagaacacugauucuugccccgacccgcgugguugcgucugaaauggcugaggcccugaaggggaugcccauccgguaucaaacgacagccgugaaguccgaacauaccggcaaagagauugucgaucucaugugccacgcuaccuucacaaugagacugcuguccccugugcgggugcccaauuacaacaugaucauuauggacgaggcccauuuuaccgauccugcuagcaucgccgcgcgcggauauaucucuacaagagucggcaugggggaagccgcugccauuuucaugaccgcuacgcccccuggauccguugaggccuuuccgcagagcaaugccgugauccaggacgaagaacgggauauucccgaacgcucuuggaacagcggcuacgacuggaucacagauuucccugggaagaccgugugguuuguccccuccauuaaaucuggaaaugacaucgcuaacugucucagaaagaacggcaaacgggugauccagcuuagcagaaagacauucgacaccgaguaucaaaagacgaaaaauaacgauugggacuacguugugaccacagauauuuccgagaugggggcgaauuuccgcgccgaccgggucaucgauccuagacgcugccugaagcccgugauucugaaagacggcccggaacggguuauccucgcuggaccuaugcccgugaccgccgccucugcugcccagagacgcggccggauugggagaaaccagaauaaggagggagaucaguacaucuauaugggccaaccccugaacaaugacgaagaucacgcgcauuggacagaggcuaaaaugcuucuggacaacauuaauaccccugaggggaucauccccgcccucuuugaaccugagcgcgaaaagagcgccgcuauugauggagaguacagacugcggggcgaagcccgcaagacauucgucgagcugaugagaagaggggaccucccgguguggcuuuccuauaaagucgcgagcgagggcuuucaguacucugaucgcagauggugcuucgacggagaacggaacaaucaggugcuggaggaaaacauggacguugagaucuggaccaaggaaggcgagcgcaagaagcugcgcccccgguggcucgaugccagaacguauuccgacccucuggcccuucgcgaguuuaaagaguucgccgcugggcggagaagcguguccggagaucugauucucgagaucggcaagcugccccagcaccugacacuccgggcccaaaaugcucuugacaaccuggugaugcugcacaauucugaacaagggggaaaagccuaccgccaugcgauggaggaacucccugauaccauugagacccugaugcuucuggcccucaucgcuguccugacaggcggcguuacccuguuuuuccucagcgggaagggacuuggcaagacauccaucgggcugcugugugugauggccucuagcgugcuccuguggauggcuuccgucgagccccacuggauugccgccagcaucauucuugaauuuuuccugauggugcuccugaucccggagccugacagacagcggacgccccaggauaaccaacuggcuuauguugugauuggacuccuuuuuaugauccugaccgucgcggccaacgaaaugggccugcucgagacaaccaaaaaggaccuggggaucggacauguggucgcugagaaucaccaccaugccacaaugcuugauauugaccugcacccugccucugcuuggacccucuacgccguggcgacgaccaucauuacacccaugaugcgccauaccaucgaaaacacaaccgccaauauuucccugacggcuaucgccaaccaggcugccauucugaugggccucgauaaaggcuggccuaucagcaagauggacaucgggguuccccuucuggcgcugggaugcuacucucaggugaauccgcucacacugaccgccgcuguccuuaugcugguggcccacuaugcuauuaucggcccugggcuccaagccaaagcuacaagagaggcccagaagcggaccgcggccggaauuaugaagaaccccaccguugauggcaucguggcuauugaccuggaccccgucguguacgaugccaaauucgaaaagcagcuggggcagaucaugcuccuuauccuguguacaucccaaauucugcucaugcgcacgaccugggcucugugcgagagcaucacacuugccaccggaccucugacaacccucugggaaggcucuccgggcaaauuuuggaauacgacaauugccgugagcauggcgaacaucuucagaggguccuaucuggcuggagccggccuggcuuucucucucaugaaaagccuugggggaggccggcgcgggaccggagcccagggcgagacccugggcgagaaauggaagagacagcugaaucagcucuccaagagcgaauuuaacacauacaaacgguccgggauuauggagguugacagaucugaagccaaggagggacugaaacgcggcgaaaccacaaagcaugcugucagccgggggacggccaaacuuagaugguucguggagcgcaaucuggugaagcccgagggaaaggucaucgaucucggcugugggcggggaggcugguccuauuacugcgcgggccugaaaaagguuaccgaagugaaaggguauacaaagggaggcccugggcacgaggaacccaucccuauggccaccuacggauggaacauugugaaacugcacucuggcagagacgucuuuuucacacccccugagaagugugauacccuccuuugcgacaucggggaaagcuccccgaaucccacgauugaggagggacgcacccugcgggugcugaaaaugguugaaccuuggcucagaggcaaccaauuuuguaucaagauucugaaucccuacaugccuucuguggucgagacacuugaacagaugcagcgcaagcauggcgggaugcuggugcggaacccccucagcagaaauuccacccacgagauguauuggguuagcugcggaacaggcaacaucgugucugcugucaacaugaccucccgcaugcugcugaaucgguucacaauggcccauagaaaaccgaccuacgagcgcgauguggaccucggggcuggaacgagacacguggccgucgaaccugagauugcgaaccuggauaucaucggccagcggauugaaaauaucaagaacgagcacaaaagcacauggcauuaugacgaagauaaucccuacaagaccugggccuaucacgggucuuacgagguuaaacccuccggaagcgcuucuuccauggugaacggcgugguccgccuucugaccaagccuugggacgugauucccaugguuacacaaaucgccaugacggacaccacaccuuuuggccagcagagaguguucaaggagaaagucgauacccggacaccgagacccaagcgggggaccgcucaaauuauggaagugacagccaaauggcucuggggauuucugagccgcaauaagaaaccuagaaucuguacccgggaggaguucacgcgcaagguuagauccaacgcugccaucggcgcgguguuugucgacgagaaucaguggaacagcgccaaggaagcuguggaggaugagcgguucugggaccuuguucaucgcgaaagagagcugcacaaacaggggaagugcgcuaccugcguguauaauaugaugggaaaacgggaaaagaaacucggcgaguuugggaaggccaagggcucucgcgccauuugguacauguggcugggagccagauuccuggaguucgaggcgcucggcuuuaugaacgaggaucauugguucagccgggaaaauucccugucuggggucgagggagaaggccuucacaaacugggguacauccuccgcgacauuagcaagauccccggaggcaacauguaugcugaugacacagccgggugggauaccagaauuacagaggacgaucugcagaaugaggccaaaaucaccgacaucauggaaccugagcacgcccuucuggccacguccauuuuuaagcucacauaccaaaacaaagugguccgggugcagcgccccgcuaagucuggcaccguuauggaugugaucagcagacgggaccagagaggauccggccaggucgggacauauggacugaacaccuucacgaauauggaagugcaacugauucgccagauggagucugaaggcaucuuuagcccguccgagcucgagaacagcaaucuggccgaacgggugcuugacuggcuggagaaacaugggguugaaagacucaagcgcauggcgauuucuggagaugacuguguggucaagccuaccgaugaccgguucgccacagcucugaccgcccuuaacgauaugggcaaagugagaaaggacaucccccagugggagccuuccaaaggguggaaugauuggcagcaaguucccuuuugcagccaccauuuccaccagcugaucaugaaggacggccgcgaaauuguggucccuugucggaaccaggaugagcucgugggacgggcucgcgucucucagggcgccggguggucccugcgggagacagcgugccugggaaaaagcuacgcccaaauguggcagcucauguauuuucacagacgcgaccugcggcuugcugccaaugcuaucuguuccgccgugcccguuaacugggugccgaccucuagaacaaccuggagcauucaugcucaccaucaguggaugacgacagaagauaugcuguccgucuggaaucggguguggaucgaggaaaacccuuggauggaggacaagacccacguuagcucuugggaagacgugcccuaccucggcaagagagaggaucaauggugcgggucccugauuggacuuaccgcccgcgcgacaugggccaccaauauccaggucgcuauuaaccaggugcggagacugaucggcaaugagaacuaucucgacuacaugacaagcaugaaacgcuucaagaaugaaucugaucccgagggggcccugugguga

SEQ ID NO: 19474 - RNA, 9879 nt, Artificial Sequence
  derived and/or modified CDS sequence (opt5) from DENV-1__KM403617__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucuguggucgugacgguucacaccggcgaucagcaucaaguggggaaugagacaaccgaacacggaacaaucgcuaccaucacgccccaggccccuaccuccgagauucagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaagugguugugcucggaucucaagagggcgcuaugcacaccgcccugacaggggccacggaaauccagaccagcggaacaaccacaauuuuugcuggccaucuuaaaugcagacugaagauggacaaacucacccugaagggggucuccuaugugauguguacgggcagcuucaaacuggagaaggaaguugccgagacacagcacggaaccgugcuuguccaggugaaguacgagggcaccgaugcgccgugcaaaaucccuauuucuacacaagacgaaaagggggugacccagaacggacggcucaucacagcuaaucccaucguuacggauaaagagaagccugucaacauugaaaccgagccgcccuucggcgaguccuauaucgugauuggggccggagaaaaagcccugaagcugagcugguuuaagaaaggcucuagcaucgggaagauguucgaggcuacagccagaggcgcucgccggauggccauucucggagacaccgcgugggauuuuggcuccaucgggggaguguucacaucugucggcaaacuggugcaucagguuuuugggaccgccuacggagugcuuuucagcggcgucuccuggacgaugaagaucgggauuggcauccugcucaccuggcugggacugaauagcagaucuacaucccuuagcaugaccuguauugcugugggcaugguuacacucuaccugggggugaugguccaggccgacucuggaugcgugaucaacuggaaaggccgcgaacugaaguguggguccggaauuuuuguuaccaacgaggugcacacauggaccgaacaauauaaguuccaggcugauagcccuaaacggcucuccgccgcgaucggcaaggccugggaggagggggucugcggcauuagaucugcuacgcgccuggaaaauaucauguggaaacagaucagcaacgagcuuaaucauauucugcucgaaaacgacaugaaguuuacagugguggucggagacgccaauggcauccugacccaggggaaaaagaugauucggccgcaacccauggagcacaaauacuccuggaagucuuggggaaaggcuaaaaucauuggcgccgauacccagaacacaaccuucaucaucgacgggccugauacgcccgaauguccugacgaucagagagccuggaauauuugggagguugaggacuauggauuuggcguguucacaaccaacaucuggcugaaacuucgcgauagcuacacacagaugugcgaccaccggcucauguccgcugcgauuaaagauagcaaggccgugcaugcugacaugggcuauuggaucgaaucugagaaaaaugaaaccuggaagcuggccagagccuccuuuauugaggucaagacauguaucuggccccgcagccacacccuguggucuaacggggugcucgaauccgagaugaucauuccgaaaaucuacggaggcccuauuagccaacauaauuaucggcccggguacuucacgcagaccgcuggaccuuggcaccugggcaaacuugagcuggauuucaaccucugcgaagggacaaccguuguggucgacgagcacugcggaaauagaggccccucucugcggacaaccacggugacaggcaaaaucauucaugaaugguguugccgcagcuguacccugccuccccuuagauuuagaggggaagauggaugcugguacggcauggagaucagaccgguuaaggaaaaagaggaaaaccucgugcgcuccauggucagcgccgggucuggagagguggacuccuucagccugggccugcucuguguuuccaucaugauugaagaggugaugcggucuagauggagccgcaagaugcugaugacagggacccuugcggucuuuuuccugcucaucaugggacagcugaccuggaaugaccugauuagacuuugcaucauggugggcgcuaacguguccgaucggaugggcauggggacaacguaucuggcccucauggccaccuuuaagaugcgcccuauguucgcugucggacugcucuuuagacggcugacaucucgcgagguucuucugcucaccauuggccugagccugguggccuccguggaacuucccaacucucuggaggaacucggggacggacuggcgaugggcaucaugaugcucaaacugcuuacagauuuccaaagccaccagcuguggaccacgcuccugucccugacauuuauuaagaccacccuuagccuggacuacgcuuggaaaacaauggccaugguccucucuaucgugucccuguucccccucugucugagcaccacaucucagaagacgaccuggcuuccuguucugcugggguccuuuggaugcaaaccgcucacaauguuccugaucaccgagaauaagauuuggggcagaaagagcuggccccuuaacgaaggcaucauggccguggggauugucucuauccugcucuccagccugcucaaaaaugaugugccucuggcuggaccccuuauugccggcgggaugcugaucgcuuguuauguuaucuccggaagcucugccgaccugagccucgagcgggcggccgagguguccugggaagaggaagcugagcauucuggcgccagccacaacauucuggucgaagugcaggaugacgggacaaugaagaucaaagaugaggagcgcgacgauacccuuacgauucugcucaaggcuacccugcucgccgucuccggaguguacccuaugucuauccccgccacacuguuuguuugguauuucuggcagaagaagaaacagagaagcggcgugcuuugggacaccccuagcccucccgaagucgagcgggcugugcuggaugacggcauuuaccgcauccugcagagagggcuccugggacggucucagguuggcgugggggucuuccaagacggaguguuucauacaauguggcacgugaccagaggcgcgguucuuauguaucaggggaaacgccuggaacccagcugggccuccgucaagaaagaucucaucagcuacggaggcggcuggcgguuccaggggucuuggaauacaggagaggaggugcaagugauugcugucgaacccggcaagaacccuaaaaaugugcaaacgacccccgggacauuuaagaccccggagggagaaguuggcgccaucgcccuggacuucaaaccugggaccuccggaagccccauugugaacagagagggcaagaucgucggccucuacgggaauggagugguuacaacgucuggcaccuauguguccgcuauugcccaggcgaaggcuagccaggaagggccucugcccgagaucgaggaugaagucuuuaaaaagcgcaaccuuacaauuauggaccugcaccccggauccggcaaaacccggagauaccugccugccaucgugcgcgaggccaucaagcggaaacucagaacacugauucuugcuccgacccgcguuguggccucugaaauggcggaggcucugaaggggaugcccauccgguaucaaacgacagccgucaagagcgaacauaccggcaaagagauuguggaucucaugugccacgccaccuucacaaugagacugcuguccccugugcggguccccaauuacaacaugaucauuauggacgaggcucauuuuaccgauccugccagcaucgcugcccgcggauauaucucuacaagaguuggcaugggggaagcggccgcuauuuucaugaccgccacgcccccuggauccguggaggcuuuuccgcagagcaaugccgugauccaggacgaagaacgggauauucccgaacgcucuuggaacagcggcuacgacuggaucacagauuucccugggaagaccgucugguuugugcccuccauuaaaucuggaaaugacaucgccaacugucucagaaagaacggcaaacggguuauccagcuuagcagaaagacauucgacaccgaguaucaaaagacgaaaaauaacgauugggacuacguggucaccacagauauuuccgagaugggggcuaauuuccgcgcggaccgggugaucgauccuagacgcugccugaagcccguuauucugaaagacggcccggaacgggugauccucgccggaccuaugcccgucaccgcugccucugccgcucagagacgcggccggauugggagaaaccagaauaaggagggagaucaguacaucuauaugggccaaccccugaacaaugacgaagaucacgcccauuggacagaggcgaaaaugcuucuggacaacauuaauaccccugaggggaucauccccgcucucuuugaaccugagcgcgaaaagagcgccgccauugauggagaguacagacugcggggcgaagcucgcaagacauucguggagcugaugagaagaggggaccucccggucuggcuuuccuauaaaguggccagcgagggcuuucaguacucugaucgcagauggugcuucgacggagaacggaacaaucagguucuggaggaaaacauggacguggagaucuggaccaaggaaggcgagcgcaagaagcugcgcccccgguggcucgaugcgagaacguauuccgacccucuggcccuucgcgaguuuaaagaguucgcugccgggcggagaagcguguccggagaucugauucucgagaucggcaagcugccccagcaccugacacuccgggcucaaaaugcccuugacaaccuggucaugcugcacaauucugaacaagggggaaaggcuuaccgccaugccauggaggaacucccugauaccauugagacccugaugcuucuggcgcucaucgccguucugacaggcggcgugacccuguuuuuccucagcgggaagggacuuggcaagacauccaucgggcugcugugugugauggcuucuagcguccuccuguggauggccuccguggagccccacuggauugcugccagcaucauucuugaauuuuuccugaugguucuccugaucccggagccugacagacagcggacgccccaggauaaccaacuggccuauguggucauuggacuccuuuuuaugauccugaccguggcugcgaacgaaaugggccugcucgagacaaccaaaaaggaccuggggaucggacaugucguggccgagaaucaccaccaugcuacaaugcuugauauugaccugcacccugccucugccuggacccucuacgcuguugccacgaccaucauuacacccaugaugcgccauaccaucgaaaacacaaccgcgaauauuucccugacggccaucgcuaaccaggccgcuauucugaugggccucgauaaaggcuggccuaucagcaagauggacaucggggugccccuucuggcccugggaugcuacucucaggucaauccgcucacacugaccgcggccgugcuuaugcugguugcucacuaugccauuaucggcccugggcuccaagcuaaagccacaagagaggcucagaagcggaccgccgcgggaauuaugaagaaccccaccguggauggcaucgucgccauugaccuggaccccgugguguacgaugcuaaauucgaaaagcagcuggggcagaucaugcuccuuauccuguguacaucccaaauucugcucaugcgcacgaccugggcccugugcgagagcaucacacuugcuaccggaccucugacaacccucugggaaggcucuccgggcaaauuuuggaauacgacaauugccguuagcauggccaacaucuucagaggguccuaucuggcgggagcuggccuggccuucucucucaugaagucccuugggggaggccggcgcgggaccggagcucagggcgagacccugggcgagaaauggaagagacagcugaaucagcucuccaagagcgaauuuaacacauacaaacgguccgggauuauggaggucgacagaucugaagccaaggagggacugaaacgcggcgaaaccacaaagcaugccgugagccgggggacggcuaaacuuagaugguucguggagcgcaaucuggucaagcccgagggaaagguuaucgaucucggcugugggcggggaggcugguccuauuacugcgccggccugaaaaaggugaccgaagugaaaggguauacaaagggaggcccugggcacgaggaacccaucccuauggcgaccuacggauggaacauugucaaacugcacucuggcagagacguguuuuucacacccccugagaagugugauacccuccuuugcgacaucggggaaagcuccccgaaucccacgauugaggagggacgcacccugcggguucugaaaaugguggaaccuuggcucagaggcaaccaauuuuguaucaagauucugaaucccuacaugccuucugucguggagacacuugaacagaugcagcgcaagcauggcgggaugcugguucggaacccccucagcagaaauuccacccacgagauguauugggugagcugcggaacaggcaacaucgucucugccgugaacaugaccucccgcaugcugcugaaucgguucacaauggcucauagaaaaccgaccuacgagcgcgauguggaccucggggccggaacgagacacgucgcuguugaaccugagauugccaaccuggauaucaucggccagcggauugaaaauaucaagaacgagcacaaaagcacauggcauuaugacgaagauaaucccuacaagaccugggcguaucacgggucuuacgaggugaaacccuccggaagcgccucuuccauggugaacggcgucgugcgccuucugaccaagccuugggacguuauucccauggugacacaaaucgcuaugacggacaccacaccuuuuggccagcagagagucuucaaggagaaaguggauacccggacaccgagacccaagcgggggaccgcccaaauuauggaaguuacagcuaaauggcucuggggauuucugagccgcaauaagaaaccuagaaucuguacccgggaggaguucacgcgcaaggugagauccaacgccgcuaucggcgccgucuuuguggacgagaaucaguggaacagcgcgaaggaagccguugaggaugagcgguucugggaccuugugcaucgcgaaagagagcugcacaaacaggggaagugcgcuaccugcgucuauaauaugaugggaaaacgggaaaagaaacucggcgaguuugggaaggccaagggcucucgcgcuauuugguacauguggcugggagccagauuccuggaguucgaggcccucggcuuuaugaacgaggaucauugguucagccgggaaaauucccugucugggguggagggagaaggccuucacaaacugggguacauccuccgcgacauuagcaagauccccggaggcaacauguaugcggaugacacagcugggugggauaccagaauuacagaggacgaucugcagaaugaggccaaaaucaccgacaucauggaaccugagcacgcccuucuggcuacguccauuuuuaagcucacauaccaaaacaaagucgugcggguucagcgccccgccaagucuggcaccgugauggaugucaucagcagacgggaccagagaggauccggccagguggggacauauggacugaacaccuucacgaauauggaagugcaacugauucgccagauggagucugaaggcaucuuuagcccguccgagcucgagaacagcaaucuggcugaacggguucuugacuggcuggagaaacaugggguggaaagacucaagcgcauggccauuucuggagaugacugugucgugaagccuaccgaugaccgguucgcgacagcccugaccgcucuuaacgauaugggcaaaguuagaaaggacaucccccagugggagccuuccaaaggguggaaugauuggcagcaagugcccuuuugcagccaccauuuccaccagcugaucaugaaggacggccgcgaaauugucgugccuugucggaaccaggaugagcucgucggacgggcccgcgugucucagggcgcuggguggucccugcgggagacagccugccugggaaaaagcuacgcgcaaauguggcagcucauguauuuucacagacgcgaccugcggcuugccgcuaaugccaucuguuccgcuguucccgugaacugggucccgaccucuagaacaaccuggagcauucaugcccaccaucaguggaugacgacagaagauaugcuguccguguggaaucggguuuggaucgaggaaaacccuuggauggaggacaagacccacgugagcucuugggaagacguccccuaccucggcaagagagaggaucaauggugcgggucccugauuggacuuaccgcucgcgccacaugggcgaccaauauccagguggccauuaaccaggugcggagacugaucggcaaugagaacuaucucgacuacaugacaagcaugaaacgcuucaagaaugaaucugaucccgagggggcucugugguga

SEQ ID NO: 19475 - RNA, 9879 nt, Artificial Sequence
  derived and/or modified CDS sequence (opt5) from DENV-1__KM403635__SS-prME
agcgugaccaugcugcucaugcugcuucccaccgcucuggcuuuccaccucacgacccggggcggggagccucauaugaucgucuccaagcaggaacggggaaaaucucugcuuuuuaagacaagcgcuggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcgcgucccaagagacauggaaucgccaggaucugcuggugaccuucaaaacagcccacgcuaagaagcaggaagucgugguucucggaucucaagagggcgccaugcacaccgcccugaccggggcuacagaaauucagacgagcggaaccacaaccaucuuugccggccaucuuaaaugcagacugaagauggacaaacucacacugaaggggguguccuaugucauguguaccggcagcuucaaacuggagaaggaaguggcggagacgcagcacggaacaguucuugugcaggucaaguacgagggcaccgaugcuccgugcaaaauuccuaucucuacccaagacgaaaagggggugacacagaacggacggcucaucaccgccaaucccauugugacagauaaagagaagccuguuaacaucgaaacggagccgcccuucggcgaguccuauauugucaucggggccggagaaaaagcucugaagcugagcugguuuaagaaaggcucuagcauugggaagauguucgaggccaccgcuagaggcgcccgccggauggcgauccucggagacacagccugggauuuuggcuccaucgggggaguguucaccucugugggcaaacugguccaucagguguuugggacagcuuacggaguucuuuucagcggcguguccuggaccaugaagauugggaucggcauucugcucacguggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuuugugacaaacgagguucacaccuggacagaacaauauaaguuccaggccgauagcccuaaacggcucuccgcggccauuggcaaggcuugggaggagggggugugcggcaucagaucugccacccgccuggaaaauaucauguggaaacagauuagcaacgagcuuaaucauauccugcucgaaaacgacaugaaguuuacggucguggugggagacgcuaauggcauucugacacaggggaaaaagaugauccggccgcaacccauggagcacaaauacuccuggaagucuuggggaaaggccaaaauuaucggcgccgauacccagaacaccacauucaucauugacgggccugauacccccgaauguccugacgaucagagagcuuggaauaucugggaggucgaggacuauggauuuggcguuuucacgacaaacauuuggcugaaacuucgcgauagcuacacccagaugugcgaccaccggcucauguccgcggccaucaaagauagcaaggcugugcaugccgacaugggcuauuggauugaaucugagaaaaaugaaacauggaagcuggccagagcuuccuuuaucgaggugaagaccuguaucuggccccgcagccacacacuguggucuaacgggguccucgaauccgagaugauuaucccgaaaauuuacggaggcccuaucagccaacauaauuaucggcccggguacuucacccagacggccggaccuuggcaccugggcaaacuugagcuggauuucaaccucugcgaagggaccacagugguuguggacgagcacugcggaaauagaggccccucucugcggaccacaaccgucacgggcaaaauuauccaugaaugguguugccgcagcuguacacugccuccccuuagauuuagaggggaagauggaugcugguacggcauggagaucagaccggugaaggaaaaagaggaaaaccucguucgcuccauggugagcgcggggucuggagaggucgacuccuucagccugggccugcucuguguguccauuaugaucgaagagguuaugcggucuagauggagccgcaagaugcugaugaccgggacacuugcuguguuuuuccugcucauuaugggacagcugaccuggaaugaccugaucagacuuugcauuauggucggcgccaacguguccgaucggaugggcauggggaccacauaucuggcccucauggcuacguuuaagaugcgcccuauguucgccgugggacugcucuuuagacggcugaccucucgcgagguccuucugcucacaaucggccugagccugguugcguccguggaacuucccaacucucuggaggaacucggggacggacuggcuaugggcauuaugaugcucaaacugcuuaccgauuuccaaagccaccagcuguggacaacccuccugucccugacguuuaucaagacaacccuuagccuggacuacgccuggaaaaccauggccauggugcucucuaucgucucccuguucccccucugucugagcacaaccucucagaagacaacguggcuuccugugcugcugggguccuuuggaugcaaaccgcucaccauguuccugauuacagagaauaagaucuggggcagaaagagcuggccccuuaacgaaggcauuauggcuguugggaucgugucuauucugcucuccagccugcucaaaaaugaugucccucuggccggaccccuuaucgcuggcgggaugcugaucgccuguuaugugauuuccggaagcucugcggaccugagccucgagcgggccgcugagguuuccugggaagaggaagccgagcauucuggcgcuagccacaacauccugguggaaguccaggaugacgggaccaugaagauuaaagaugaggagcgcgacgauacacuuaccauccugcucaaggccacgcugcucgccguguccggagucuacccuaugucuauucccgcuacccuguuugugugguauuucuggcagaagaagaaacagagaagcggcguucuuugggacacaccuagcccucccgaaguggagcgggcgguccuggaugacggcaucuaccgcauccugcagagagggcuccugggacggucucaggugggcguugggguguuccaagacggagucuuucauaccauguggcacgugacaagaggcgccgugcuuauguaucaggggaagcgccuggaacccagcugggcuuccguuaagaaagaucucauuagcuacggaggcggcuggcgguuccaggggucuuggaauaccggagaggagguccaggugaucgccguggaacccggcaagaacccuaaaaauguccaaacaacgcccgggaccuuuaagacaccggagggagaagugggcgccauugcucuggacuucaaaccugggaccuccggaagccccaucguuaacagagagggcaagauugugggccucuacgggaauggagucgugaccacaucuggcacguauguuuccgccaucgcgcaggcuaaggccagccaggaagggccucugcccgagauugaggaugaaguguuuaaaaagcgcaaccuuaccaucauggaccugcaccccggauccggcaaaacacggagauaccugccugccaucguccgcgaggcuauuaagcggaaacucagaacccugauccuugccccgacacgcgugguugcgucugaaauggcugaggcccugaaggggaugcccauucgguaucaaaccacggccgugaaguccgaacauacaggcaaagagaucgucgaucucaugugccacgcuaccuucaccaugagacugcuguccccugugcgggugcccaauuacaacaugauuaucauggacgaggcccauuuuacagauccugcuagcaucgccgcgcgcggauauauuucuaccagagucggcaugggggaagccgcugccaucuucaugacagcuacacccccuggauccguugaggccuuuccgcagagcaaugccgugauucaggacgaagaacgggauauccccgaacgcucuuggaacagcggcuacgacuggauuacggauuucccugggaagacagugugguuuguccccuccaucaaaucuggaaaugacaucgcuaacugucucagaaagaacggcaaacgggugauucagcuuagcagaaagaccuucgacacagaguaucaaaagaccaaaaauaacgauugggacuacguugugacgaccgauaucuccgagaugggggcgaauuuccgcgccgaccgggucauugauccuagacgcugccugaagcccgugauccugaaagacggcccggaacggguuauucucgcuggaccuaugcccgugacagccgccucugcugcccagagacgcggccggaucgggagaaaccagaauaaggagggagaucaguacauuuauaugggccaaccccugaacaaugacgaagaucacgcgcauuggaccgaggcuaaaaugcuucuggacaacaucaauacaccugaggggaucauucccgcccucuuugaaccugagcgcgaaaagagcgccgcuaucgauggagaguacagacugcggggcgaagcccgcaagaccuucgucgagcugaugagaagaggggaccucccgguguggcuuuccuauaaagucgcgagcgagggcuuucaguacucugaucgcagauggugcuucgacggagaacggaacaaucaggugcuggaggaaaacauggacguugagauuuggacaaaggaaggcgagcgcaagaagcugcgcccccgguggcucgaugccagaaccuauuccgacccucuggcccuucgcgaguuuaaagaguucgccgcugggcggagaagcguguccggagaucugauccucgagauuggcaagcugccccagcaccugacgcuccgggcccaaaaugcucuugacaaccuggugaugcugcacaauucugaacaagggggaaaagccuaccgccaugcgauggaggaacucccugauacaaucgagacccugaugcuucuggcccucaucgcuguccugaccggcggcguuacacuguuuuuccucagcgggaagggacuuggcaagaccuccauugggcugcugugugugauggccucuagcgugcuccuguggauggcuuccgucgagccccacuggaucgccgccagcauuauccuugaauuuuuccugauggugcuccugauuccggagccugacagacagcggacaccccaggauaaccaacuggcuuauguugugaucggacuccuuuuuaugauccugacggucgcggccaacgaaaugggccugcucgagaccaccaagaaggaccuggggauuggacauguggucgcugagaaucaccaccaugccaccaugcuugauaucgaccugcacccugccucugcuuggacacucuacgccguggcgaccacgauuaucacccccaugaugcgccauacaauugaaaacaccacagccaauaucucccugaccgcuauugccaaccaggcugccauccugaugggccucgauaaaggcuggccuaucagcaagauggacauugggguuccccuucuggcgcugggaugcuacucucaggugaauccgcucacgcugacagccgcuguccuuaugcugguggcccacuaugcuaucauuggcccugggcuccaagccaaagcuaccagagaggcccagaagcggacagcggccggaaucaugaagaaccccaccguugauggcauuguggcuaucgaccuggaccccgucguguacgaugccaaauucgaaaagcagcuggggcagaucaugcuccuuauucuguguaccucccaaauccugcucaugcgcacaacgugggcucugugcgagagcauuacccuugccacaggaccucugaccacacucugggaaggcucuccgggcaaauuuuggaauaccacgaucgccgugagcauggcgaacauuuucagaggguccuaucuggcuggagccggccuggcuuucucucucaugaaaagccuugggggaggccggcgcgggacaggagcccagggcgagacccugggcgagaaauggaagagacagcugaaucagcucuccaagagcgaauuuaacaccuacaaacgguccgggaucauggagguugacagaucugaagccaaggagggacugaaacgcggcgaaacaaccaagcaugcugucagccgggggacagccaaacuuagaugguucguggagcgcaaucuggugaagcccgagggaaaggucaucgaucucggcugugggcggggaggcugguccuauuacugcgcgggccugaaaaagguuacggaagugaaaggguauaccaagggaggcccugggcacgaggaacccauuccuauggccacauacggauggaacaucgugaaacugcacucuggcagagacgucuuuuucacacccccugagaagugugauacccuccuuugcgacauuggggaaagcuccccgaaucccaccaucgaggagggacgcacgcugcgggugcugaaaaugguugaaccuuggcucagaggcaaccaauuuuguauuaagauccugaaucccuacaugccuucuguggucgagacccuugaacagaugcagcgcaagcauggcgggaugcuggugcggaacccccucagcagaaauuccacacacgagauguauuggguuagcugcggaaccggcaacauugugucugcugucaacaugacaucccgcaugcugcugaaucgguucaccauggcccauagaaaaccgacauacgagcgcgauguggaccucggggcuggaaccagacacguggccgucgaaccugagaucgcgaaccuggauaucauuggccagcggaucgaaaauauuaagaacgagcacaaaagcacguggcauuaugacgaagauaaucccuacaagacaugggccuaucacgggucuuacgagguuaaacccuccggaagcgcuucuuccauggugaacggcgugguccgccuucugaccaagccuugggacgugauccccaugguuacccaaauugccaugacagacacgaccccuuuuggccagcagagaguguucaaggagaaagucgauacacggaccccgagacccaagcgggggacagcucaaaucauggaagugaccgccaaauggcucuggggauuucugagccgcaauaagaaaccuagaaucuguacacgggaggaguucacccgcaagguuagauccaacgcugccauuggcgcgguguuugucgacgagaaucaguggaacagcgccaaggaagcuguggaggaugagcgguucugggaccuuguucaucgcgaaagagagcugcacaaacaggggaagugcgccacgugcguguauaauaugaugggaaaacgggaaaagaaacucggcgaguuugggaaggcuaagggcucucgcgccaucugguacauguggcugggagccagauuccuggaguucgaggcgcucggcuuuaugaacgaggaucauugguucagccgggaaaauucccugucuggggucgagggagaaggccuucacaaacugggguacauucuccgcgacaucagcaagauucccggaggcaacauguaugcugaugacaccgccgggugggauacaagaaucaccgaggacgaucugcagaaugaggccaaaaucacagacauuauggaaccugagcacgcccuucuggccaccuccaucuuuaagcucacguaccaaaacaaagugguccgggugcagcgccccgcuaagucuggcacaguuauggaugugauuagcagacgggaccagagaggauccggccaggucgggaccuauggacugaacacauucaccaauauggaagugcaacugauccgccagauggagucugaaggcauuuuuagcccguccgagcucgagaacagcaaucuggccgaacgggugcuugacuggcuggagaaacaugggguugaaagacucaagcgcauggcgaucucuggagaugacuguguggucaagccuacggaugaccgguucgccaccgcucugacagcccuuaacgauaugggcaaagugagaaaggacaucccccagugggagccuuccaaaggguggaaugauuggcagcaaguucccuuuugcagccaccauuuccaccagcugauuaugaaggacggccgcgaaaucguggucccuugucggaaccaggaugagcucgugggacgggcucgcgucucucagggcgccggguggucccugcgggagaccgcgugccugggaaaaagcuacgcccaaauguggcagcucauguauuuucacagacgcgaccugcggcuugcugccaaugcuauuuguuccgccgugcccguuaacugggugccgacaucuagaaccacauggagcauccaugcucaccaucaguggaugaccacggaagauaugcuguccgucuggaaucggguguggauugaggaaaacccuuggauggaggacaagacacacguuagcucuugggaagacgugcccuaccucggcaagagagaggaucaauggugcgggucccugaucggacuuaccgcccgcgcgaccugggccacaaauauucaggucgcuaucaaccaggugcggagacuggugggcaaugagaacuaucucgacuacaugaccagcaugaaacgcuucaagaaugaaucugaucccgagggggcccugugguga

SEQ ID NO: 19476 - RNA, 9879 nt, Artificial Sequence
  derived and/or modified CDS sequence (opt5) from DENV-1__KM403621__SS-prME
agcgugaccaugcugcucaugcugcuucccacagcccuggcuuuccaccucacgacccggggcggggagccucauaugauugucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaagcgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugagagcuuuccgcagucuaaugcugugauucaggacgaagaacgggauauccccgaacgcagcuggaacuccggcuacgacuggauuacagauuucccugggaagaccgugugguuuguccccucuaucaaaagcggaaaugacaucgccaacugucucagaaagaacggcaaacgggugauucagcuuuccagaaagacauucgacaccgaguaucaaaagacgaaaaauaacgauugggacuacguugugaccacagauaucucugagaugggggccaauuuccgcgcugaccgggucauugauccuagacgcugccugaagcccgugauccugaaagacggcccggaacggguuauucucgcgggaccuaugcccgugaccgccgcuagcgccgcccagagacgcggccggaucgggagaaaccagaauaaggagggagaucaguacauuuauaugggccaaccccugaacaaugacgaagaucacgcucauuggacagaggccaaaaugcuucuggacaacaucaauaccccugaggggaucauucccgcgcucuuugaaccugagcgcgaaaaguccgcugccaucgauggagaguacagacugcggggcgaagcccgcaagacauucgucgagcugaugagaagaggggaccucccgguguggcuuagcuauaaagucgcuucugagggcuuucaguacuccgaucgcagauggugcuucgacggagaacggaacaaucaggugcuggaggaaaacauggacguugagauuuggaccaaggaaggcgagcgcaagaagcugcgcccccgguggcucgaugccagaacguauagcgacccucuggcgcuucgcgaguuuaaagaguucgccgcugggcggagauccgugucuggagaucugauccucgagauuggcaagcugccccagcaccugacacuccgggcccaaaaugcucuugacaaccuggugaugcugcacaauagcgaacaagggggaaaagccuaccgccaugcuauggaggaacucccugauaccaucgagacccugaugcuucuggcccucaucgcgguccugacaggcggcguuacccuguuuuuccucuccgggaagggacuuggcaagacaucuauugggcugcugugugugauggccagcuccgugcuccuguggauggcuagcgucgagccccacuggaucgccgcuucuauuauccuugaauuuuuccugauggugcuccugauuccggagccugacagacagcggacgccccaggauaaccaacuggccuauguugugaucggacuccuuuuuaugauccugaccgucgccgcuaacgaaaugggccugcucgagacaaccaaaaaggaccuggggauuggacauguggucgcggagaaucaccaccaugccacaaugcuugauaucgaccugcacccugcuuccgccuggacccucuacgccguggcuacgaccauuaucacacccaugaugcgccauaccauugaaaacacaaccgccaauaucagccugacggcgauugccaaccaggcugccauccugaugggccucgauaaaggcuggccuaucucuaagauggacauugggguuccccuucuggcucugggaugcuacucccaggugaauccgcucacacugaccgccgcgguccuuaugcugguggcccacuaugcuaucauuggcccugggcuccaagccaaagcuacaagagaggcccagaagcggaccgcugccggaaucaugaagaaccccaccguugauggcauuguggcgaucgaccuggaccccgucguguacgaugccaaauucgaaaagcagcuggggcagaucaugcuccuuauucuguguacaagccaaauccugcucaugcgcacgaccugggcucugugcgagucuauuacacuugccaccggaccucugacaacccucugggaaggcagcccgggcaaauuuuggaauacgacaaucgcuguguccauggccaacauuuucagagggucuuaucuggccggagcgggccuggcuuucagccucaugaagucccuugggggaggccggcgcgggaccggagcccagggcgagacccugggcgagaaauggaagagacagcugaaucagcucagcaaguccgaauuuaacacauacaaacggucugggaucauggagguugacagaagcgaagcuaaggagggacugaaacgcggcgaaaccacaaagcaugccgucucccgggggacggccaaacuuagaugguucguggagcgcaaucuggugaagcccgagggaaaggucaucgaucucggcugugggcggggaggcuggucuuauuacugcgcuggccugaaaaagguuaccgaagugaaaggguauacaaagggaggcccugggcacgaggaacccauuccuauggccaccuacggauggaacaucgugaaacugcacagcggcagagacgucuuuuucacacccccugagaagugugauacccuccuuugcgacauuggggaauccucuccgaaucccacgaucgaggagggacgcacccugcgggugcugaaaaugguugaaccuuggcucagaggcaaccaauuuuguauuaagauccugaaucccuacaugccuagcguggucgagacacuugaacagaugcagcgcaagcauggcgggaugcuggugcggaacccccucuccagaaauagcacccacgagauguauuggguuucuugcggaacaggcaacauuguguccgcggucaacaugaccagccgcaugcugcugaaucgguucacaauggcccauagaaaaccgaccuacgagcgcgauguggaccucggggcuggaacgagacacguggccgucgaaccugagaucgcuaaccuggauaucauuggccagcggaucgaaaauauuaagaacgagcacaaaucuacauggcauuaugacgaagauaaucccuacaagaccugggccuaucacggguccuacgagguuaaacccagcggaucugcguccagcauggugaacggcgugguccgccuucugaccaagccuugggacgugauccccaugguuacacaaauugccaugacggacaccacaccuuuuggccagcagagaguguucaaggagaaagucgauacccggacaccgagacccaagcgggggaccgcucaaaucauggaagugacagccaaauggcucuggggauuucugucccgcaauaagaaaccuagaaucuguacccgggaggaguucacgcgcaagguuagaagcaacgcugccauuggcgcuguguuugucgacgagaaucaguggaacucugccaaggaagcgguggaggaugagcgguucugggaccuuguucaucgcgaaagagagcugcacaaacaggggaagugcgcuaccugcguguauaauaugaugggaaaacgggaaaagaaacucggcgaguuugggaaggccaagggcagccgcgccaucugguacauguggcugggagcuagauuccuggaguucgaggcccucggcuuuaugaacgaggaucauugguucucccgggaaaauucucugagcggggucgagggagaaggccuucacaaacugggguacauucuccgcgacaucuccaagauucccggaggcaacauguaugccgaugacacagcggggugggauaccagaaucacagaggacgaucugcagaaugaggcuaaaaucaccgacauuauggaaccugagcacgcccuucuggccacgucuaucuuuaagcucacauaccaaaacaaagugguccgggugcagcgccccgcuaagagcggcaccguuauggaugugauuuccagacgggaccagagaggaucuggccaggucgggacauauggacugaacaccuucacgaauauggaagugcaacugauccgccagauggagagcgaaggcaucuuuuccccgagcgagcucgagaacucuaaucuggccgaacgggugcuugacuggcuggagaaacaugggguugaaagacucaagcgcauggcuaucuccggagaugacuguguggucaagccuaccgaugaccgguucgccacagcgcugaccgcccuuaacgauaugggcaaagugagaaaggacaucccccagugggagccuagcaaaggguggaaugauuggcagcaaguucccuuuugcucucaccauuuccaccagcugauuaugaaggacggccgcgaaaucguggucccuugucggaaccaggaugagcucgugggacgggcucgcgucucccagggcgccggguggagccugcgggagacagcuugccugggaaaauccuacgcccaaauguggcagcucauguauuuucacagacgcgaccugcggcuugcggccaaugcuauuuguucugccgugcccguuaacugggugccgaccagcagaacaaccugguccauccaugcucaccaucaguggaugacgacagaagauaugcugagcgucuggaaucggguguggauugaggaaaacccuuggauggaggacaagacccacguuucuuccugggaagacgugcccuaccucggcaagagagaggaucaauggugcgggagccugaucggacuuaccgcccgcgcuacaugggccaccaauauucaggucgcgaucaaccaggugcggagacugaucggcaaugagaacuaucucgacuacaugacaucuaugaaacgcuucaagaaugaaagcgaucccgagggggcccugugguga

SEQ ID NO: 19477 - RNA, 9879 nt, Artificial Sequence
  derived and/or modified CDS sequence (opt5) from DENV-1__KM403623__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugccauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagaacaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggguguccuaugucauguguacgggcagcuucaaacuggagaaggaaguggccgagacacagcacggaaccguucuggugcaggucaaguacgagggcaccgaugcgccgugcaaaauuccuaucucuacacaagacgaaaagggggugacccagaacggacggcuuaucacagcuaaucccauugugacggauaaagagaagccuguuaacaucgaaaccgagccgcccuuuggcgaguccuauauugucaucggggccggagaaaaagcccucaagcugagcugguucaagaaaggcucuagcauugggaagauguuugaggcuacagccagaggcgcucgccggauggccauccugggagacaccgcgugggauuucggcuccaucgggggaguguuuacaucugugggcaaacucguccaucagguguucgggaccgccuacggaguucuguuuagcggcguguccuggacgaugaagauugggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcuguccgccgcgauuggcaaggccugggaggagggggugugcggcaucagaucugcuacgcgccucgaaaauaucauguggaaacagauuagcaacgagcugaaucauauccuucuggaaaacgacaugaaguucacagucguggugggagacgccaauggcauucucacccaggggaaaaagaugauccggccgcaacccauggagcacaaauacuccuggaagucuuggggaaaggcuaaaauuaucggcgccgauacccagaacacaaccuuuaucauugacgggccugauacgcccgaauguccugacgaucagagagccuggaauaucugggaggucgaggacuauggauucggcguuuuuacaaccaacauuuggcugaagcugcgcgauagcuacacacagaugugcgaccaccggcuuauguccgcugcgaucaaagauagcaaggccgugcaugcugacaugggcuauuggauugaaucugagaaaaaugaaaccuggaagcucgccagagccuccuucaucgaggugaagacauguaucuggccccgcagccacacccuguggucuaacgggguccuggaauccgagaugauuaucccgaaaauuuacggaggcccuaucagccaacauaauuaucggcccggguacuucacgcagaccgcuggaccuuggcaccucggcaagcuggagcuugauuuuaaccugugcgaagggacaaccgugguuguggacgagcacugcggaaauagaggccccucucuccggacaaccacggucacaggcaaaauuauccaugaaugguguugccgcagcuguacccugccuccccugagauucagaggggaagauggaugcugguacggcauggagaucagaccggugaaggaaaaagaggaaaaccuuguucgcuccauggugagcgccgggucuggagaggucgacuccuuuagccucggccugcuguguguguccauuaugaucgaagagguuaugcggucuagauggagccgcaagaugcucaugacagggacccuggcgguguucuuucuucugauuaugggacagcucaccuggaaugaccugaucagacugugcauuauggucggcgcuaacguguccgaucggaugggcauggggacaacguaucuugcccugauggccaccuucaagaugcgcccuauguuugcugugggacuccuguucagacggcucacaucucgcgagguccugcuucugaccaucggccucagccugguugccuccguggaacugcccaacucucuugaggaacugggggacggacucgcgaugggcauuaugaugcugaaacuccugacagauuuucaaagccaccagcuuuggaccacgcugcucucccugacauucaucaagaccacccugagccuugacuacgcuuggaaaacaauggccauggugcugucuaucgucucccucuuuccccugugucucagcaccacaucucagaagacgaccuggcugccugugcuucugggguccuucggaugcaaaccgcugacaauguuucucauuaccgagaauaagaucuggggcagaaagagcuggccccugaacgaaggcauuauggccguugggaucgugucuauucuucuguccagccuccugaaaaaugaugucccucucgcuggaccccugaucgccggcgggaugcuuaucgcuuguuaugugauuuccggaagcucugccgaccugagccuggagcgggcggccgagguuuccugggaagaggaagcugagcauucuggcgccagccacaacauccucguggaaguccaggaugacgggacaaugaagauuaaagaugaggagcgcgacgauacccugacgauccuucugaaggcuacccuccuggccguguccggagucuacccuaugucuauucccgccacacucuucgugugguauuucuggcagaaaaagaaacagagaagcggcguucugugggacaccccuagcccucccgaaguggagcgggcuguccuugaugacggcaucuaccgcauccugcagagagggcugcucggacggucucaggugggcguugggguguuucaagacggagucuuccauacaauguggcacgugaccagaggcgcggugcugauguaucaggggaagcgccuugaacccagcugggccuccguuaagaaagaucugauuagcuacggaggcggcuggcgguuucaggggucuuggaauacaggagaggagguccaggugaucgcuguggaacccggcaagaacccuaaaaauguccaaacgacccccgggacauucaagaccccggagggagaagugggcgccauugcccucgacuuuaaaccugggaccuccggaagccccaucguuaacagagagggcaagauugugggccuguacgggaauggagucgugacaacgucuggcaccuauguuuccgcuaucgcccaggcgaaggcuagccaggaagggccucuccccgagauugaggaugaaguguucaaaaagcgcaaccugacaaucauggaccuucaccccggauccggcaaaacccggagauaccugccugccaucguccgcgaggccauuaagcggaaacugagaacacucauccuggcuccgacccgcgugguugccucugaaauggcggaggcucuuaaggggaugcccauucgguaucaaacgacagccgugaaguccgaacauaccggcaaagagaucgucgaucugaugugccacgccaccuuuacaaugagacuccuguccccugugcgggugcccaauuacaacaugauuaucauggacgaggcucauuucaccgauccugccagcaucgcugcccgcggauauauuucuacaagagucggcaugggggaagcggccgcuaucuuuaugaccgccacgcccccuggauccguugagagcuucccgcagucuaaugcugugauucaggacgaggaacgggauauccccgaacgcagcuggaacuccggcuacgacuggauuacagauuuuccugggaagaccgugugguucguccccucuaucaaaagcggaaaugacaucgccaacugucugagaaagaacggcaaacgggugauucagcucuccagaaagacauucgacaccgaguaucaaaagacgaaaaauaacgauugggacuacguugugaccacagauaucucugagaugggggccaauuuucgcgcugaccgggucauugauccuagacgcugccuuaagcccgugauccugaaagacggcccggaacggguuauucuggcgggaccuaugcccgugaccgccgcuagcgccgcccagagacgcggccggaucgggagaaaccagaauaaggagggagaucaguacauuuauaugggccaaccccucaacaaugacgaagaucacgcucauuggacagaggccaaaaugcugcuugacaacaucaauaccccugaggggaucauucccgcgcuguucgaaccugagcgcgaaaaguccgcugccaucgauggagaguacagacuccggggcgaagcccgcaagacauuugucgagcugaugagaagaggggaccugccgguguggcucagcuauaaagucgcuucugagggcuuccaguacuccgaucgcagauggugcuuugacggagaacggaacaaucaggugcuugaggaaaacauggacguugagauuuggaccaaggaaggcgagcgcaaaaagcugcgcccccgguggcuggaugccagaacguauagcgacccucucgcgcugcgcgaguucaaagaauuugccgcugggcggagauccgugucuggagaucuuauccuggagauuggcaagcucccccagcaccugacacugcgggcccaaaaugcucucgacaaccuugugaugcugcacaauagcgaacaagggggaaaagccuaccgccaugcuauggaggaacugccugauaccaucgagacccucaugcugcuugcccugaucgcgguccucacaggcggcguuacccuguucuuucuguccgggaagggacucggcaagacaucuauugggcuucugugugugauggccagcuccgugcugcucuggauggcuagcgucgagccccacuggaucgccgcuucuauuauccuggaguucuuucuuauggugcugcucauuccggagccugacagacagcggacgccccaggauaaccaacuggccuauguugugaucggacuccuguucaugauccuuaccgucgccgcuaacgaaaugggccugcuggagacaaccaaaaaggaccucgggauuggacauguggucgcggagaaucaccaccaugccacaaugcuggauaucgaccuucacccugcuuccgccuggacccuguacgccguggcuacgaccauuaucacacccaugaugcgccauaccauugaaaacacaaccgccaauaucagccucacggcgauugccaaccaggcugccauccugaugggccuggauaaaggcuggccuaucucuaagauggacauugggguuccccuccuugcucugggaugcuacucccaggugaauccgcugacacucaccgccgcgguccugaugcuuguggcccacuaugcuaucauuggcccugggcugcaagccaaagcuacaagagaggcccagaagcggaccgcugccggaaucaugaagaaccccaccguugauggcauuguggcgaucgaccucgaccccgucguguacgaugccaaauuugaaaagcagcuggggcagaucaugcugcucauucuuuguacaagccaaauccugcugaugcgcacgaccugggcucucugcgagucuauuacacuggccaccggaccucuuacaacccugugggaaggcagcccgggcaaauucuggaauacgacaaucgcuguguccauggccaacauuuucagagggucuuaucucgccggagcgggccuggcuuuuagccugaugaagucccucgggggaggccggcgcgggaccggagcccagggcgagacccuuggcgagaaauggaagagacagcugaaucagcugagcaaguccgaguucaacacauacaaacggucugggaucauggagguugacagaagcgaagcuaaggagggacucaaacgcggcgaaaccacaaagcaugccgucucccgggggacggccaaacugagaugguuuguggagcgcaaucuugugaagcccgagggaaaggucaucgaucugggcugugggcggggaggcuggucuuauuacugcgcuggccucaaaaagguuaccgaagugaaaggguauacaaagggaggcccugggcacgaggaacccauuccuauggccaccuacggauggaacaucgugaaacugcacagcggcagagacgucuucuuuacacccccugagaagugugauacccugcucugcgacauuggggaauccucuccgaaucccacgaucgaggagggacgcacccuucgggugcugaaaaugguugaaccuuggcugagaggcaaccaauucuguauuaagauccucaaucccuacaugccuagcguggucgagacacuggaacagaugcagcgcaagcauggcgggaugcuugugcggaacccccuguccagaaauagcacccacgagauguauuggguuucuugcggaacaggcaacauuguguccgcggucaacaugaccagccgcaugcuccugaaucgguuuacaauggcccauagaaaaccgaccuacgagcgcgauguggaccugggggcuggaacgagacacguggccgucgaaccugagaucgcuaaccucgauaucauuggccagcggaucgaaaauauuaagaacgagcacaaaucuacauggcauuaugacgaagauaaucccuacaagaccugggccuaucacggguccuacgagguuaaacccagcggaucugcguccagcauggugaacggcgugguccgccugcuuaccaagccuugggacgugauccccaugguuacacaaauugccaugacggacaccacaccuuucggccagcagagaguguuuaaggagaaagucgauacccggacaccgagacccaagcgggggaccgcucaaaucauggaagugacagccaaauggcuguggggauuccucucccgcaauaagaaaccuagaaucuguacccgggaggaauuuacgcgcaagguuagaagcaacgcugccauuggcgcuguguucgucgacgagaaucaguggaacucugccaaggaagcgguggaggaugagcgguuuugggaccugguucaucgcgaaagagagcuucacaaacaggggaagugcgcgaccugcguguauaauaugaugggaaaacgggaaaagaaacugggcgaguucgggaaggcuaagggcagccgcgccaucugguacauguggcucggagcuagauuccuggaauuugaggcccugggcuucaugaacgaggaucauugguuuucccgggaaaauucucucagcggggucgagggagaaggccugcacaaacuuggguacauucugcgcgacaucuccaagauucccggaggcaacauguaugccgaugacacagcggggugggauaccagaaucacagaggacgaucuccagaaugaggcuaaaaucaccgacauuauggaaccugagcacgcccugcuugccacgucuaucuucaagcugacauaccaaaacaaagugguccgggugcagcgccccgcuaagagcggcaccguuauggaugugauuuccagacgggaccagagaggaucuggccaggucgggacauauggacucaacaccuuuacgaauauggaagugcaacugauccgccagauggagagcgaaggcauuuucuccccgagcgagcuggagaacucuaaucucgccgaacgggugcuggacuggcuugagaaacaugggguugaaagacugaagcgcauggcuaucuccggagaugacuguguggucaagccuaccgaugaccgguuugccacagcgcucaccgcccugaacgauaugggcaaagugagaaaggacaucccccagugggagccuagcaaaggguggaaugauuggcagcaaguucccuucugcucucaccauuuucaccagcuuauuaugaaggacggccgcgaaaucguggucccuugucggaaccaggaugagcuggugggacgggcucgcgucucccagggcgccggguggagccuccgggagacagcuugccugggaaaauccuacgcccaaauguggcagcugauguauuuccacagacgcgaccuccggcuggcggccaaugcuauuuguucugccgugcccguuaacugggugccgaccagcagaacaaccugguccauccaugcucaccaucaguggaugacgacagaagauaugcuuagcgucuggaaucggguguggauugaggaaaacccuuggauggaggacaagacccacguuucuuccugggaagacgugcccuaccugggcaagagagaggaucaauggugcgggagccucaucggacugaccgcccgcgcuacaugggccaccaauauucaggucgcgaucaaccaggugcggagacuuaucggcaaugagaacuaucuggacuacaugacaucuaugaaacgcuuuaagaaugaaagcgaucccgagggggcccucugguga

SEQ ID NO: 19478 - RNA, 9879 nt, Artificial Sequence
  derived and/or modified CDS sequence (opt5) from DENV-1__KM403575__SS-prME
agcgugaccaugcugcucaugcugcuucccacagcccuggcuuuccaccucacgacccggggcggggagccucauaugaucgucuccaagcaggaacggggaaagucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagcugcgcccccgguggcucgaugcgagaacguauuccgacccucuggcccuucgcgaguuuaaagaguucgcugccgggcggagaagcguguccggagaucugauccucgagauuggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucaucgccguccugacaggcggcguuacccuguuuuuccucagcgggaagggacuuggcaagacauccauugggcugcugugugugauggcuucuagcgugcuccuguggauggccuccgucgagccccacuggaucgcugccagcauuauccuugaauuuuuccugauggugcuccugauuccggagccugacagacagcggacgccccaggauaaccaacuggccuauguugugaucggacuccuuuuuaugauccugaccgucgcugcgaacgaaaugggccugcucgagacaaccaaaaaggaccuggggauuggacauguggucgccgagaaucaccaccaugcuacaaugcuugauaucgaccugcacccugccucugccuggacccucuacgcuguggccacgaccauuaucacacccaugaugcgccauaccauugaaaacacaaccgcgaauaucucccugacggccauugcuaaccaggccgcuauccugaugggccucgauaaaggcuggccuaucagcaagauggacauugggguuccccuucuggcccugggaugcuacucucaggugaauccgcucacacugaccgcggccguccuuaugcugguggcucacuaugccaucauuggcccugggcuccaagcuaaagccacaagagaggcucagaagcggaccgccgcgggaaucaugaagaaccccaccguugauggcauuguggccaucgaccuggaccccgucguguacgaugcuaaauucgaaaagcagcuggggcagaucaugcuccuuauucuguguacaucccaaauccugcucaugcgcacgaccugggcccugugcgagagcauuacacuugcuaccggaccucugacaacccucugggaaggcucuccgggcaaauuuuggaauacgacaaucgccgugagcauggccaacauuuucagaggguccuaucuggcgggagcuggccuggccuucucucucaugaaaagccuugggggaggccggcgcgggaccggagcucagggcgagacccugggcgagaaauggaagagacagcugaaucagcucuccaagagcgaauuuaacacauacaaacgguccgggaucauggagguugacagaucugaagccaaggagggacugaaacgcggcgaaaccacaaagcaugccgucagccgggggacggcuaaacuuagaugguucguggagcgcaaucuggugaagcccgagggaaaggucaucgaucucggcugugggcggggaggcugguccuauuacugcgccggccugaaaaagguuaccgaagugaaaggguauacaaagggaggcccugggcacgaggaacccauuccuauggcgaccuacggauggaacaucgugaaacugcacucuggcagagacgucuuuuucacacccccugagaagugugauacccuccuuugcgacauuggggaaagcuccccgaaucccacgaucgaggagggacgcacccugcgggugcugaaaaugguugaaccuuggcucagaggcaaccaauuuuguauuaagauccugaaucccuacaugccuucuguggucgagacacuugaacagaugcagcgcaagcauggcgggaugcuggugcggaacccccucagcagaaauuccacccacgagauguauuggguuagcugcggaacaggcaacauugugucugccgucaacaugaccucccgcaugcugcugaaucgguucacaauggcucauagaaaaccgaccuacgagcgcgauguggaccucggggccggaacgagacacguggcugucgaaccugagaucgccaaccuggauaucauuggccagcggaucgaaaauauuaagaacgagcacaaaagcacauggcauuaugacgaagauaaucccuacaagaccugggcguaucacgggucuuacgagguuaaacccuccggaagcgccucuuccauggugaacggcgugguccgccuucugaccaagccuugggacgugauccccaugguuacacaaauugcuaugacggacaccacaccuuuuggccagcagagaguguucaaggagaaagucgauacccggacaccgagacccaagcgggggaccgcccaaaucauggaagugacagcuaaauggcucuggggauuucugagccgcaauaagaaaccuagaaucuguacccgggaggaguucacgcgcaagguuagauccaacgccgcuauuggcgccguguuugucgacgagaaucaguggaacagcgcgaaggaagccguggaggaugagcgguucugggaccuuguucaucgcgaaagagagcugcacaaacaggggaagugcgcuaccugcguguauaauaugaugggaaaacgggaaaagaaacucggcgaguuugggaaggccaagggcucucgcgcuaucugguacauguggcugggagccagauuccuggaguucgaggcccucggcuuuaugaacgaggaucauugguucagccgggaaaauucccugucuggggucgagggagaaggccuucacaaacugggguacauucuccgcgacaucagcaagauucccggaggcaacauguaugcggaugacacagcugggugggauaccagaaucacagaggacgaucugcagaaugaggccaaaaucaccgacauuauggaaccugagcacgcccuucuggcuacguccaucuuuaagcucacauaccaaaacaaagugguccgggugcagcgccccgccaagucuggcaccguuauggaugugauuagcagacgggaccagagaggauccggccaggucgggacauauggacugaacaccuucacgaauauggaagugcaacugauccgccagauggagucugaaggcauuuuuagcccguccgagcucgagaacagcaaucuggcugaacgggugcuugacuggcuggagaaacaugggguugaaagacucaagcgcauggccaucucuggagaugacuguguggucaagccuaccgaugaccgguucgcgacagcccugaccgcucuuaacgauaugggcaaagugagaaaggacaucccccagugggagccuuccaaaggguggaaugauuggcagcaaguucccuuuugcagccaccauuuccaccagcugauuaugaaggacggccgcgaaaucguggucccuugucggaaccaggaugagcucgugggacgggcccgcgucucucagggcgcuggguggucccugcgggagacagccugccugggaaaaagcuacgcgcaaauguggcagcucauguauuuucacagacgcgaccugcggcuugccgcuaaugccauuuguuccgcugugcccguuaacugggugccgaccucuagaacaaccuggagcauccaugcccaccaucaguggaugacgacagaagauaugcuguccgucuggaaucggguguggauugaggaaaacccuuggauggaggacaagacccacguuagcucuugggaagacgugcccuaccucggcaagagagaggaucaauggugcgggucccugaucggacuuaccgcucgcgccacaugggcgaccaauauucaggucgccaucaaccaggugcggagacugaucggcaaugagaacuaucucgacuacaugacaagcaugaaacgcuucaagaaugaaucugaucccgagggggcucugugguga

SEQ ID NO: 19479 - RNA, 9879 nt, Artificial Sequence
  derived and/or modified CDS sequence (opt5) from DENV-1__KM403586__SS-prME
uccgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagaacaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgaggugcagcugacagacuacggcgcccugacccucgacuguagcccccggacaggccuggauuuuaacgaaaugguccuucugaccaugaaggagaaaucuuggcucgugcauaagcagugguuccuggaccuuccucugcccuggacguccggggcuagcacaucccaagagaccuggaaucgccaggaucuccuggucacauuuaaaaccgcgcacgccaagaagcaggaagugguugugcugggaucucaagagggcgcuaugcacaccgcccucacaggggccacggaaauccagaccagcggaacaaccacaauuuucgcuggccaucugaaaugcagacuuaagauggacaaacugacccucaagggggucuccuaugugauguguacgggcagcuucaaacuggagaaggaaguugccgagacacagcacggaaccgugcugguccaggugaaguacgagggcaccgaugcgccgugcaaaaucccuauuucuacacaagacgaaaagggggugacccagaacggacggcuuaucacagcuaaucccaucguuacggauaaagagaagccugucaacauugaaaccgagccgcccuuuggcgaguccuauaucgugauuggggccggagaaaaagcccucaagcugagcugguucaagaaaggcucuagcaucgggaagauguuugaggcuacagccagaggcgcucgccggauggccauucugggagacaccgcgugggauuucggcuccaucgggggaguguuuacaucugucggcaaacucgugcaucagguuuucgggaccgccuacggagugcuguuuagcggcgucuccuggacgaugaagaucgggauuggcauccuucugaccuggcucggacugaauagcagaucuacaucccugagcaugaccuguauugcugugggcaugguuacacuuuaccucggggugaugguccaggccgacucuggaugcgugaucaacuggaaaggccgcgaacugaaguguggguccggaauuuucguuaccaacgaggugcacacauggaccgaacaauauaaguuucaggcugauagcccuaaacggcuguccgccgcgaucggcaaggccugggaggagggggucugcggcauuagaucugcuacgcgccucgaaaauaucauguggaaacagaucagcaacgagcugaaucauauucuucuggaaaacgacaugaaguucacagugguggucggagacgccuacggcauccucacccaggggaaaaagaugauucggccgcaacccauggagcacaaauauuccuggaagucuuggggaaaggcuaaaaucauuggcgccgauacccagaauacaaccuuuaucaucgacgggccugauacgcccgaauguccugacgaucagagagccuggaacauuugggagguugaggacuacggauucggcguguuuacaaccaauaucuggcugaagcugcgcgauagcuauacacagaugugcgaccaccggcuuauguccgcugcgauuaaagauagcaaggccgugcaugcugacaugggcuacuggaucgaaucugagaaaaacgaaaccuggaagcucgccagagccuccuucauugaggucaagacauguaucuggccccgcagccacacccuguggucuaauggggugcuggaauccgagaugaucauuccgaaaaucuauggaggcccuauuagccaacauaacuaccggcccggguacuucacgcagaccgcuggaccuuggcaccucggcaagcuggagcuugauuuuaaucugugcgaagggacaaccguuguggucgacgagcacugcggaaacagaggccccucucuccggacaaccacggugacaggcaaaaucauucaugaaugguguugccgcagcuguacccugccuccccugagauucagaggggaagauggaugcugguauggcauggagauccggccgguuaaggaaaaagaggaaaaucuugugcgcuccauggucagcgccgggucuggagagguggacuccuuuagccucggccugcuguguguuuccaucaugauugaagaggugaugcggucuagauggagccgcaagaugcucaugacagggacccuggcggucuucuuucuucugaucaugggacagcucaccuggaacgaccugauuagacugugcaucauggugggcgcuaauguguccgaucggaugggcauggggacaacguaccuugcccugauggccaccuucaagaugcgcccuauguuugcugucggacuccuguucagacggcucacaucucgcgagguucugcuucugaccauuggccucagccugguggccuccguggaacugcccaacucucuugaggaacugggggacggacucgcgaugggcaucaugaugcugaaacuccugacagauuuucaaagccaccagcuuuggaccacgcugcucucccugacauucauuaagaccacccugagccuugacuaugcuuggaaaacaauggccaugguccugucuaucgugucccucuuuccccugugucucagcaccacaucucagaagacgaccuggcugccuguucuucugggguccuucggaugcaaaccgcugacaauguuucucaucaccgagaacaagauuuggggcagaaagagcuggccccugaaugaaggcaucauggccguggggauugucucuauccuucuguccagccuccugaaaaacgaugugccucucgcuggaccccugauugccggcgggaugcuuaucgcuuguuacguuaucuccggaagcucugccgaccugagccuggagcgggcggccgagguguccugggaagaggaagcugagcauucuggcgccagccacaauauucucgucgaagugcaggaugacgggacaaugaagaucaaagaugaggagcgcgacgauacccugacgauucuucugaaggcuacccuccuggccgucuccggaguguauccuaugucuauccccgccacacucuucguuugguacuucuggcagaagaagaaacagagaagcggcgugcugugggacaccccuagcccucccgaagucgagcgggcugugcuugaugacggcauuuaucgcauccugcagagagggcugcucggacggucucagguuggcgugggggucuuucaagacggaguguuccauacaauguggcacgugaccagaggcgcgguucugauguaccaggggaaacgccuugaacccagcugggccuccgucaagaaagaucugaucagcuacggaggcggcuggcgguuucaggggucuuggaacacaggagaggaggugcaagugauugcugucgaacccggcaagaauccuaaaaacgugcaaacgacccccgggacauucaagaccccggagggagaaguuggcgccaucgcccucgacuuuaaaccugggaccuccggaagccccauugugaauagagagggcaagaucgucggccuguaugggaacggagugguuacaacgucuggcaccuacguguccgcuauugcccaggcgaaggcuagccaggaagggccucuccccgagaucgaggaugaagucuucaaaaagcgcaaucugacaauuauggaccuucaccccggauccggcaaaacccggagauaucugccugccaucgugcgcgaggccaucaagcggaaacugagaacacucauucuggcuccgacccgcguuguggccucugaaauggcggaggcucuuaaggggaugcccauccgguaccaaacgacagccgucaagagcgaacauaccggcaaagagauuguggaucugaugugccacgccaccuuuacaaugagacuccuguccccugugcggguccccaacuauaauaugaucauuauggacgaggcucauuucaccgauccugccagcaucgcugcccgcggauacaucucuacaagaguuggcaugggggaagcggccgcuauuuuuaugaccgccacgcccccuggauccguggaggcuuucccgcagagcaacgccgugauccaggacgaagaacgggauauucccgaacgcucuuggaauagcggcuaugacuggaucacagauuuuccugggaagaccgucugguucgugcccuccauuaaaucuggaaacgacaucgccaauugucugagaaagaacggcaaacggguuauccagcucagcagaaagacauucgacaccgaguaccaaaagacgaaaaacaaugauugggacuacguggucaccacagauauuuccgagaugggggcuaacuuucgcgcggaccgggugaucgauccuagacgcugccuuaagcccguuauucugaaagacggcccggaacgggugauccuggccggaccuaugcccgucaccgcugccucugccgcucagagacgcggccggauugggagaaaucagaacaaggagggagaucaguauaucuacaugggccaaccccucaauaacgacgaagaucacgcccauuggacagaggcgaaaaugcugcuugacaauauuaacaccccugaggggaucauccccgcucuguucgaaccugagcgcgaaaagagcgccgccauugauggagaguauagacuccggggcgaagcucgcaagacauuuguggagcugaugagaagaggggaccugccggucuggcucuccuacaaaguggccagcgagggcuuccaguauucugaucgcagauggugcuuugacggagaacggaauaaccagguucuugaggaaaauauggacguggagaucuggaccaaggaaggcgagcgcaaaaagcugcgcccccgguggcuggaugcgagaacguacuccgacccucucgcccugcgcgaguucaaagaauuugcugccgggcggagaagcguguccggagaucuuauucuggagaucggcaagcucccccagcaccugacacugcgggcucaaaacgcccucgacaaucuugucaugcugcacaacucugaacaagggggaaaggcuuaucgccaugccauggaggaacugccugauaccauugagacccucaugcugcuugcgcugaucgccguucucacaggcggcgugacccuguucuuucugagcgggaagggacucggcaagacauccaucgggcuucugugugugauggcuucuagcguccugcucuggauggccuccguggagccccacuggauugcugccagcaucauucuggaguucuuucuuaugguucugcucaucccggagccugacagacagcggacgccccaggauaaucaacuggccuacguggucauuggacuccuguucaugauccuuaccguggcugcgaacgaaaugggccugcuggagacaaccaaaaaggaccucgggaucggacaugucguggccgagaaccaccaccaugcuacaaugcuggauauugaccuucacccugccucugccuggacccuguacgcuguugccacgaccaucauuacacccaugaugcgccauaccaucgaaaauacaaccgcgaacauuucccucacggccaucgcuaaucaggccgcuauucugaugggccuggauaaaggcuggccuaucagcaagauggacaucggggugccccuccuugcccugggaugcuauucucaggucaacccgcugacacucaccgcggccgugcugaugcuuguugcucacuacgccauuaucggcccugggcugcaagcuaaagccacaagagaggcucagaagcggaccgccgcgggaauuaugaagaaucccaccguggauggcaucgucgccauugaccucgaccccgugguguaugaugcuaaauuugaaaagcagcuggggcagaucaugcugcucauccuuuguacaucccaaauucugcugaugcgcacgaccugggcccucugcgagagcaucacacuggcuaccggaccucuuacaacccugugggaaggcucuccgggcagauucuggaacacgacaauugccguuagcauggccaauaucuuccggggguccuaccucgcgggagcuggccuggccuuuucucugaugaaaagccucgggggaggccgcagagggaccggagcucagggcgagacccuuggcgagaaguggaaacggcagcugaaccagcuguccaagagcgaguucaauacauauaagagauccgggauuauggaggucgaccgcucugaagccaaagagggaaugaagcggggcgaaaccacaaaacaugccgugagcagagggacggcuaagcuccgcugguuuguggagcggaaccuggucaaacccgagggaaagguuaucgaucuuggcugugggagaggaggcugguccuacuauugcgccggccugaagaaagugaccgaagugaagggguacacaaaaggaggcccugggcacgaggaacccaucccuauggcgaccuacggauggaauauugucaagcuccacucuggccgcgacguguucuuuacacccccugagaaaugugauacccugcugugcgacaucggggaaagcuccccgaaccccacgauugaggagggacggacccucagaguucuuaagaugguggaaccuuggcugcgcggcaaucaauucuguaucaaaauucugaaccccuauaugccuucugucguggagacacucgaacagaugcagcggaagcauggcgggaugcugguuagaaauccccuuagccgcaacuccacccacgagauguacugggugagcugcggaacaggcaauaucgucucugccgugaacaugaccucccggaugcugcucaacagauuuacaauggcucaucgcaagccgaccuaugagagagauguggaccugggggccggaacgcggcacgucgcuguugaaccugagauugccaaucuggauaucaucggccagcgcauugaaaacaucaaaaaugagcacaagagcacauggcauuacgacgaagauaaccccuauaaaaccugggcguaccacgggucuuaugaggugaagcccuccggaagcgccucuuccauggugaauggcgucgugagacuccugaccaaaccuugggacguuauucccauggugacacaaaucgcuaugacggacaccacaccuuucggccagcagcgggucuuuaaggagaagguggauaccagaacaccgcggcccaaacgcgggaccgcccaaauuauggaaguuacagcuaaguggcuuuggggauuccugagcagaaacaaaaagccucggaucuguacccgcgaggaauuuacgagaaaagugcgguccaaugccgcuaucggcgccgucuucguggacgagaaccaguggaauagcgcgaaggaagccguugaggaugagcgcuuuugggaccucgugcauagagaacgggagcugcacaagcaggggaaaugcgcuaccugcgucuacaacaugaugggaaagcgcgagaagaaacuuggcgaguucgggaaagccaaaggcucuagagcuauuugguacauguggcugggagcccgguuccucgaauuugaggcccugggcuucaugaaugaggaucauugguuuagccgcgaaaacucccugucugggguggagggagaaggccuccacaagcugggguauauccuuagagacauuagcaaaauccccggaggcaauauguacgcggaugacacagcugggugggauacccggauuacagaggacgaucugcagaacgaggccaagaucaccgacaucauggaaccugagcacgcccuccuggcuacguccauuuucaaacuuacauaucaaaauaaggucgugcgcguucagagacccgccaaaucuggcaccgugauggaugucaucagccggagagaccagcgcggauccggccagguggggacauacggacugaacaccuuuacgaacauggaagugcaacucauucggcagauggagucugaaggcaucuucagcccguccgagcuggagaauagcaaccuggcugaaagaguucucgacuggcuggagaagcaugggguggaacgccuuaaacggauggccauuucuggagaugacugugucgugaagccuaccgaugacagauuugcgacagcccugaccgcucucaaugauaugggcaagguucgcaaagacaucccccagugggagccuuccaagggguggaacgauuggcagcaagugcccuucugcagccaccauuuucaccagcugaucaugaaagacggccgggaaauugucgugccuuguagaaaucaggaugagcuugucggacgcgcccgggugucucagggcgcuggguggucccugagagagacagccugccucggaaagagcuaugcgcaaauguggcagcugauguacuuccaccgccgggaccugagacucgccgcuaacgccaucuguuccgcuguucccgugaauugggucccgaccucucggacaaccuggagcauucaugcccaccaucaguggaugacgacagaagauaugcuguccguguggaacagaguuuggaucgaggaaaauccuuggauggaggacaaaacccacgugagcucuugggaagacguccccuaucuuggcaagcgcgaggaucaauggugcgggucccugauuggacucaccgcucgggccacaugggcgaccaacauccagguggccauuaaucaggugagacgccugaucggcaacgagaauuaccuugacuacaugacaagcaugaagagauuuaaaaacgaaucugaucccgagggggcucugugguga

SEQ ID NO: 19480 - RNA, 9879 nt, Artificial Sequence
  derived and/or modified CDS sequence (opt5) from DENV-1__KM403602__SS-prME
agcgugaccaugcugcucaugcugcuucccacagcucuggcuuuccaccucacgaccagaggcggggaaccucauaugaucgucuccaagcaggaacggggaaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaagaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgccauuacccucgacuguagcccccggacaggccuggauuucaacgaaauggugcuucugaccaugaaggagaaaucuuggcucguccauaagcagugguuucuggaccuuccucugcccuggacguccggggcuagcacaucccaagagaccuggaaucgccaggaucuccuggugacauucaaaaccgcgcacgccaagaagcaggaagucgugguucugggaucucaagagggcgcuaugcacaccgcccucacaggggccacggaaauccagaccagcggaacaaccacaauuuuugcuggccaucugaaaugcagacuuaagauggacaaacugacccucaaggggguguccuaugucauguguacgggcagcuucaaacuggagaaggaaguggccgagacacagcacggaaccguucuggugcaggucaaguacgagggcaccgaugcgccgugcaaaaucccuaucucuacacaagacgaaaagggggugacccagaacggacggcuuauuacagcuaaucccaucgugacggauaaagagaagccuguuaacauugaaaccgagccgcccuucggcgaguccuauaucgucauuggggccggagaaaaagcccucaagcugagcugguuuaagaaaggcucuagcaucgggaagauguucgaggcuacagccagaggcgcucgccggauggccauccugggagacaccgcgugggauuuuggcuccauugggggaguguucacaucugugggcaaacucguccaucagguguuugggaccgccuacggaguucuguucagcggcguguccuggacgaugaagaucgggauuggcauccuucugaccuggcucggacugaauagcagaucuacaucccugagcaugaccuguauugcugucggcauggugacacuuuaccucgggguuauggugcaggccgacucuggaugcgucaucaacuggaaaggccgcgaacugaaguguggguccggaauuuuugugaccaacgagguucacacauggaccgaacaauauaaguuccaggcugauagcccuaaacggcuguccgccgcgaucggcaaggccugggaggagggggugugcggcaucagaucugcuacgcgccucgaaaauauuauguggaaacagaucagcuccgagcugaaccauauucuucuggaaaaugacaugaaguuuacagucguggugggagacgccaacggcauccucacccaggggaaaaagaugauucggccgcaacccauggagcacaaauacucuuggaaaagcuggggaaaggcuaaaaucaucggcgccgauacccagaauacaaccuucauuaucgacgggccugauacgcccgaauguccugacgaucagagagccuggaacauuugggaggucgaggacuauggauuuggcguuuucacaaccaauaucuggcugaagcugcgcgauuccuacacacagaugugcgaccaccggcuuaugagcgcugcgauuaaagauucuaaggccgugcaugcugacaugggcuauuggaucgaauccgagaaaaacgaaaccuggaagcucgccagagccagcuuuaucgaggugaagacauguauuuggccccgcucucacacccugugguccaaugggguccuggaaagcgagaugaucauuccgaaaaucuacggaggcccuauuucucaacauaacuaucggcccggguacuucacgcagaccgcuggaccuuggcaccucggcaagcuggagcuugauuucaaucugugcgaagggacaaccgugguuguggacgagcacugcggaaacagaggccccagccuccggacaaccacggucacaggcaaaaucauccaugaaugguguugccgcuccuguacccugccuccccugagauuuagaggggaagauggaugcugguacggcauggagauucggccggugaaggaaaaagaggaaaaucuuguucgcagcauggugucugccggguccggagaggucgacagcuucucccucggccugcugugugugucuaucaugauugaagagguuaugcggagcagaugguccaagaagaugcucaugacagggacccuggcgguguuuuuccuucugaucaugggacagcucaccuggaacgaccugauucgccugugcaucauggucggcgcuaaugugucugauagaaugggcauggggacaacguaucuugcccugauggccaccuuuaaaaugcggccuauguucgcugugggacuccuguuucgcagacucacaagccgggagguccugcuucugaccauuggccucucccugguugccucuguggaacugcccaacagccuugaggaacugggggacggacucgcgaugggcaucaugaugcugaagcuccugacagauuuccaaucccaccagcuuuggaccacgcugcucagccugacauuuaucaaaaccacccugucucuugacuacgcuuggaagacaauggccauggugcuguccauugucagccucuucccccugugucucucuaccacaucccagaaaacgaccuggcugccugugcuucuggggagcuuuggaugcaagccgcugacaauguuccucaucaccgagaacaagauuuggggccgcaaaucuuggccccugaaugaaggcaucauggccguugggauuguguccauccuucugagcucccuccugaagaacgaugucccucucgcuggaccccugaucgccggcgggaugcuuauugcuuguuaugugaucagcggaucuagcgccgaccugucccuggagagagcggccgagguuucuugggaagaggaagcugagcauagcggcgccucccacaauauucucguggaaguccaggaugacgggacaaugaaaaucaaggaugaggagcgggacgauacccugacgauucuucugaaagcuacccuccuggccgugucuggagucuacccuaugagcauccccgccacacucuuugugugguauuucuggcaaaagaaaaagcagcgcuccggcguucugugggacaccccuucucccccggaaguggagagagcuguccuugaugacggcaucuaccggauucugcagcgcgggcugcucggaagaagccaggugggcguugggguguuccaagacggagucuuucauacaauguggcacgugacccggggcgcggugcugauguaucaggggaagagacuugaaccuuccugggccagcguuaaaaaggaucugaucucuuacggaggcggcuggcgcuuccagggguccuggaacacaggagaggagguccaggugauugcuguggaacccggcaaaaauccuaagaacguccaaacgacccccgggacauuuaaaaccccggagggagaagugggcgccaucgcccucgacuucaagccugggaccagcggaucucccauuguuaaucgggagggcaagaucgugggccuguacgggaacggagucgugacaacguccggcaccuauguuagcgcuauugcccaggcgaaggcuucccaggaagggccucuccccgagaucgaggaugaaguguuuaagaaaagaaaucugacaaucauggaccuucaccccggaucuggcaagacccgccgguaccugccugccauugucagagaggccaucaaacgcaagcugcggacacucauucuggcuccgaccagagugguugccagcgaaauggcggaggcucuuaaggggaugcccauccgcuaucaaacgacagccgugaaauccgaacauaccggcaaggagauugucgaucugaugugccacgccaccuucacaaugcggcuccugagcccugugagagugcccaacuacaauaugaucaucauggacgaggcucauuuuaccgauccugccucuauugcugcccggggauauaucuccacacgcgucggcaugggggaagcggccgcuauuuucaugaccgccacgcccccuggaagcguugaggcuuuuccgcagucuaacgccgugauccaggacgaagagagagauauucccgaacggagcuggaacuccggcuacgacuggaucacagauuucccugggaaaaccgugugguuuguccccucuaucaagagcggaaacgacauugccaauugucugcgcaaaaacggcaagagagugauccagcucucccggaagacauucgacaccgaguaucagaagacgaagaacaaugauugggacuacguugugaccacagauauuucugagaugggggcuaacuucagagcggaccgcgucaucgauccucggagaugccuuaaacccgugauucugaaggacggcccggaacgcguuauccuggccggaccuaugcccgugaccgcugccagcgccgcucagcggagaggccgcauugggcggaaucagaacaaagagggagaucaguacaucuauaugggccaaccccucaauaacgacgaagaucacgcccauuggacagaggcgaagaugcugcuugacaauaucaacaccccugaggggauuauccccgcucuguuugaaccugagagagaaaaguccgccgccauugauggagaguaccgccucagaggcgaagcucggaaaacauucgucgagcugaugcgcagaggggaccugccgguguggcucagcuauaaggucgccucugagggcuuucaguacuccgaucggcgcuggugcuucgacggagaaagaaauaaccaggugcuugaggaaaauauggacguugagaucuggaccaaagaaggcgagcggaagaaacugagaccccgcuggcuggaugcgcggacguauagcgacccucucgcccugagagaguuuaaggaguucgcugccgggcgccgguccgugucuggagaucuuauucuggagaucggcaaacucccccagcaccugacacugagagcucaaaacgcccucgacaaucuugugaugcugcacaacagcgaacaagggggaaaggcuuaccggcaugccauggaggaacugccugauaccaucgagacccucaugcugcuugcgcugauugccguccucacaggcggcguuacccuguuuuuccuguccgggaagggacucggcaaaacaucuaucgggcuucugugugugauggcuagcuccgugcugcucuggauggccagcgucgagccccacuggauugcugccucuaucauucuggaauuuuuccuuauggugcugcucaucccggagccugaccgccagagaacgccccaggauaaucaacuggccuauguugugaucggacugcucuuuaugauucuuaccgucgcugcgaacgaaaugggccugcuggagacaaccaagaaagaccucgggaucggacauguggucgccgagaaccaccaccaugcuacaaugcuggauauugaccuucacccugccuccgccuggacccuguacgcuguggccacgaccaucauuacacccaugaugcggcauaccaucgaaaauacaaccgcgaacauuagccucacggccaucgcuaaucaggccgcuauccugaugggccuggauaagggcuggccuauuucuaaaauggacaucgggguuccccuccuugcccugggaugcuacucccaggugaacccgcugacacucaccgcggccguccugaugcuuguggcucacuaugccauuaucggcccugggcugcaagcuaaggccacacgcgaggcucagaagagaaccgccgcgggaauuaugaaaaaucccaccguugauggcaucguggccaucgaccucgaccccgucguguacgaugcuaaguucgaaaaacagcuggggcagauuaugcugcucauccuuuguacaagccaaauucugcugaugcggacgaccugggcccucugcgagucuaucacacuggcuaccggaccucuuacaacccugugggaaggcagcccgggcaaguuuuggaacacgacaauugccguguccauggccaauaucuuccgcgggucuuaucucgcgggagcuggccuggccuucagccugaugaaaucccucgggggaggcagacgggggaccggagcucagggcgagacccuuggcgagaaguggaagcgccagcugaaccagcugagcaaauccgaauuuaauacauacaagagaucugggaucauggagguugaccggagcgaagccaaagagggacucaagagaggcgaaaccacaaaacaugccgucucccgcgggacggcuaagcugcggugguucguggagagaaaccuugugaagcccgagggaaaagucauugaucugggcugugggcgcggaggcuggucuuauuacugcgccggccucaagaaaguuaccgaagugaagggguauacaaaaggaggcccugggcacgaggaacccaucccuauggcgaccuacggauggaauauugugaagcugcacagcggccgggacgucuuuuucacacccccugagaaaugugauacccugcucugcgacaucggggaauccucuccgaaccccacgauugaggagggaagaacccuucgcgugcugaagaugguugaaccuuggcugcggggcaaucaauuuuguaucaagauucucaaccccuacaugccuagcguggucgagacacuggaacagaugcagagaaaacauggcgggaugcuugugcgcaauccccugucccggaacagcacccacgagauguauuggguuucuugcggaacaggcaauaucguguccgccgucaacaugaccagcagaaugcuccugaaccgcuucacaauggcucaucggaagccgaccuacgagagagauguggaccugggggccggaacgcgccacguggcugucgaaccugagaucgccaaucucgauauuaucggccagagaauugaaaacaucaaaaaugagcacaagucuacauggcauuaugacgaagauaaccccuacaaaaccugggcguaucacggguccuacgagguuaagcccagcggaucugccuccagcauggugaauggcgugguccggcugcuuaccaagccuugggacgugauucccaugguuacacaaaucgcuaugacggacaccacaccuuuuggccagcagcgcguguucaaagagaaggucgauaccagaacaccgcggcccaaaagagggaccgcccaaaucauggaagugacagcuaaguggcuguggggauuucucucccggaacaaaaagccucgcauuuguaccagagaggaguucacgcggaagguucgcagcaaugccgcuaucggcgccguguuugucgacgagaaccaguggaacucugcgaaagaagccguggaggaugagagauucugggaccugguucaucgggaacgcgagcuucacaagcaggggaaaugcgcuaccugcguguauaacaugaugggaaagagagagaagaaacugggcgaguuugggaaggccaaaggcagccgggcuauuugguacauguggcucggagcccgcuuccuggaguucgaggcccugggcuuuaugaaugaggaucauugguucuccagagaaaacucucucagcggggucgagggagaaggccugcacaaacuuggguacauccugcgggacauuuccaaaauccccggaggcaauauguaugcggaugacacagcugggugggauacccgcaucacagaggacgaucuccagaacgaggccaagauuaccgacaucauggaaccugagcacgcccugcuugcuacgucuauuuuuaaacugacauaccaaaauaagguggucagagugcagcggcccgccaaaagcggcaccguuauggaugugaucucccgcagagaccagcggggaucuggccaggucgggacauauggacucaacaccuucacgaacauggaagugcaacugauuagacagauggagagcgaaggcaucuuuuccccgagcgagcuggaaaauucuaaccucgcugaacgcgugcuggacuggcuugagaagcaugggguugaacggcugaagagaauggccaucuccggagaugacuguguggucaaaccuaccgaugaccgcuucgcgacagcccucaccgcucugaaugauaugggcaaggugcggaaagacauuccccagugggagccuagcaagggguggaacgauuggcagcaaguucccuuuugcucucaccauuuccaccagcuuaucaugaaagacggcagagaaauuguggucccuugucgcaaucaggaugagcuggugggacgggccagagucucccagggcgcuggguggagccuccgcgagacagccugccugggaaaguccuacgcgcaaauguggcagcugauguauuuucaccggagagaccuccgccuggccgcuaacgccaucuguucugcugugcccguuaauugggugccgaccagccggacaaccugguccauucaugcccaccaucaguggaugacgacagaagauaugcuuagcgucuggaacagaguguggaucgaggaaaauccuuggauggaggacaagacccacguuucuuccugggaagacgugcccuaccugggcaaacgggaggaucaauggugcgggagccucauuggacugaccgcuagagccacaugggcgaccaacauccaggucgccaucaaucaggugcgccggcuuauuggcaacgagaauuaucuggacuacaugacaucuaugaagagauucaaaaacgaaagcgaucccgagggggcucucugguga

SEQ ID NO: 19481 - RNA, 9879 nt, Artificial Sequence
  derived and/or modified CDS sequence (opt5) from DENV-1__KM403582__SS-prME
agcgugaccaugcugcucaugcugcuucccaccgcucuggcuuuccaccucacgacccggggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccgcgcaucacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaggagaaaucuuggcugguccauaagcagugguuucuugaccugccucuccccuggacguccggggcuagcacaucccaagagaccuggaaucggcaggaucugcuggugacauucaaaaccgcgcacgccaagaaacaggaagucgugguucucggaucucaagagggcgcuaugcacaccgcccugacaggggccacggaaauucagaccagcggaacaaccacaaucuuugcuggccaucuuaagugcagacugaagauggacaaacucacccugaaggggguguccuaugucauguguacgggcagcuucaaacuggagaaggaaguggccgagacacagcacggaaccguucuugugcaggucaaauacgagggcaccgaugcgccgugcaagauuccuaucucuacacaagacgaaaagggggugacccagaacggacgccucaucacagcuaaucccauugugacggauaaagagaagccuguuaacaucgaaaccgagccgcccuucggcgaguccuauauugucaucggggccggagaaaaagcccugaagcugagcugguuuaaaaagggcucuagcauugggaagauguucgaggcuacagcccggggcgcuagacgcauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagccggucuacaucccuuagcaugaccuguaucgcugucggcauggugacacucuaccuggggguuauggugcaggccgacucuggaugcgucauuaacuggaaaggcagagaacugaaguguggguccggaaucuuugugaccaacgagguucacacauggaccgaacaauauaaauuccaggcugauagcccuaagcgccucuccgccgcgauuggcaaggccugggaggagggggugugcggcauccggucuacgacaagacuggaaaauaucauguggaaacagauuagcaacgagcuuaaucauauccugcucgaaaacgacaugaaguuuaccgucguggugggagacgcuaauggcauucugacccaggggaaaaagaugauccgcccgcaacccauggagcacaaauacuccuggaagucuuggggaaaagccaagauuaucggcgcugauacacagaacaccacguucaucauugacgggccugauacacccgaauguccugacgaucagcgggccuggaauaucugggaggucgaggacuauggauuuggcguuuucaccacaaacauuuggcugaaacuuagagauagcuacacccagaugugcgaccaccgccucauguccgccgcuaucaaagauagcaaggcggugcaugccgacaugggcuauuggauugaaucugagaaaaaugaaacauggaagcuggcucgggccuccuuuaucgaggugaaaaccuguaucuggcccagaagccacacgcuguggucuaacgggguccucgaauccgagauggugauuccgaagaucuacggaggcccuauuagccaacauaauuaucggcccggguacuucacccagacagccggaccuuggcaccugggcaaacuugagcuggauuucaaccucugcgaagggaccacaguuguggucgacgagcacugcggaaaucgcggccccucucugagaaccacgacagugaccggcaaaaucauucaugaaugguguugccggagcuguacacugccuccccuuagauuucgcggggaggauggaugcugguacggcauggagauccggccgguuaaggaaaaagaggaaaaccucgugagauccauggucagcgcugggucuggagagguggacuccuucagccugggccugcucuguguuuccaucaugauugaagaggugaugcgcucuagauggagccggaagaugcugaugaccgggacccuugccaucuuuuuccugcucauuaugggacagcugacauggaaugaccugauccgccuuugcauuauggucggcgcgaacguguccgauagaaugggcauggggacgaccuaucuggcucucauggccacauuuaaaaugcggccuauguucgccgugggacugcucuuucgcagacugaccucucgggagguccuucugcucacaaucggccugagccugguugcuuccguggaacuucccaacucucuggaggaacucggggacggacuggccaugggcauuaugaugcucaagcugcuuaccgauuuccaaagccaccagcuguggacgacacuccugucccugaccuuuaucaagaccacacuuagccuggacuacgcguggaaaaccauggcuauggugcucucuaucgucucccuguucccccucugucugagcacaacgucucagaagaccacauggcuuccugugcugcugggguccuuuggaugcaaaccgcucaccauguuccugauuacagagaauaagaucuggggccgcaaaagcuggccccuuaacgaaggcauuauggccguugggaucgugucuauucugcucuccagccugcucaagaaugaugucccucuggccggaccccuuaucgcuggcgggaugcugaucgccuguuaugugauuuccggaagcucugcugaccugagccucgagagagccgcggagguuuccugggaagaggaagccgagcauucuggcgcuagccacaacauccugguggaaguccaggaugacgggaccaugaagauuaaagaugaggagcgggacgauacgcuuaccauccugcucaaggccacacugcucgcuguguccggagucuacccuaugucuauucccgccacccuguuugugugguauuucuggcagaagaagaaacagcgcagcggcguucuuugggacacaccuagcccucccgaaguggagagagccguccuggaugacggcaucuaccggauccugcagagagggcuccugggacgcucucaggugggcguugggguguuccaagacggagucuuucauaccauguggcacgugacacggggcgcugugcuuauguaucaggggaagagacuggaacccagcugggcguccguuaaaaaggaucucauuagcuacggaggcggcuggcgcuuccaggggucuuggaauacgggagaggagguccaggugaucgccguggaacccggcaagaacccuaaaaauguccaaaccacacccgggaccuuuaagaccccggagggagaagugggcgcuauugcccuggacuucaaaccugggacauccggaagccccaucguuaaccgggagggcaagauugugggccucuacgggaauggagucgugacgaccucuggcacauauguuuccgccaucgcucaggccaaagcgagccaggaagggccucugcccgagauugaggaugaaguguuuaagaagagaaaccuuaccaucauggaccugcaccccggauccggcaaaacacgccgguaccugccugcuaucgucagagaggccauuaagcgcaaacuccggacccugauccuugccccgacgagagugguugcuucugaaauggccgaggcgcugaaggggaugcccauucgguaucaaacaaccgcugugaaaagcgaacauaccggcaaggagaucgucgaucucaugugccacgccacauucaccaugcgccugcuguccccugugagagugcccaauuacaacaugauuaucauggacgaggcccauuuuacagauccugcuagcaucgccgcucggggauauauuucuacccgcgucggcaugggggaagccgcggccaucuucaugacggcuacacccccuggauccguugaggccuuuccgcagagcaaugcugugauucaggacgaagagagagauauccccgaacggucuuggaacagcggcuacgacuggauuaccgauuucccugggaagacagugugguuuguccccuccaucaaaucuggaaaugacaucgccaacugucucagaaagaacggcaaacgcgugauucagcuuagccggaagaccuucgacacggaguaucagaagaccaagaauaacgauugggacuacguugugacaaccgauaucuccgagaugggggccaauuucagagcugaccgcgucauugauccucggagaugccugaagcccgugauccugaaagacggcccggaacgcguuauucucgcgggaccuaugcccgugacagccgcuucugccgcccagcggagaggccgcaucgggagaaaccagaauaaggagggagaucaguacauuuauaugggccaaccccugaacaaugacgaagaucacgcucauuggaccgaggccaaaaugcuucuggacaacaucaauacaccugaggggaucauucccgcgcucuuugaaccugagcgggaaaagagcgcugccaucgauggagaguaccgccugagaggcgaagcccggaaaaccuucgucgagcugaugcgcagaggggaccucccgguguggcuuuccuauaaggucgcuagcgagggcuuucaguacucugaucggagauggugcuucgacggagaacgcaacaaucaggugcuggaggaaaacauggacguugagauuuggacgaaggaaggcgagcggaaaaagcugagaccccgcuggcucgaugcccggacauauuccgacccucuggcgcuuagagaguuuaaagaguucgccgcugggcggcgcagcguguccggagaucugauccucgagauuggcaagcugccccagcaccugacccucagagcccaaaaugcucuugacaaccuggugaugcugcacaauucugaacaagggggaaaagccuaccggcaugcuauggaggaacucccugauaccaucgagacacugaugcuucuggcccucaucgcgguccugaccggcggcguuacacuguuuuuccucagcgggaagggacuuggcaaaacguccauugggcugcugugugugauggccucuagcgugcuccuguggauggcuuccgucgagccccacuggaucgccgcuagcauuauccuugaauuuuuccugauggugcuccugauuccggagccugaccgccagagaacaccccaggauaaccaacuggccuauguugugaucggacuccuuuuuaugauccugacagucgccgcuaacgaaaugggccugcucgagaccacaaagaaggaccuggggauuggacauguggucgcggagaaucaccaccaugccaccaugcuugauaucgaccugcacccugcuucugccuggacgcucuacgccguggcuaccacaauuaucacccccaugaugcggcauacaauugaaaacaccacggccaauaucucccugacagcgauugccaaccaggcugccauccugaugggccucgauaaaggcuggccuaucagcaagauggacauugggguuccccuucuggcucugggaugcuacucucaggugaauccgcucacccugacagccgcgguccuuaugcugguggcccacuaugcuaucauuggcccugggcuccaagccaaagcuacccgcgaggcccagaagagaaccgcugccggaaucaugaaaaaccccacaguugauggcauuguggcgaucgaccuggaccccgucguguacgaugccaaguucgaaaagcagcuggggcagaucaugcuccuuauucuguguacgucccaaauccugcucaugcggaccacaugggcucugugcgagagcauuacccuugccacaggaccucugaccacgcucugggaaggcucuccgggcaaauuuuggaauacaaccaucgcugugagcauggccaacauuuuccgcggguccuaucuggccggagcgggccuggcuuucucucucaugaagucccuugggggaggcagacgggggaccggagcccagggcgagacacugggcgagaaauggaagagacagcugaaucagcucuccaaaagcgaauuuaacaccuacaagcgcuccgggaucauggagguugaccggucugaagcuaaggagggacugaaaagaggcgaaacaacgaagcaugccgucagccgcgggaccgccaaacuucggugguucguggagagaaaucuggugaagcccgagggaaaagucaucgaucucggcugugggcgcggaggcugguccuauuacugcgcuggccugaagaagguuacagaagugaaaggguauaccaagggaggcccugggcacgaggaacccauuccuauggccacauacggauggaacaucgugaaacugcacucuggccgggacgucuuuuucacgcccccugagaagugugauacccuccuuugcgacauuggggaaagcuccccgaaucccaccaucgaggagggaagaacacugcgcgugcugaaaaugguugaaccuuggcuccggggcaaccaauuuuguauuaagauccugaaucccuacaugccuucuguggucgagacccuugaacagaugcagagaaaacauggcgggaugcuggugcgcaacccccucagcagaaauuccacacacgagauguauuggguuagcugcggaaccggcaacauugugucugcggucaacaugacauccagaaugcugcugaaucgcuucaccauggcccauagaaagccgacguacgagcgggauguggaccucggggcuggaacacgccacguggccgucgaaccugagaccgcuaaccuggauaucaucggccagagaauugaaaauaucaagaacgagcacaaaagcaccuggcauuaugacgaagauaaucccuacaagacaugggccuaucacgggucuuacgagguuaaacccuccggaagcgcgucuuccauggugaacggcgugguccggcuucugacgaagccuugggacgugauucccaugguuacccaaaucgccaugacagacaccacaccuuuuggccagcagagaguguucaaagagaaggucgauacccggacaccgcgccccaagagagggaccgcucaaauuauggaagugacggccaaauggcucuggggauuucugagccggaauaagaaaccucgcaucuguaccagagaggaguucacacggaagguucgcuccaacgcugccaucggcgcuguguuugucgacgagaaucaguggaacagcgccaaagaagcgguggaggaugagagauucugggaccuuguucaucgggaacgcgagcugcacaagcaggggaagugcgcuaccugcguguauaauaugaugggaaaaagagaaaagaaacucggcgaguuugggaaggccaaaggcucucgggccauuugguacauguggcugggagcucgcuuccuggaguucgaggcccucggcuuuaugaacgaggaucauugguucagcagagaaaauucccugucuggggucgagggagaaggccuucacaagcugggguacauccuccgggacauuagcaagauccccggaggcaacauguaugccgaugacacagcggggugggauacccgcauuacggaggacgaucugcagaaugaggcuaaaaucacagacaucauggaaccugagcacgcccuucuggccaccuccauuuuuaagcucacauaccaaaacaaaguggucagagugcagcggcccgcuaagucuggcaccguuauggaugugaucagcagacgcgaccagcggggauccggccaggucgggacguauggacugaacaccuucacaaauauggaagugcaacugauuagacagauggagucugaaggcaucuuuagcccguccgagcucgagaacagcaaucuggccgaacgcgugcuugacuggcuggagaaacaugggguugaacggcucaagagaauggcuauuucuggagaugacuguguggucaaaccuaccgaugaccgcuucgccacagcgcugaccgcccuuaacgauaugggcaaggugcggaaggacaucccccagugggagccuuccaaaggguggaaugauuggcagcaaguucccuuuugcagccaccauuuccaccagcugaucaugaaggacggcagagaaauuguggucccuugucgcaaccaggaugagcucgugggacgggcuagagucucucagggcgccggguggucccugcgcgagacagcuugccugggaaaaagcuacgcccaaauguggcagcucauguauuuucaccggagagaccugcggcuugcggccaaugcuaucuguuccgccgugcccguuaacugggugccgaccucuagaacgacauggagcauucaugcucaccaucaguggaugaccaccgaagauaugcuguccgucuggaaucgcguguggaucgaggaaaacccuuggauggaggacaagacacacguuagcucuugggaagacgugcccuaccucggcaaacgggaggaucaauggugcgggucccugauuggacuuaccgccagagcuacaugggccacgaauauccaggucgcgauuaaccaggugcgcagacugaucggcaaugagaacuaucucgacuacaugaccagcaugaagcgguucaagaaugaaucugaucccgagggggcccugugguga

SEQ ID NO: 19482 - RNA, 9879 nt, Artificial Sequence
  derived and/or modified CDS sequence (opt5) from DENV-1__KM403577__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagaacaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggguguccuaugucauguguacgggcagcuucaaacuggagaaggaaguggccgagacacagcacggaaccguucuggugcaggucaaguacgagggcaccgaugcgccgugcaaaauuccuaucucuacacaagacgaaaagggggugacccagaacggacggcuuaucacagcuaaucccauugugacggauaaagagaagccuguuaacaucgaaaccgagccgcccuuuggcgaguccuauauugucaucggggccggagaaaaagcccucaagcugagcugguucaagaaaggcucuagcauugggaagauguuugaggcuacagccagaggcgcucgccggauggccauccugggagacaccgcgugggauuucggcuccaucgggggaguguuuacaucugugggcaaacucguccaucagguguucgggaccgccuacggaguucuguuuagcggcguguccuggacgaugaagauugggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcuguccgccgcgauuggcaaggccugggaggagggggugugcggcaucagaucugcuacgcgccucgaaaauaucauguggaaacagauuagcaacgagcugaaucauauccuucuggaaaacgacaugaaguucacagucguggugggagacgccaauggcauucucacccaggggaaaaagaugauccggccgcaacccauggagcacaaauacuccuggaagucuuggggaaaggcuaaaauuaucggcgccgauacccagaacacaaccuuuaucauugacgggccugauacgcccgaauguccugacgaucagagagccuggaauaucugggaggucgaggacuauggauucggcguuuuuacaaccaacauuuggcugaagcugcgcgauagcuacacacagaugugcgaccaccggcuuauguccgcugcgaucaaagauagcaaggccgugcaugcugacaugggcuauuggauugaaucugagaaaaaugaaaccuggaagcucgccagagccuccuucaucgaggugaagacauguaucuggccccgcagccacacccuguggucuaacgggguccuggaauccgagaugauuaucccgaaaauuuacggaggcccuaucagccaacauaauuaucggcccggguacuucacgcagaccgcuggaccuuggcaccucggcaagcuggagcuugauuuuaaccugugcgaagggacaaccgugguuguggacgagcacugcggaaauagaggccccucucuccggacaaccacggucacaggcaaaauuauccaugaaugguguugccgcagcuguacccugccuccccugagauucagaggggaagauggaugcugguacggcauggagaucagaccggugaaggaaaaagaggaaaaccuuguucgcuccauggugagcgccgggucuggagaggucgacuccuuuagccucggccugcuguguguguccauuaugaucgaagagguuaugcggucuagauggagccgcaagaugcucaugacagggacccuggcgguguucuuucuucugauuaugggacagcucaccuggaaugaccugaucagacugugcauuauggucggcgcuaacguguccgaucggaugggcauggggacaacguaucuugcccugauggccaccuucaagaugcgcccuauguuugcugugggacuccuguucagacggcucacaucucgcgagguccugcuucugaccaucggccucagccugguugccuccguggaacugcccaacucucuugaggaacugggggacggacucgcgaugggcauuaugaugcugaaacuccugacagauuuucaaagccaccagcuuuggaccacgcugcucucccugacauucaucaagaccacccugagccuugacuacgcuuggaaaacaauggccauggugcugucuaucgucucccucuuuccccugugucucagcaccacaucucagaagacgaccuggcugccugugcuucugggguccuucggaugcaaaccgcugacaauguuucucauuaccgagaauaagaucuggggcagaaagagcuggccccugaacgaaggcauuauggccguugggaucgugucuauucuucuguccagccuccugaaaaaugaugucccucucgcuggaccccugaucgccggcgggaugcuuaucgcuuguuaugugauuuccggaagcucugccgaccugagccuggagcgggcggccgagguuuccugggaagaggaagcugagcauucuggcgccagccacaacauccucguggaaguccaggaugacgggacaaugaagauuaaagaugaggagcgcgacgauacccugacgauccuucugaaggcuacccuccuggccguguccggagucuacccuaugucuauucccgccacacucuucgugugguauuucuggcagaagaagaaacagagaagcggcguucugugggacaccccuagcccucccgaaguggagcgggcuguccuugaugacggcaucuaccgcauccugcagagagggcugcucggacggucucaggugggcguugggguguuucaagacggagucuuccauacaauguggcacgugaccagaggcgcggugcugauguaucaggggaaacgccuugaacccagcugggccuccguuaagaaagaucugauuagcuacggaggcggcuggcgguuucaggggucuuggaauacaggagaggagguccaggugaucgcuguggaacccggcaagaacccuaaaaauguccaaacgacccccgggacauucaagaccccggagggagaagugggcgccauugcccucgacuuuaaaccugggaccuccggaagccccaucguuaacagagagggcaagauugugggccuguacgggaauggagucgugacaacgucuggcaccuauguuuccgcuaucgcccaggcgaaggcuagccaggaagggccucuccccgagauugaggaugaaguguucaaaaagcgcaaccugacaaucauggaccuucaccccggauccggcaaaacccggagauaccugccugccaucguccgcgaggccauuaagcggaaacugagaacacucauccuggcuccgacccgcgugguugccucugaaauggcggaggcucuuaaggggaugcccauucgguaucaaacgacagccgugaaguccgaacauaccggcaaagagaucgucgaucugaugugccacgccaccuuuacaaugagacuccuguccccugugcgggugcccaauuacaacaugauuaucauggacgaggcucauuucaccgauccugccagcaucgcugcccgcggauauauuucuacaagagucggcaugggggaagcggccgcuaucuuuaugaccgccacgcccccuggauccguugaggcuuucccgcagagcaaugccgugauucaggacgaggaacgggauauccccgaacgcucuuggaacagcggcuacgacuggauuacagauuuuccugggaagaccgugugguucguccccuccaucaaaucuggaaaugacaucgccaacugucugagaaagaacggcaaacgggugauucagcucagcagaaagacauucgacaccgaguaucaaaagacgaaaaauaacgauugggacuacguugugaccacagauaucuccgagaugggggcuaauuuucgcgcggaccgggucauugauccuagacgcugccuuaagcccgugauccugaaagacggcccggaacggguuauucuggccggaccuaugcccgugaccgcugccucugccgcucagagacgcggccggaucgggagaaaccagaauaaggagggagaucaguacauuuauaugggccaaccccucaacaaugacgaagaucacgcccauuggacagaggcgaaaaugcugcuugacaacaucaauaccccugaggggaucauucccgcucuguucgaaccugagcgcgaaaagagcgccgccaucgauggagaguacagacuccggggcgaagcucgcaagacauuugucgagcugaugagaagaggggaccugccgguguggcucuccuauaaagucgccagcgagggcuuccaguacucugaucgcagauggugcuuugacggagaacggaacaaucaggugcuugaggaaaacauggacguugagauuuggaccaaggaaggcgagcgcaaaaagcugcgcccccgguggcuggaugcgagaacguauuccgacccucucgcccugcgcgaguucaaagaauuugcugccgggcggagaagcguguccggagaucuuauccuggagauuggcaagcucccccagcaccugacacugcgggcucaaaaugcccucgacaaccuugugaugcugcacaauucugaacaagggggaaaggcuuaccgccaugccauggaggaacugccugauaccaucgagacccucaugcugcuugcgcugaucgccguccucacaggcggcguuacccuguucuuucugagcgggaagggacucggcaagacauccauugggcuucugugugugauggcuucuagcgugcugcucuggauggccuccgucgagccccacuggaucgcugccagcauuauccuggaguucuuucuuauggugcugcucauuccggagccugacagacagcggacgccccaggauaaccaacuggccuauguugugaucggacuccuguucaugauccuuaccgucgcugcgaacgaaaugggccugcuggagacaaccaaaaaggaccucgggauuggacauguggucgccgagaaucaccaccaugcuacaaugcuggauaucgaccuucacccugccucugccuggacccuguacgcuguggccacgaccauuaucacacccaugaugcgccauaccauugaaaacacaaccgcgaauaucucccucacggccauugcuaaccaggccgcuauccugaugggccuggauaaaggcuggccuaucagcaagauggacauugggguuccccuccuugcccugggaugcuacucucaggugaauccgcugacacucaccgcggccguccugaugcuuguggcucacuaugccaucauuggcccugggcugcaagcuaaagccacaagagaggcucagaagcggaccgccgcgggaaucaugaagaaccccaccguugauggcauuguggccaucgaccucgaccccgucguguacgaugcuaaauuugaaaagcagcuggggcagaucaugcugcucauucuuuguacaucccaaauccugcugaugcgcacgaccugggcccucugcgagagcauuacacuggcuaccggaccucuuacaacccugugggaaggcucuccgggcaaauucuggaauacgacaaucgccgugagcauggccaacauuuucagaggguccuaucucgcgggagcuggccuggccuuuucucugaugaaaagccucgggggaggccggcgcgggaccggagcucagggcgagacccuuggcgagaaauggaagagacagcugaaucagcuguccaagagcgaguucaacacauacaaacgguccgggaucauggagguugacagaucugaagccaaggagggacucaaacgcggcgaaaccacaaagcaugccgucagccgggggacggcuaaacugagaugguuuguggagcgcaaucuugugaagcccgagggaaaggucaucgaucugggcugugggcggggaggcugguccuauuacugcgccggccucaaaaagguuaccgaagugaaaggguauacaaagggaggcccugggcacgaggaacccauuccuauggcgaccuacggauggaacaucgugaaacugcacucuggcagagacgucuucuuuacacccccugagaagugugauacccugcucugcgacauuggggaaagcuccccgaaucccacgaucgaggagggacgcacccuucgggugcugaaaaugguugaaccuuggcugagaggcaaccaauucuguauuaagauccucaaucccuacaugccuucuguggucgagacacuggaacagaugcagcgcaagcauggcgggaugcuugugcggaacccccugagcagaaauuccacccacgagauguauuggguuagcugcggaacaggcaacauugugucugccgucaacaugaccucccgcaugcuccugaaucgguuuacaauggcucauagaaaaccgaccuacgagcgcgauguggaccugggggccggaacgagacacguggcugucgaaccugagaucgccaaccucgauaucauuggccagcggaucgaaaauauuaagaacgagcacaaaagcacauggcauuaugacgaagauaaucccuacaagaccugggcguaucacgggucuuacgagguuaaacccuccggaagcgccucuuccauggugaacggcgugguccgccugcuuaccaagccuugggacgugauccccaugguuacacaaauugcuaugacggacaccacaccuuucggccagcagagaguguuuaaggagaaagucgauacccggacaccgagacccaagcgggggaccgcccaaaucauggaagugacagcuaaauggcuguggggauuccucagccgcaauaagaaaccuagaaucuguacccgggaggaauuuacgcgcaagguuagauccaacgccgcuauuggcgccguguucgucgacgagaaucaguggaacagcgcgaaggaagccguggaggaugagcgguuuugggaccugguucaucgcgaaagagagcuucacaaacaggggaagugcgcuaccugcguguauaauaugaugggaaaacgggaaaagaaacugggcgaguucgggaaggccaagggcucucgcgcuaucugguacauguggcucggagccagauuccuggaauuugaggcccugggcuucaugaacgaggaucauugguuuagccgggaaaauucccucucuggggucgagggagaaggccugcacaaacuuggguacauucugcgcgacaucagcaagauucccggaggcaacauguaugcggaugacacagcugggugggauaccagaaucacagaggacgaucuccagaaugaggccaaaaucaccgacauuauggaaccugagcacgcccugcuugcuacguccaucuucaagcugacauaccaaaacaaagugguccgggugcagcgccccgccaagucuggcaccguuauggaugugauuagcagacgggaccagagaggauccggccaggucgggacauauggacucaacaccuuuacgaauauggaagugcaacugauccgccagauggagucugaaggcauuuucagcccguccgagcuggagaacagcaaucucgcugaacgggugcuggacuggcuugagaaacaugggguugaaagacugaagcgcauggccaucucuggagaugacuguguggucaagccuaccgaugaccgguuugcgacagcccucaccgcucugaacgauaugggcaaagugagaaaggacaucccccagugggagccuuccaaaggguggaaugauuggcagcaaguucccuucugcagccaccauuuucaccagcuuauuaugaaggacggccgcgaaaucguggucccuugucggaaccaggaugagcuggugggacgggcccgcgucucucagggcgcuggguggucccuccgggagacagccugccugggaaaaagcuacgcgcaaauguggcagcugauguauuuccacagacgcgaccuccggcuggccgcuaaugccauuuguuccgcugugcccguuaacugggugccgaccucuagaacaaccuggagcauccaugcccaccaucaguggaugacgacagaagauaugcuuuccgucuggaaucggguguggauugaggaaaacccuuggauggaggacaagacccacguuagcucuugggaagacgugcccuaccugggcaagagagaggaucaauggugcgggucccucaucggacugaccgcucgcgccacaugggcgaccaauauucaggucgccaucaaccaggugcggagacuuaucggcaaugagaacuaucuggacuacaugacaagcaugaaacgcuuuaagaaugaaucugaucccgagggggcucucugguga

SEQ ID NO: 19483 - RNA, 9879 nt, Artificial Sequence
  derived and/or modified CDS sequence (opt5) from DENV-1__KM403631__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuaucaacauugaaaccgagccgcccuucggcgaguccuauaucguuauuggggccggagaaaaagcccugaagcugagcugguuuaagaaaggcucuagcaucgggaagauguucgaggcuacagccagaggcgcucgccggauggccauccucggagacaccgcgugggauuuuggcuccauugggggagucuucacaucugugggcaaacuggugcaucaggucuuugggaccgccuacggagugcuuuucagcggcguuuccuggacgaugaagaucgggauuggcauccugcucaccuggcugggacugaauagcagaucuacaucccuuagcaugaccuguauugcugugggcauggucacacucuaccugggggugaugguucaggccgacucuggaugcgugaucaacuggaaaggccgcgaacugaaguguggguccggaauuuuugucaccaacgaggugcacacauggaccgaacaauauaaguuccaggcugauagcccuaaacggcucuccgccgcgaucggcaaggccugggaggaggggguuugcggcaucagaucugcuacgcgccuggaaaauauuauguggaaacagaucagcaacgagcuuaaucauauucugcucgaaaacgacaugaaguuuacaguggucgugggagacgccaauggcauccugacccaggggaaaaagaugauucggccgcaacccauggagcacaaauacuccuggaagucuuggggaaaggcuaaaaucaucggcgccgauacccagaacacaaccuucauuaucgacgggccugauacgcccgaauguccugacgaucagagagccuggaauauuugggagguggaggacuauggauuuggcgucuucacaaccaacaucuggcugaaacuucgcgauagcuacacacagaugugcgaccaccggcucauguccgcugcgauuaaagauagcaaggccguucaugcugacaugggcuauuggaucgaaucugagaaaaaugaaaccuggaagcuggccagagccuccuuuaucgaggugaagacauguauuuggccccgcagccacacccuguggucuaacggggugcucgaauccgagaugaucauuccgaaaaucuacggaggcccuauuagccaacauaauuaucggcccggguacuucacgcagaccgcuggaccuuggcaccugggcaaacuugagcuggauuucaaccucugcgaagggacaaccgucgugguugacgagcacugcggaaauagaggccccucucugcggacaaccacggugacaggcaaaaucauccaugaaugguguugccgcagcuguacccugccuccccuuagauuuagaggggaagauggaugcugguacggcauggagauuagaccggucaaggaaaaagaggaaaaccucgugcgcuccaugguuagcgccgggucuggagagguggacuccuucagccugggccugcucugugucuccaucaugauugaagaggugaugcggucuagauggagccgcaagaugcugaugacagggacccuugcggucuuuuuccugcucaucaugggacagcugaccuggaaugaccugauuagacuuugcaucauggugggcgcuaacgucuccgaucggaugggcauggggacaacguaucuggcccucauggccaccuuuaagaugcgcccuauguucgcugugggacugcucuuuagacggcugacaucucgcgaggugcuucugcucaccauuggccugagccuggucgccuccguugaacuucccaacucucuggaggaacucggggacggacuggcgaugggcaucaugaugcucaaacugcuuacagauuuccaaagccaccagcuguggaccacgcuccugucccugacauuuaucaagaccacccuuagccuggacuacgcuuggaaaacaauggccauggugcucucuauugugucccuguucccccucugucugagcaccacaucucagaagacgaccuggcuuccuguccugcugggguccuuuggaugcaaaccgcucacaauguuccugaucaccgagaauaagauuuggggcagaaagagcuggccccuuaacgaaggcaucauggccguggggauuguuucuauccugcucuccagccugcucaaaaaugaugugccucuggcuggaccccuuaucgccggcgggaugcugauugcuuguuaugucaucuccggaagcucugccgaccugagccucgagcgggcggccgagguguccugggaagaggaagcugagcauucuggcgccagccacaacauucugguugaagugcaggaugacgggacaaugaagaucaaagaugaggagcgcgacgauacccuuacgauucugcucaaggcuacccugcucgccgucuccggaguguacccuaugucuauccccgccacacuguuugucugguauuucuggcagaagaagaaacagagaagcggcgugcuuugggacaccccuagcccucccgaaguugagcgggcugugcuggaugacggcaucuaccgcauucugcagagagggcuccugggacggucucaggucggcguggggguuuuccaagacggaguguuucauacaauguggcacgucaccagaggcgcggugcuuauguaucaggggaaacgccuggaacccagcugggccuccgugaagaaagaucucaucagcuacggaggcggcuggcgguuccaggggucuuggaauacaggagaggagguucaggucauugcuguggaacccggcaagaacccuaaaaaugugcaaacgacccccgggacauuuaagaccccggagggagaagucggcgccaucgcccuggacuucaaaccugggaccuccggaagccccauugugaacagagagggcaagaucguuggccucuacgggaauggaguggucacaacgucuggcaccuauguguccgcuauugcccaggcgaaggcuagccaggaagggccucugcccgagaucgaggaugaaguuuuuaaaaagcgcaaccuuacaaucauggaccugcaccccggauccggcaaaacccggagauaccugccugccauugugcgcgaggccaucaagcggaaacucagaacacugauucuugcuccgacccgcgucguggccucugaaauggcggaggcucugaaggggaugcccauccgguaucaaacgacagccguuaagagcgaacauaccggcaaagagauuguggaucucaugugccacgccaccuucacaaugagacugcuguccccuguccgggugcccaauuacaacaugaucaucauggacgaggcucauuuuaccgauccugccagcauugcugcccgcggauauaucucuacaagagugggcaugggggaagcggccgcuauuuucaugaccgccacgcccccuggauccgucgaggcuuuuccgcagagcaaugccguuauccaggacgaagaacgggauauucccgaacgcucuuggaacagcggcuacgacuggaucacagauuucccugggaagaccgugugguuugugcccuccaucaaaucuggaaaugacauugccaacugucucagaaagaacggcaaacgggucauccagcuuagcagaaagacauucgacaccgaguaucaaaagacgaaaaauaacgauugggacuacgugguuaccacagauauuuccgagaugggggcuaauuuccgcgcggaccgggugaucgauccuagacgcugccugaagcccgucauucugaaagacggcccggaacgggugauccucgccggaccuaugcccguuaccgcugccucugccgcucagagacgcggccggauugggagaaaccagaauaaggagggagaucaguacaucuauaugggccaaccccugaacaaugacgaagaucacgcccauuggacagaggcgaaaaugcuucuggacaacaucaauaccccugaggggauuauccccgcucucuuugaaccugagcgcgaaaagagcgccgccauugauggagaguacagacugcggggcgaagcucgcaagacauucguggagcugaugagaagaggggaccucccggucuggcuuuccuauaaaguggccagcgagggcuuucaguacucugaucgcagauggugcuucgacggagaacggaacaaucagguccuggaggaaaacauggacguggagaucuggaccaaggaaggcgagcgcaagaagcugcgcccccgguggcucgaugcgagaacguauuccgacccucuggcccuucgcgaguuuaaagaguucgcugccgggcggagaagcguuuccggagaucugauucucgagaucggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucauugccgugcugacaggcggcgucacccuguuuuuccucagcgggaagggacuuggcaagacauccaucgggcugcuguguguuauggcuucuagcgugcuccuguggauggccuccguggagccccacuggauugcugccagcaucauucuugaauuuuuccugaugguccuccugaucccggagccugacagacagcggacgccccaggauaaccaacuggccuaugugguuaucggacuccuuuuuaugauucugaccguggcugcgaacgaaaugggccugcucgagacaaccaaaaaggaccuggggaucggacaugucguggccgagaaucaccaccaugcuacaaugcuugauauugaccugcacccugccucugccuggacccucuacgcugucgccacgaccaucauuacacccaugaugcgccauaccaucgaaaacacaaccgcgaauauuucccugacggccaucgcuaaccaggccgcuauccugaugggccucgauaaaggcuggccuauuagcaagauggacaucggggugccccuucuggcccugggaugcuacucucagguuaauccgcucacacugaccgcggccgugcuuaugcuggucgcucacuaugccauuaucggcccugggcuccaagcuaaagccacaagagaggcucagaagcggaccgccgcgggaauuaugaagaaccccaccguggauggcaucguugccaucgaccuggaccccguggucuacgaugcuaaauucgaaaagcagcuggggcagauuaugcuccuuauccuguguacaucccaaauucugcucaugcgcacgaccugggcccugugcgagagcaucacacuugcuaccggaccucugacaacccucugggaaggcucuccgggcaaauuuuggaauacgacaauugccgugagcauggccaacaucuucagaggguccuaucuggcgggagcuggccuggccuucucucucaugaagucccuugggggaggccggcgcgggaccggagcucagggcgagacccugggcgagaaauggaagagacagcugaaucagcucuccaagagcgaauuuaacacauacaaacgguccgggaucauggagguggacagaucugaagccaaggagggacugaaacgcggcgaaaccacaaagcaugccguuagccgggggacggcuaaacuuagaugguucgucgagcgcaaucuggugaagcccgagggaaaggugauugaucucggcugugggcggggaggcugguccuauuacugcgccggccugaaaaaggucaccgaaguuaaaggguauacaaagggaggcccugggcacgaggaacccaucccuauggcgaccuacggauggaacauugugaaacugcacucuggcagagacguguuuuucacacccccugagaagugugauacccuccuuugcgacaucggggaaagcuccccgaaucccacgauugaggagggacgcacccugcggguccugaaaaugguggaaccuuggcucagaggcaaccaauuuuguaucaagauucugaaucccuacaugccuucuguuguggagacacuugaacagaugcagcgcaagcauggcgggaugcugguccggaacccccucagcagaaauuccacccacgagauguauugggugagcugcggaacaggcaacaucguuucugccgugaacaugaccucccgcaugcugcugaaucgguucacaauggcucauagaaaaccgaccuacgagcgcgaugucgaccucggggccggaacgagacacguggcuguggaaccugagaucgccaaccuggauauuaucggccagcggauugaaaauaucaagaacgagcacaaaagcacauggcauuaugacgaagauaaucccuacaagaccugggcguaucacgggucuuacgaggucaaacccuccggaagcgccucuuccaugguuaacggcguggugcgccuucugaccaagccuugggacgucauucccauggugacacaaaucgcuaugacggacaccacaccuuuuggccagcagagaguuuucaaggagaaaguggauacccggacaccgagacccaagcgggggaccgcccaaaucauggaagucacagcuaaauggcucuggggauuucugagccgcaauaagaaaccuagaauuuguacccgggaggaguucacgcgcaaggugagauccaacgccgcuaucggcgccguuuuuguggacgagaaucaguggaacagcgcgaaggaagccgucgaggaugagcgguucugggaccuugugcaucgcgaaagagagcugcacaaacaggggaagugcgcuaccugcguuuauaauaugaugggaaaacgggaaaagaaacucggcgaguuugggaaggccaagggcucucgcgcuauuugguacauguggcugggagccagauuccuggaguucgaggcccucggcuuuaugaacgaggaucauugguucagccgggaaaauucccugucugggguggagggagaaggccuucacaaacugggguacauccuccgcgacauuagcaagauccccggaggcaacauguaugcggaugacacagcugggugggauaccagaaucacagaggacgaucugcagaaugaggccaaaauuaccgacaucauggaaccugagcacgcccuucuggcuacguccauuuuuaagcucacauaccaaaacaaagucgugcggguccagcgccccgccaagucuggcaccgugauggauguuaucagcagacgggaccagagaggauccggccagguggggacauauggacugaacaccuucacgaauauggaaguccaacugauucgccagauggagucugaaggcaucuuuagcccguccgagcucgagaacagcaaucuggcugaacgggugcuugacuggcuggagaaacaugggguggaaagacucaagcgcauggccaucucuggagaugacuguguugugaagccuaccgaugaccgguucgcgacagcccugaccgcucuuaacgauaugggcaaagucagaaaggacauuccccagugggagccuuccaaaggguggaaugauuggcagcaagugcccuuuugcagccaccauuuccaccagcugaucaugaaggacggccgcgaaauuguugugccuugucggaaccaggaugagcucgucggacgggcccgcgugucucagggcgcuggguggucccugcgggagacagccugccugggaaaaagcuacgcgcaaauguggcagcucauguauuuucacagacgcgaccugcggcuugccgcuaaugccaucuguuccgcuguccccgugaacuggguuccgaccucuagaacaaccuggagcauucaugcccaccaucaguggaugacgacagaagauaugcuguccguguggaaucgggucuggaucgaggaaaacccuuggauggaggacaagacccacgugagcucuugggaagacguucccuaccucggcaagagagaggaucaauggugcgggucccugauuggacuuaccgcucgcgccacaugggcgaccaauauccagguggccaucaaccagguccggagacugauuggcaaugagaacuaucucgacuacaugacaagcaugaaacgcuucaagaaugaaucugaucccgagggggcucugugguga

SEQ ID NO: 19484 - RNA, 9879 nt, Artificial Sequence
  derived and/or modified CDS sequence (opt5) from DENV-1__KM403632__SS-prME
agcgugaccaugcugcucaugcugcuucccacagcucuggcuuuccaccucacgaccagaggcggggaaccucauaugaucguguccaagcaggaacggggaaaaucucugcuuuuuaagacaagcgccggcguuaacaugugcacccugauugcgauggaccucggggaacugugugaagauacaaugaccuacaaaugcccgcgcaucacagaagcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuucggugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccgcacaggccuugauuucaacgaaauggugcugcucaccaugaaagagaagucuuggcugguccauaaacagugguuucuugaccugccucuccccuggacguccggggcuagcacaucccaagagaccuggaauagacaggaucugcuggugacauucaagaccgcgcacgccaaaaagcaggaagucgugguucucggaucucaagagggcgcuaugcacaccgcccugacaggggccacggaaauucagaccagcggaacaaccacaaucuuugcuggccaucuuaagugccggcugaaaauggacaagcucacccugaaagggguguccuaugucauguguacgggcagcuucaagcuggagaaagaaguggccgagacacagcacggaaccguucuugugcaggucaaguacgagggcaccgaugcgccgugcaagauuccuaucucuacacaagacgaaaaaggggugacccagaacggaagacucaucacagcuaaucccauugugacggauaaggagaaaccuguuaacaucgaaaccgagccgcccuucggcgaguccuauauugucaucggggccggagaaaaggcccugaaacugagcugguuuaagaagggcucuagcauugggaaaauguucgaggcuacagcccgcggcgcucggagaauggccauccucggagacaccgcgugggauuuuggcuccaucgggggaguguucacaucugugggcaagcugguccaucagguguuugggaccgccuacggaguucuuuucagcggcguguccuggacgaugaaaauugggaucggcauucugcucaccuggcugggacugaauagccgcucuacaucccuuagcaugaccuguaucgcugucggcauggugacacucuaccuggggguuauggugcaggccgacucuggaugcgucauuaacuggaagggccgggaacugaaauguggguccggaaucuuugugaccaacgagguucacacauggaccgaacaauauaaguuccaggcugauagcccuaagagacucuccgccgcgauuggcaaagccugggaggagggggugugcggcauccgcucugcuacgcggcuggaaaauaucauguggaagcagauuagcaacgagcuuaaucauauccugcucgaaaacgacaugaaauuuacagucguggugggagacgccaauggcauucugacccaggggaagaaaaugaucagaccgcaacccauggagcacaaguacuccuggaaaucuuggggaaaggcuaagauuaucggcgccgauacccagaacacaaccuucaucauugacgggccugauacgcccgaauguccugacgaucagcgcgccuggaauaucugggaggucgaggacuauggauuuggcguuuucacaaccaacauuuggcugaaacuucgggauagcuacacacagaugugcgaccacagacucauguccgcugcgaucaaggauagcaaagccgugcaugcugacaugggcuauuggauugaaucugagaagaaugaaaccuggaaacuggcccgcgccuccuuuaucgaggugaagacauguaucuggccccggagccacacccuguggucuaacgggguccucgaauccgagaugauuaucccgaagauuuacggaggcccuaucagccaacauaauuauagacccggguacuucacgcagaccgcuggaccuuggcaccugggcaaacuugagcuggauuucaaccucugcgaagggacaaccgugguuguggacgagcacugcggaaaucggggccccucucugcgcacaaccacggucacaggcaagauuauccaugaaugguguugcagaagcuguacccugccuccccuucgguuuagaggggaggauggaugcugguacggcauggagauccgcccggugaaagaaaaggaggaaaaccucguucgguccauggugagcgccgggucuggagaggucgacuccuucagccugggccugcucuguguguccauuaugaucgaagagguuaugagaucucgcuggagcagaaaaaugcugaugacagggacccuugcgguguuuuuccugcucauuaugggacagcugaccuggaaugaccugauccggcuuugcauuauggucggcgcuaacguguccgaucgcaugggcauggggacaacguaucuggcccucauggccaccuuuaagaugagaccuauguucgcugugggacugcucuuucggcgccugacaucuagagagguccuucugcucaccaucggccugagccugguugccuccguggaacuucccaacucucuggaggaacucggggacggacuggcgaugggcauuaugaugcucaagcugcuuacagauuuccaaagccaccagcuguggaccacgcuccugucccugacauuuaucaaaaccacccuuagccuggacuacgcuuggaagacaauggccauggugcucucuaucgucucccuguucccccucugucugagcaccacaucucagaaaacgaccuggcuuccugugcugcugggguccuuuggaugcaagccgcucacaauguuccugauuaccgagaauaaaaucuggggccggaaguccuggccccuuaacgaaggcauuauggccguugggaucgugucuauucugcucuccagccugcucaagaaugaugucccucuggcuggaccccuuaucgccggcgggaugcugaucgcuuguuaugugauuuccggaagcucugccgaccugagccucgagcgcgcggccgagguuuccugggaagaggaagcugagcauucuggcgccagccacaacauccugguggaaguccaggaugacgggacaaugaaaauuaaggaugaggagagagacgauacccuuacgauccugcucaaagcuacccugcucgccguguccggagucuacccuaugucuauucccgccacacuguuugugugguauuucuggcaaaagaaaaagcagcggagcggcguucuuugggacaccccuagcccucccgaaguggagcgcgcuguccuggaugacggcaucuacagaauccugcagcgggggcuccugggaagaucucaggugggcguugggguguuccaagacggagucuuucauacaauguggcacgugacccgcggcgcggugcuuauguaucaggggaaacggcuggaacccagcugggccuccguuaagaaggaucucauuagcuacggaggcggcuggagauuccaggggucuuggaauacaggagaggagguccaggugaucgcuguggaacccggcaaaaacccuaagaauguccaaacgacccccgggacauuuaaaaccccggagggagaagugggcgccauugcccuggacuucaagccugggaccuccggaagccccaucguuaaccgcgagggcaaaauugugggccucuacgggaauggagucgugacaacgucuggcaccuauguuuccgcuaucgcccaggcgaaggcuagccaggaagggccucugcccgagauugaggaugaaguguuuaagaaacggaaccuuacaaucauggaccugcaccccggauccggcaagaccagacgcuaccugccugccaucguccgggaggccauuaaaagaaagcuccgcacacugauccuugcuccgacccgggugguugccucugaaauggcggaggcucugaaagggaugcccauuagauaucaaacgacagccgucaagagcgaacauaccggcaaggagaucgucgaucucaugugccacgccaccuucacaaugcggcugcuguccccugugcgcgugcccaauuacaacaugauuaucauggacgaggcucauuuuaccgauccugccagcaucgcugccagaggauauauuucuacacgggucggcaugggggaagcggccgcuaucuucaugaccgccacgcccccuggauccguugaggcuuuuccgcagagcaaugccgugauucaggacgaagaacgcgauauccccgaaagaucuuggaacagcggcuacgacuggauuacagauuucccugggaaaaccgugugguuuguccccuccaucaagucuggaaaugacaucgccaacugucuccggaaaaacggcaagagagugauucagcuuagccgcaaaacauucgacaccgaguaucaaaagacgaagaauaacgauugggacuacguugugaccacagauaucuccgagaugggggcuaauuuccgggcggacagagucauugauccucgccggugccugaaacccgugauccugaaggacggcccggaaagaguuauucucgccggaccuaugcccgugaccgcugccucugccgcucagcgccggggcagaaucgggcgcaaccagaauaaagagggagaucaguacauuuauaugggccaaccccugaacaaugacgaagaucacgcccauuggacagaggcgaagaugcuucuggacaacaucaauaccccugaggggaucauucccgcucucuuugaaccugagagagaaaagagcgccgccaucgauggagaguaccggcugcgcggcgaggcuagaaagacauucgucgagcugaugcggcgcggggaccucccgguguggcuuuccuauaaggucgccagcgagggcuuucaguacucugauagacgguggugcuucgacggagaaagaaacaaucaggugcuggaggaaaacauggacguugagauuuggaccaaagaaggcgagcgcaagaaacugcggcccagauggcucgaugcgcgcacguauuccgacccucuggcccuucgggaguuuaaggaguucgcugccgggagacggagcguguccggagaucugauccucgagauuggcaaacugccccagcaccugacacuccgcgcucaaaaugcccuugacaaccuggugaugcugcacaauucugaacaagggggaaaggcuuacagacaugccauggaggaacucccugauaccaucgagacccugaugcuucuggcgcucaucgccguccugacaggcggcguuacccuguuuuuccucagcgggaaaggacuuggcaagacauccauugggcugcugugugugauggcuucuagcgugcuccuguggauggccuccgucgagccccacuggaucgcugccagcauuauccuugaauuuuuccugauggugcuccugauuccggagccugaccggcagcgcacgccccaggauaaccaacuggccuauguugugaucggacuccuuuuuaugauccugaccgucgcugcgaacgaaaugggccugcucgagacaaccaagaaagaccuggggauuggacauguggucgccgagaaucaccaccaugcuacaaugcuugauaucgaccugcacccugccucugccuggacccucuacgcuguggccacgaccauuaucacacccaugaugagacauaccauugaaaacacaaccgcgaauaucucccugacggccauugcuaaccaggccgcuauccugaugggccucgauaagggcuggccuaucagcaaaauggacauugggguuccccuucuggcccugggaugcuacucucaggugaauccgcucacacugaccgcggccguccuuaugcugguggcucacuaugccaucauuggcccugggcuccaagcuaaggccacacgggaggcucagaaacgcaccgccgcgggaaucaugaagaaccccaccguugauggcauuguggccaucgaccuggaccccgucguguacgaugcuaaguucgaaaaacagcuggggcagaucaugcuccuuauucuguguacaucccaaauccugcucaugagaacgaccugggcccugugcgagagcauuacacuugcuaccggaccucugacaacccucugggaaggcucuccgggcaaguuuuggaauacgacaaucgccgugagcauggccaacauuuuccggggguccuaucuggcgggagcuggccuggccuucucucucaugaaaagccuugggggaggccgcagagggaccggagcucagggcgagacccugggcgagaaguggaaacggcagcugaaucagcucuccaagagcgaauuuaacacauacaagagauccgggaucauggagguugaccgcucugaagccaaagagggacugaagcggggcgaaaccacaaaacaugccgucagcagagggacggcuaaacuucgcugguucguggagcggaaucuggugaaacccgagggaaaggucaucgaucucggcugugggagaggaggcugguccuauuacugcgccggccugaagaaaguuaccgaagugaagggguauacaaaaggaggcccugggcacgaggaacccauuccuauggcgaccuacggauggaacaucgugaagcugcacucuggccgcgacgucuuuuucacacccccugagaaaugugauacccuccuuugcgacauuggggaaagcuccccgaaucccacgaucgaggagggacggacccugagagugcugaagaugguugaaccuuggcuccgcggcaaccaauuuuguauuaaaauccugaaucccuacaugccuucuguggucgagacacuugaacagaugcagcggaagcauggcgggaugcuggugagaaacccccucagccgcaauuccacccacgagauguauuggguuagcugcggaacaggcaacauugugucugccgucaacaugaccucccggaugcugcugaauagauucacaauggcucaucgcaagccgaccuacgagagagauguggaccucggggccggaacgcggcacguggcugucgaaccugagaucgccaaccuggauaucauuggccagcgcaucgaaaauauuaaaaacgagcacaagagcacauggcauuaugacgaagauaaucccuacaaaaccugggcguaucacgggucuuacgagguuaagcccuccggaagcgccucuuccauggugaacggcguggucagacuucugaccaaaccuugggacgugauccccaugguuacacaaauugcuaugacggacaccacaccuuuuggccagcagcggguguucaaggagaaggucgauaccagaacaccgcggcccaaacgcgggaccgcccaaaucauggaagugacagcuaaguggcucuggggauuucugagcagaaauaaaaagccucggaucuguacccgcgaggaguucacgagaaaaguucgguccaacgccgcuauuggcgccguguuugucgacgagaaucaguggaacagcgcgaaggaagccguggaggaugagcgcuucugggaccuuguucauagagaacgggagcugcacaagcaggggaaaugcgcuaccugcguguauaauaugaugggaaagcgcgagaaaaagcucggcgaguuugggaaagccaagggcucuagagcuaucugguacauguggcugggagcccgguuccuggaguucgaggcccucggcuuuaugaacgaggaucauugguucagccgcgaaaauucccugucuggggucgagggagaaggccuucacaagcugggguacauucucagagacaucagcaaaauucccggaggcaacauguaugcggaugacacagcugggugggauacccggaucacagaggacgaucugcagaaugaggccaagaucaccgacauuauggaaccugagcacgcccuucuggcuacguccaucuuuaaacucacauaccaaaacaaggugguccgcgugcagagacccgccaaaucuggcaccguuauggaugugauuagccggagagaccagcgcggauccggccaggucgggacauauggacugaacaccuucacgaauauggaagugcaacugauccggcagauggagucugaaggcauuuuuagcccguccgagcucgagaacagcaaucuggcugaaagagugcuugacuggcuggagaagcaugggguugaacgccucaaacggauggccaucucuggagaugacuguguggucaagccuaccgaugacagauucgcgacagcccugaccgcucuuaacgauaugggcaaggugcgcaaagacaucccccagugggagccuuccaagggguggaaugauuggcagcaaguucccuuuugcagccaccauuuccaccagcugauuaugaaagacggccgggaaaucguggucccuuguagaaaccaggaugagcucgugggacgcgcccgggucucucagggcgcuggguggucccugagagagacagccugccugggaaagagcuacgcgcaaauguggcagcucauguauuuucaccgccgggaccugagacuugccgcuaaugccauuuguuccgcugugcccguuaacugggugccgaccucucggacaaccuggagcauccaugcccaccaucaguggaugacgacagaagauaugcuguccgucuggaauagaguguggauugaggaaaacccuuggauggaggacaaaacccacguuagcucuugggaagacgugcccuaccucggcaagcgcgaggaucaauggugcgggucccugaucggacuuaccgcucgggccacaugggcgaccaauauucaggucgccaucaaccaggugagacgccugaucggcaaugagaacuaucucgacuacaugacaagcaugaagagauucaaaaaugaaucugaucccgagggggcucugugguga

SEQ ID NO: 19485 - RNA, 9879 nt, Artificial Sequence
  derived and/or modified CDS sequence (opt5) from DENV-1__KM403583__SS-prME
agcgugaccaugcugcucaugcugcuucccacagcucuggcuuuccaccucacgacccggggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccgcgcauuacagaggcugaacccgacgauguggacuguuggugcaaugccaccgauacgugggugaccuauggaacauguucccaaaccggcgagcacagacgggaccgcagaucugucgcccuggcuccucauguggggcucggacuggagacacggaccgaaacguggaugagcuccgagggcgccuggcgccagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaagaccgaggucacaaacccugccguucuucggaaacugugcauugaagcgaagaucucuaauaccacgacagacucccgcuguccgacccaaggagaggccacccucguggaagaacaagaugcuaacuucgugugcagacggacauuugucgaccgcggcuggggcaauggguguggacuguucggcaaagggagccuucugaccugcgccaaguuuaaaugcgugacaaagcucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaggagaaaucuuggcugguccauaagcagugguuucuugaccugccucuccccuggacguccggggcuagcacaucccaagagaccuggaaucggcaggaucugcuggugacauucaaaaccgcgcacgccaagaaacaggaagucgugguucucggaucucaagagggcgcuaugcacaccgcccugacaggggccacggaaauucagaccagcggaacaaccacaaucuuugcuggccaucuuaagugcagacugaagauggacaaacucacccugaaggggguguccuaugucauguguacgggcagcuucaaacuggagaaggaaguggccgagacacagcacggaaccguucuugugcaggucaaauacgagggcaccgaugcgccgugcaagauuccuaucucuacacaagacgaaaagggggugacccagaacggacgccucaucacagcuaaucccauugugacggauaaagagaagccuguuaacaucgaaaccgagccgcccuucggcgaguccuauauugucaucggggccggagaaaaagcccugaagcugagcugguuuaaaaagggcucuagcauugggaagauguucgaggcuacagcccggggcgcuagacgcauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagccggucuacaucccuuagcaugaccuguaucgcugucggcauggugacacucuaccuggggguuauggugcaggccgacucuggaugcgucauuaacuggaaaggcagagaacugaaguguggguccggaaucuuugugaccaacgagguucacacauggaccgaacaauauaaauuccaggcugauagcccuaagcgccucuccgccgcgauuggcaaggccugggaggagggggugugcggcauccggucugcuacgagacuggaaaauaucauguggaaacagauuagcaacgagcuuaaucauauccugcucgaaaacgacaugaaguuuacagucguggugggagacgccaauggcauucugacccaggggaaaaagaugauccgcccgcaacccauggagcacaaauacuccuggaagucuuggggaaaagcuaagauuaucggcgccgauacccagaacacaaccuucaucauugacgggccugauacgcccgaauguccugacgaucagcgggccuggaauaucugggaggucgaggacuauggauuuggcguuuucacaaccaacauuuggcugaaacuuagagauagcuacacacagaugugcgaccaccgccucauguccgcugcgaucaaagauagcaaggccgugcaugcugacaugggcuauuggauugaaucugagaaaaaugaaaccuggaagcuggcccgggccuccuuuaucgaggugaaaacauguaucuggcccagaagccacacccuguggucuaacgggguccucgaauccgagaugauuaucccgaagauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaaucgcggccccucucugagaacaaccacggucacaggcaaaauuauccaugaaugguguugccggagcuguacccugccuccccuuagauuucgcggggaggauggaugcugguacggcauggagauccggccggugaaggaaaaagaggaaaaccucguuagauccauggugagcgccgggucuggagaggucgacuccuucagccugggccugcucuguguguccauuaugaucgaagagguuaugcgcucuagauggagccggaagaugcugaugacagggacccuugcgaucuuuuuccugcucaucaugggacagcugaccuggaaugaccugauucgccuuugcaucauggugggcgcuaacgucuccgauagaaugggcauggggacaacguaucuggcccucauggccaccuuuaaaaugcggccuauguucgcugugggacugcucuuucgcagacugacaucucgggaggugcuucugcucaccauuggccugagccuggucgccuccguugaacuucccaacucucuggaggaacucggggacggacuggcgaugggcaucaugaugcucaagcugcuuacagauuuccaaagccaccagcuguggaccacgcuccugucccugacauuuaucaagaccacccuuagccuggacuacgcuuggaaaacaauggccauggugcucucuauugugucccuguucccccucugucugagcaccacaucucagaagacgaccuggcuuccuguccugcugggguccuuuggaugcaaaccgcucacaauguuccugaucaccgagaauaagauuuggggccgcaaaagcuggccccuuaacgaaggcaucauggccguggggauuguuucuauccugcucuccagccugcucaagaaugaugugccucuggcuggaccccuuaucgccggcgggaugcugauugcuuguuaugucaucuccggaagcucugccgaccugagccucgagagagcggccgagguguccugggaagaggaagcugagcauucuggcgccagccacaacauucugguugaagugcaggaugacgggacaaugaagaucaaagaugaggagcgggacgauacccuuacgauucugcucaaggcuacccugcucgccgucuccggaguguacccuaugucuauccccgccacacuguuugucugguauuucuggcagaagaagaaacagcgcagcggcgugcuuugggacaccccuagcccucccgaaguugagagagcugugcuggaugacggcaucuaccggauucugcagagagggcuccugggacgcucucaggucggcguggggguuuuccaagacggaguguuucauacaauguggcacgucacccggggcgcggugcuuauguaucaggggaaaagacuggaacccagcugggccuccgugaaaaaggaucucaucagcuacggaggcggcuggcgcuuccaggggucuuggaauacaggagaggagguucaggucauugcuguggaacccggcaagaacccuaaaaaugugcaaacgacccccgggacauuuaagaccccggagggagaagucggcgccaucgcccuggacuucaaaccugggaccuccggaagccccauugugaaccgggagggcaagaucguuggccucuacgggaauggaguggucacaacgucuggcaccuauguguccgcuauugcccaggcgaaagcuagccaggaagggccucugcccgagaucgaggaugaaguuuuuaagaagagaaaccuuacaaucauggaccugcaccccggauccggcaaaacccgccgguaccugccugccauugugagagaggccaucaagcgcaaacuccggacacugauucuugcuccgaccagagucguggccucugaaauggcggaggcucugaaggggaugcccauccgguaucaaacgacagccguuaaaagcgaacauaccggcaaggagauuguggaucucaugugccacgccaccuucacaaugcgccugcuguccccugucagagugcccaauuacaacaugaucaucauggacgaggcucauuuuaccgauccugccagcauugcugcccggggauauaucucuacacgcgugggcaugggggaagcggccgcuauuuucaugaccgccacgcccccuggauccgucgaggcuuuuccgcagagcaaugccguuauccaggacgaagagagagauauucccgaacggucuuggaacagcggcuacgacuggaucacagauuucccugggaagaccgugugguuugugcccuccaucaaaucuggaaaugacauugccaacugucucagaaagaacggcaaacgcgucauccagcuuagccggaagacauucgacaccgaguaucagaagacgaagaauaacgauugggacuacgugguuaccacagauauuuccgagaugggggcuaauuucagagcggaccgcgugaucgauccucggagaugccugaagcccgucauucugaaagacggcccggaacgcgugauccucgccggaccuaugcccguuaccgcugccucugccgcucagcggagaggccgcauugggagaaaccagaauaaggagggagaucaguacaucuauaugggccaaccccugaacaaugacgaagaucacgcccauuggacagaggcgaaaaugcuucuggacaacaucaauaccccugaggggauuauccccgcucucuuugaaccugagcgggaaaagagcgccgccauugauggagaguaccgccugagaggcgaagcucggaaaacauucguggagcugaugcgcagaggggaccucccggucuggcuuuccuauaagguggccagcgagggcuuucaguacucugaucggagauggugcuucgacggagaacgcaacaaucagguccuggaggaaaacauggacguggagaucuggaccaaggaaggcgagcggaaaaagcugagaccccgcuggcucgaugcgcggacguauuccgacccucuggcccuuagagaguuuaaagaguucgcugccgggcggcgcagcguuuccggagaucugauucucgagaucggcaagcugccccagcaccugacacucagagcucaaaaugcccuugacaaccuggugaugcugcacaauucugaacaagggggaaaggcuuaccggcaugccauggaggaacucccugauaccaucgagacccugaugcuucuggcgcucauugccgugcugacaggcggcgucacccuguuuuuccucagcgggaagggacuuggcaaaacauccaucgggcugcuguguguuauggcuucuagcgugcuccuguggauggccuccguggagccccacuggauugcugccagcaucauucuugaauuuuuccugaugguccuccugaucccggagccugaccgccagagaacgccccaggauaaccaacuggccuaugugguuaucggacuccuuuuuaugauucugaccguggcugcgaacgaaaugggccugcucgagacaaccaagaaggaccuggggaucggacaugucguggccgagaaucaccaccaugcuacaaugcuugauauugaccugcacccugccucugccuggacccucuacgcugucgccacgaccaucauuacacccaugaugcggcauaccaucgaaaacacaaccgcgaauauuucccugacggccaucgcuaaccaggccgcuauccugaugggccucgauaaaggcuggccuauuagcaagauggacaucggggugccccuucuggcccugggaugcuacucucagguuaauccgcucacacugaccgcggccgugcuuaugcuggucgcucacuaugccauuaucggcccugggcuccaagcuaaagccacacgcgaggcucagaagagaaccgccgcgggaauuaugaaaaaccccaccguggauggcaucguugccaucgaccuggaccccguggucuacgaugcuaaguucgaaaagcagcuggggcagauuaugcuccuuauccuguguacaucccaaauucugcucaugcggacgaccugggcccugugcgagagcaucacacuugcuaccggaccucugacaacccucugggaaggcucuccgggcaaauuuuggaauacgacaauugccgugagcauggccaacaucuuccgcggguccuaucuggcgggagcuggccuggccuucucucucaugaagucccuugggggaggcagacgggggaccggagcucagggcgagacccugggcgagaaauggaagagacagcugaaucagcucuccaaaagcgaauuuaacacauacaagcgcuccgggaucauggagguggaccggucugaagccaaggagggacugaaaagaggcgaaaccacaaagcaugccguuagccgcgggacggcuaaacuucggugguucgucgagagaaaucuggugaagcccgagggaaaagugauugaucucggcugugggcgcggaggcugguccuauuacugcgccggccugaagaaggucaccgaaguuaaaggguauacaaagggaggcccugggcacgaggaacccaucccuauggcgaccuacggauggaacauugugaaacugcacucuggccgggacguguuuuucacacccccugagaagugugauacccuccuuugcgacaucggggaaagcuccccgaaucccacgauugaggagggaagaacccugcgcguccugaaaaugguggaaccuuggcuccggggcaaccaauuuuguaucaagauucugaaucccuacaugccuucuguuguggagacacuugaacagaugcagagaaaacauggcgggaugcugguccgcaacccccucagcagaaauuccacccacgagauguauugggugagcugcggaacaggcaacaucguuucugccgugaacaugaccuccagaaugcugcugaaucgcuucacaauggcucauagaaagccgaccuacgagcgggaugucgaccucggggccggaacgcgccacguggcuguggaaccugagaucgccaaccuggauauuaucggccagagaauugaaaauaucaagaacgagcacaaaagcacauggcauuaugacgaagauaaucccuacaagaccugggcguaucacgggucuuacgaggucaaacccuccggaagcgccucuuccaugguuaacggcguggugcggcuucugaccaagccuugggacgucauucccauggugacacaaaucgcuaugacggacaccacaccuuuuggccagcagagaguuuucaaagagaagguggauacccggacaccgcgccccaagagagggaccgcccaaaucauggaagucacagcuaaauggcucuggggauuucugagccggaauaagaaaccucgcauuuguaccagagaggaguucacgcggaaggugcgcuccaacgccgcuaucggcgccguuuuuguggacgagaaucaguggaacagcgcgaaagaagccgucgaggaugagagauucugggaccuugugcaucgggaacgcgagcugcacaagcaggggaagugcgcuaccugcguuuauaauaugaugggaaaaagagaaaagaaacucggcgaguuugggaaggccaaaggcucucgggcuauuugguacauguggcugggagcccgcuuccuggaguucgaggcccucggcuuuaugaacgaggaucauugguucagcagagaaaauucccugucugggguggagggagaaggccuucacaagcugggguacauccuccgggacauuagcaagauccccggaggcaacauguaugcggaugacacagcugggugggauacccgcaucacagaggacgaucugcagaaugaggccaaaauuaccgacaucauggaaccugagcacgcccuucuggcuacguccauuuuuaagcucacauaccaaaacaaagucgugagaguccagcggcccgccaagucuggcaccgugauggauguuaucagcagacgcgaccagcggggauccggccagguggggacauauggacugaacaccuucacgaauauggaaguccaacugauuagacagauggagucugaaggcaucuuuagcccguccgagcucgagaacagcaaucuggcugaacgcgugcuugacuggcuggagaaacaugggguggaacggcucaagagaauggccaucucuggagaugacuguguugugaaaccuaccgaugaccgcuucgcgacagcccugaccgcucuuaacgauaugggcaagguccggaaggacauuccccagugggagccuuccaaaggguggaaugauuggcagcaagugcccuuuugcagccaccauuuccaccagcugaucaugaaggacggcagagaaauuguugugccuugucgcaaccaggaugagcucgucggacgggccagagugucucagggcgcuggguggucccugcgcgagacagccugccugggaaaaagcuacgcgcaaauguggcagcucauguauuuucaccggagagaccugcggcuugccgcuaaugccaucuguuccgcuguccccgugaacuggguuccgaccucuagaacaaccuggagcauucaugcccaccaucaguggaugacgacagaagauaugcuguccguguggaaucgcgucuggaucgaggaaaacccuuggauggaggacaagacccacgugagcucuugggaagacguucccuaccucggcaaacgggaggaucaauggugcgggucccugauuggacuuaccgcuagagccacaugggcgaccaauauccagguggccaucaaccagguccgcagacugauuggcaaugagaacuaucucgacuacaugacaagcaugaagcgguucaagaaugaaucugaucccgagggggcucugugguga

SEQ ID NO: 19486 - RNA, 9879 nt, Artificial Sequence
  derived and/or modified CDS sequence (opt5) from DENV-1__KM403579__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauauccagaacaccacauucauuaucgacgggccugauacccccgaauguccugacgaucagagagccuggaauauuugggaggucgaggacuauggauuuggcguuuucacgacaaacaucuggcugaaacuucgcgauagcuacacccagaugugcgaccaccggcucauguccgcugcgauuaaagauagcaaggccgugcaugcugacaugggcuauuggaucgaaucugagaaaaaugaaacauggaagcuggccagagccuccuuuaucgaggugaagaccuguauuuggccccgcagccacacacuguggucuaacgggguccucgaauccgagaugaucauuccgaaaaucuacggaggcccuauuagccaacauaauuaucggcccggguacuucacccagacggcuggaccuuggcaccugggcaaacuugagcuggauuucaaccucugcgaagggaccacagugguuguggacgagcacugcggaaauagaggccccucucugcggaccacaaccgucacgggcaaaaucauccaugaaugguguugccgcagcuguacacugccuccccuuagauuuagaggggaagauggaugcugguacggcauggagauuagaccggugaaggaaaaagaggaaaaccucguucgcuccauggugagcgccgggucuggagaggucgacuccuucagccugggccugcucuguguguccaucaugauugaagagguuaugcggucuagauggagccgcaagaugcugaugaccgggacacuugcgguguuuuuccugcucaucaugggacagcugaccuggaaugaccugauuagacuuugcaucauggucggcgcuaacguguccgaucggaugggcauggggaccacauaucuggcccucauggccacguuuaagaugcgcccuauguucgcugugggacugcucuuuagacggcugaccucucgcgagguccuucugcucacaauuggccugagccugguugccuccguggaacuucccaacucucuggaggaacucggggacggacuggcgaugggcaucaugaugcucaaacugcuuaccgauuuccaaagccaccagcuguggacaacccuccugucccugacguuuaucaagacaacccuuagccuggacuacgcuuggaaaaccauggccauggugcucucuauugucucccuguucccccucugucugagcacaaccucucagaagacaacguggcuuccugugcugcugggguccuuuggaugcaaaccgcucaccauguuccugaucacagagaauaagauuuggggcagaaagagcuggccccuuaacgaaggcaucauggccguugggauugugucuauccugcucuccagccugcucaaaaaugaugucccucuggcuggaccccuuaucgccggcgggaugcugauugcuuguuaugugaucuccggaagcucugccgaccugagccucgagcgggcggccgagguuuccugggaagaggaagcugagcauucuggcgccagccacaacauucugguggaaguccaggaugacgggaccaugaagaucaaagaugaggagcgcgacgauacacuuaccauucugcucaaggcuacgcugcucgccguguccggagucuacccuaugucuauccccgccacccuguuugugugguauuucuggcagaagaagaaacagagaagcggcguucuuugggacacaccuagcccucccgaaguggagcgggcuguccuggaugacggcaucuaccgcauucugcagagagggcuccugggacggucucaggugggcguugggguguuccaagacggagucuuucauaccauguggcacgugacaagaggcgcggugcuuauguaucaggggaaacgccuggaacccagcugggccuccguuaagaaagaucucaucagcuacggaggcggcuggcgguuccaggggucuuggaauaccggagaggagguccaggugauugcuguggaacccggcaagaacccuaaaaauguccaaacaacgcccgggaccuuuaagacaccggagggagaagugggcgccaucgcccuggacuucaaaccugggaccuccggaagccccauuguuaacagagagggcaagaucgugggccucuacgggaauggagucgugaccacaucuggcacguauguuuccgcuauugcccaggcgaaggcuagccaggaagggccucugcccgagaucgaggaugaaguguuuaaaaagcgcaaccuuaccaucauggaccugcaccccggauccggcaaaacacggagauaccugccugccauuguccgcgaggccaucaagcggaaacucagaacccugauucuugcuccgacacgcgugguugccucugaaauggcggaggcucugaaggggaugcccauccgguaucaaaccacggccgugaaguccgaacauacaggcaaagagauugucgaucucaugugccacgccaccuucaccaugagacugcuguccccugugcgggugcccaauuacaacaugaucaucauggacgaggcucauuuuacagauccugccagcauugcugcccgcggauauaucucuaccagagucggcaugggggaagcggccgcuauuuucaugacagccacacccccuggauccguugaggcuuuuccgcagagcaaugccgugauccaggacgaagaacgggauauucccgaacgcucuuggaacagcggcuacgacuggaucacggauuucccugggaagacagugugguuuguccccuccaucaaaucuggaaaugacauugccaacugucucagaaagaacggcaaacgggugauccagcuuagcagaaagaccuucgacacagaguaucaaaagaccaaaaauaacgauugggacuacguugugacgaccgauauuuccgagaugggggcuaauuuccgcgcggaccgggucaucgauccuagacgcugccugaagcccgugauucugaaagacggcccggaacggguuauccucgccggaccuaugcccgugacagcugccucugccgcucagagacgcggccggauugggagaaaccagaauaaggagggagaucaguacaucuauaugggccaaccccugaacaaugacgaagaucacgcccauuggaccgaggcgaaaaugcuucuggacaacaucaauacaccugaggggauuauccccgcucucuuugaaccugagcgcgaaaagagcgccgccauugauggagaguacagacugcggggcgaagcucgcaagaccuucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagaucuggacaaaggaaggcgagcgcaagaagcugcgcccccgguggcucgaugcgagaaccuauuccgacccucuggcccuucgcgaguuuaaagaguucgcugccgggcggagaagcguguccggagaucugauucucgagaucggcaagcugccccagcaccugacgcuccgggcucaaaaugcccuugacaaccuggugaugcugcacaauucugaacaagggggaaaggcuuaccgccaugccauggaggaacucccugauacaaucgagacccugaugcuucuggcgcucauugccguccugaccggcggcguuacacuguuuuuccucagcgggaagggacuuggcaagaccuccaucgggcugcugugugugauggcuucuagcgugcuccuguggauggccuccgucgagccccacuggauugcugccagcaucauucuugaauuuuuccugauggugcuccugaucccggagccugacagacagcggacaccccaggauaaccaacuggccuauguugugaucggacuccuuuuuaugauucugacggucgcugcgaacgaaaugggccugcucgagaccaccaagaaggaccuggggaucggacauguggucgccgagaaucaccaccaugcuaccaugcuugauauugaccugcacccugccucugccuggacacucuacgcuguggccaccacgaucauuacccccaugaugcgccauacaaucgaaaacaccacagcgaauauuucccugaccgccaucgcuaaccaggccgcuauccugaugggccucgauaaaggcuggccuauuagcaagauggacaucgggguuccccuucuggcccugggaugcuacucucaggugaauccgcucacgcugacagcggccguccuuaugcugguggcucacuaugccauuaucggcccugggcuccaagcuaaagccaccagagaggcucagaagcggacagccgcgggaauuaugaagaaccccaccguugauggcaucguggccaucgaccuggaccccgucguguacgaugcuaaauucgaaaagcagcuggggcagauuaugcuccuuauccuguguaccucccaaauucugcucaugcgcacaacgugggcccugugcgagagcaucacccuugcuacaggaccucugaccacacucugggaaggcucuccgggcaaauuuuggaauaccacgauugccgugagcauggccaacaucuucagaggguccuaucuggcgggagcuggccuggccuucucucucaugaaaagccuugggggaggccggcgcgggacaggagcucagggcgagacccugggcgagaaauggaagagacagcugaaucagcucuccaagagcgaauuuaacaccuacaaacgguccgggaucauggagguugacagaucugaagccaaggagggacugaaacgcggcgaaacaaccaagcaugccgucagccgggggacagcuaaacuuagaugguucguggagcgcaaucuggugaagcccgagggaaaggucauugaucucggcugugggcggggaggcugguccuauuacugcgccggccugaaaaagguuacggaagugaaaggguauaccaagggaggcccugggcacgaggaacccaucccuauggcgacauacggauggaacauugugaaacugcacucuggcagagacgucuuuuucacacccccugagaagugugauacccuccuuugcgacaucggggaaagcuccccgaaucccaccauugaggagggacgcacgcugcgggugcugaaaaugguugaaccuuggcucagaggcaaccaauuuuguaucaagauucugaaucccuacaugccuucuguggucgagacccuugaacagaugcagcgcaagcauggcgggaugcuggugcggaacccccucagcagaaauuccacacacgagauguauuggguuagcugcggaaccggcaacaucgugucugccgucaacaugacaucccgcaugcugcugaaucgguucaccauggcucauagaaaaccgacauacgagcgcgauguggaccucggggccggaaccagacacguggcugucgaaccugagaucgccaaccuggauauuaucggccagcggauugaaaauaucaagaacgagcacaaaagcacguggcauuaugacgaagauaaucccuacaagacaugggcguaucacgggucuuacgagguuaaacccuccggaagcgccucuuccauggugaacggcgugguccgccuucugaccaagccuugggacgugauucccaugguuacccaaaucgcuaugacagacacgaccccuuuuggccagcagagaguguucaaggagaaagucgauacacggaccccgagacccaagcgggggacagcccaaaucauggaagugaccgcuaaauggcucuggggauuucugagccgcaauaagaaaccuagaauuuguacacgggaggaguucacccgcaagguuagauccaacgccgcuaucggcgccguguuugucgacgagaaucaguggaacagcgcgaaggaagccguggaggaugagcgguucugggaccuuguucaucgcgaaagagagcugcacaaacaggggaagugcgcuacgugcguguauaauaugaugggaaaacgggaaaagaaacucggcgaguuugggaaggccaagggcucucgcgcuauuugguacauguggcugggagccagauuccuggaguucgaggcccucggcuuuaugaacgaggaucauugguucagccgggaaaauucccugucuggggucgagggagaaggccuucacaaacugggguacauccuccgcgacauuagcaagauccccggaggcaacauguaugcggaugacaccgcugggugggauacaagaaucaccgaggacgaucugcagaaugaggccaaaauuacagacaucauggaaccugagcacgcccuucuggcuaccuccauuuuuaagcucacguaccaaaacaaagugguccgggugcagcgccccgccaagucuggcacaguuauggaugugaucagcagacgggaccagagaggauccggccaggucgggaccuauggacugaacacauucaccaauauggaagugcaacugauucgccagauggagucugaaggcaucuuuagcccguccgagcucgggaacagcaaucuggcugagcgggugcuugacuggcuggaaaaacauggaguugagagacucaagcgcauggccaucucuggcgaugacuguguggucaagccuacggaugaccgguucgcgaccgcccugacagcucuuaacgauauggggaaagugagaaaggacauuccccagugggaaccuuccaaaggcuggaaugauuggcagcaaguucccuuuugcagccaccauuuccaccagcugaucaugaaggacggacgcgagauuguggucccuugucggaaccaggaugaacucgugggcagagcccgcgucucucagggggcuggauggucccugcgggagaccgccugccugggcaaaagcuacgcgcaaauguggcagcucauguauuuucacagacgcgaccugcggcuugccgcuaaugccaucuguuccgcugugcccguuaacugggugccgacaucuagaaccacauggagcauucaugcccaccaucaguggaugaccacggaggauaugcuguccgucuggaaucggguguggaucgaagagaacccuuggauggaagacaagacacacguuagcucuugggaggacgugcccuaccucgggaagagagaagaucaauggugcggaucccugauuggccuuaccgcucgcgccaccugggcgacaaauauccaggucgccaucaaccaggugcggaaacugauugggaaugagaacuaucucgacuacaugaccagcaugaagagauucaaaaaugagucugaucccgaaggcgcucugugguga

SEQ ID NO: 19487 - RNA, 9879 nt, Artificial Sequence
  derived and/or modified CDS sequence (opt5) from DENV-1__HM469968__SS-prME
agcgugaccaugcugcucaugcugaugcccaccgcucuugcuuuccaccugacgacccggggaggggaaccucauaugaucguguccaagcaggaacggggaaaaucucuccuguuuaagaccagcgcuggcguuaacaugugcacccuuaucgcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcaccggcgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgcccugcuuaccuggcugggacucaauucuagauccacaagccugucuaugaccuguaucgcugugggccugguuacacuuuaccucggggugaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaaguucacagugguugugggagaugucgccggcauucucgcccaggggaaaaagaugauccggccgcaacccauggaguacaaauauucuuggaaaagcuggggaaaggcuaagauuaucggcgcggacgugcagaauaccaccuuuaucauugaugggccuaacacacccgaauguccugacgaucagagagccuggaauaucugggagguggaggacuacggauucggcauuuuuaccacgaacaucuggcugaagcugcgcgauuccuauacacaggucugcgaccaccggcuuaugagcgcugccauuaaagauucuaaggccguucacgcugacaugggcuacuggaucgaauccgagaaaaaugaaaccuggaagcucgccagagcgagcuucaucgaggugaagacauguauuuggcccaaaucucauacccugugguccaacggggugcuggaaagcgagaugaucauuccgaagaucuauggaggcccuauuucucaacacaauuaccgccccggguacuucacacagaccgcuggaccuuggcaucucggcaaacuggagcuugauuuugaccugugcgaagggacgaccgucgugguugaugagcacugcggaaaccggggccccagccucagaacaaccacagugaccggcaagaucauccacgaaugguguugccgguccuguacgcugccuccccugcgcuucagaggggaggacggaugcugguauggcauggagauucggccggucaaagaaaaggaggaaaaucuugucaagagcaugguuucugccggguccggagagguggacagcuuuucccucggccugcuguguaucucuauuaugaucgaagaggucaugagaagccgcuggucccggaaaaugcucaugacagggacccuggccguguucuuucuucugauuaugggacagcucacauggaacgaucugaucagacugugcauuaugguuggcgcuaaugccucugaccgcaugggcauggggaccaccuaccuugcgcugauggcuacauucaagaugagaccuauguuugccgugggacuccuguuccggcgccucacgagcagagagguccugcuucugaccaucggccucucccugguggccucuguggaacugcccaacagccuugaggaacugggggauggacucgcuaugggcaucaugauucugaaacuccugacagacuuucaaucccaucagcuuugggccacccugcucagccugacauucaucaagaccacguuuucucugcacuaugcuuggaaaacaauggccaugguccuuuccauuguuagccuguucccccucugucugucuaccaccucccagaagacaaccuggcucccugugcugcuugggagccugggaugcaagccgcugacaauguuucucaucgcggagaauaaaauuuggggccggaagucuuggccccugaacgaaggcaucauggccguggggaucgucuccauucuucugagcucccuccugaaaaacgaugugccucucgcuggaccccugaucgccggcgggaugcuuauugcuuguuacguuaucagcggaucuagcgccgaccugucccuggagaaggccgcugaggugucuugggaagaggaagcggagcauagcggcgccucccacaauauucucgucgaagugcaggaugacgggacgaugaaaaucaaggaugaggagcgcgacgauacccugacaauccuucugaaagcuacccuccuggccguuucuggaguguauccucucagcauucccgccacacuguucgucugguacuucuggcaaaagaagaaacagagauccggcgugcuuugggacaccccuucucccccggaagucgagcgggcugugcuggaugacggcaucuaucgcauuaugcagagagggcugcucggacggagccagguuggcgugggggucuuucaagaaaacguguuccauacgauguggcacguuacccgcggagccgugcugauguaccagggcaagagacuugagccuuccugggcgagcgucaaaaaggaccugaucucuuacgggggaggcuggcggcuccagggcuccuggaauacaggggaggaaguccaggugauugcuguugagcccggcaagaacccuaagaauguccaaaccgcccccggcacauuuaagaccccggaaggggaggugggagccaucgcucuggauuucaaaccuggcacaagcgggucucccauugugaacagagaaggaaagaucgucggccucuauggcaauggggugguuacgaccuccggaacauacgugagcgccaucgcgcaggcuaaagccucccaggagggcccucugcccgagauugaagacgaggucuuucgcaagcggaaccuuaccaucauggaucugcaccccgggucuggaaaaaccagacgcuaucugccugccauugugcgggaagcuaucaagagaaagcuccgcacacugauucuugccccgacgcggguuguggcuagcgagauggccgaagcgcugaaaggcaugcccaucagauaccaaaccacagccgucaaguccgagcauaccgggaaagagaucguggaccucaugugccacgcuacauucaccaugcgccugcugagcccuguucgggugcccaauuauaacaugauuaucauggaugaagcccauuuuacggacccuucuuccauugcugccagaggcuacaucagcacacgggucggaaugggcgaggccgcugcgauuuucaugaccgccacacccccugggucuguggaggcuuuuccgcagagcaaugccgugauccaggaugaggaacgcgacauccccgagagauccuggaacucuggauaugaguggauuacagauuucccuggcaagaccgucugguuuguucccagcaucaaauccgggaaugacauugccaacugucuccggaagaauggaaagcgcgugauccagcuuucuagaaaaacauucgauaccgaauaccaaaagacgaaaaacaacgacugggacuacguggucacaaccgauauuagcgagaugggcgcuaauuuccgggccgacagagugaucgauccucgccggugccugaagcccguuauucugaaagacgggccggaaagagugauccucgcgggcccuaugcccgucacaguggcuuccgccgcccagcgccggggaagaaucggccgcaaccacaauaaggagggggaucaguauauuuacaugggacagccccugaacaaugacgaggaucaugcucacuggaccgaagccaagaugcuucuggacaacaucaauacgccugagggcauuauccccgcgcucuuugaaccugagcgggaaaagagcgccgcuauugauggggaguauagacugcgcggagaggccagaaagaccuucguugagcugaugcggcgcggcgaccucccgguguggcuuucuuacaaagucgcuuccgagggguuucaauauagcgauagacgguggugcuucgacggcgaacgcaacaaucaggugcuggaggaaaacauggaugucgagaucuggacaaaggagggagaacgcaagaagcugcggcccagauggcucgacgcccgcaccuacuccgacccucuggcccuucgggaguuuaaagaguucgccgcgggcagacgcucugugagcggggaucugauccucgagauuggaaagcugccccagcaccugacacagcgggcccaaaaugcucucgacaaccuuguuaugcugcauaauuccgaacagggcgggagagccuaucggcacgcuauggaggagcugccugauaccaucgaaacacucaugcugcuugcccugauugccgugcucaccggaggcgugacgcuguuuuuccugucuggccgcgggcucggaaagacaagcaucggccuucugugugucauggcuuccagcguucugcucuggauggcgucuguggagccccauuggauugccgcuuccaucauccuggaauuuuuccuuauggugcugcucauuccggagccugacagacagcggacaccccaggauaaccaacuggccuacgucgugaucgggcugcucuuuaugauucuuaccguugccgcuaaugagaugggacugcuggaaacaaccaaaaaggaccucggcaucgggcacguggccgucgagaaccaccaucacgcggccaugcuggauguggaccuucauccugcuagcgccuggacacuguacgcugucgccacgaccauuaucacacccaugaugcgccacaccauugaaaacacaaccgcgaauaucucucucacggccaucgcuaaccaggccgcuauucugaugggacuggauaaaggcuggccuaucuccaagauggacauuggcgugccccuccuugcccuggggugcuauagccagguuaauccgcugacccucacagcugccgugcugaugcuugucgcgcauuacgccaucauuggaccuggccugcaagcuaaagccaccagagaggcucagaagcggacagccgccgggaucaugaagaaccccaccguggauggaaucguugcgauugaccucgaucccguggucuaugacgcuaaauucgaaaagcagcugggccagaucaugcugcucauucuuuguacgucucaaauccugcugaugcgcacaaccugggcccucugcgagagcauuacacuggcuaccgggccucuuaccacacugugggagggauccccgggcaaauuuuggaauacgaccaucgccgugucuauggccaacaucuucagaggcagcuaccucgcuggggccggacuggcguucucccugaugaaaagccucggcgggggacggcgcggcacaggggcccagggagaaacccuuggcgagaaauggaagagacagcugaaucagcuguccaagucugaauuuaacacauauaaacggagcggcauuauggagguggacagauccgaagcuaaggaggggcucaaacgcggagagaccacgaagcacgccguuucucggggcacagcuaaacugagaugguucgucgaacgcaaucuugugaagcccgaggggaaggugaucgaucugggauguggcagagggggauggagcuacuauugcgccggccucaaaaaggucaccgaaguuaaaggcuacaccaaagggggaccuggccacgaggaacccauuccuauggcgacauacggguggaaccuggugaaacugcauuccggaaaggacguguuuuucauucccccugagaaaugugauacccuccuuugcgacauuggcgagucuagcccgaaucccacaaucgaagaggggagaacgcugcgcguccugaagaugguggaaccuuggcuccggggaaaccaauuuuguauuaagauccugaaucccuauaugccuuccguuguggagacccuugagcagaugcagagaaaauacggcggcaugcugguccgcaacccccucagcagaaauucuacacacgaaauguauuggguguccugcgggaccggaaacaucguuagcgccgugaauaugacaucuagaaugcugcugaaccgcuucaccauggcucaucggaagccgacguacgagagagaugucgaccucggcgccgggacccgccacguggcuguggaaccugaggucgccaaccuggauauuaucggacagagaauugaaaauaucaaacacgagcauaaguccacauggcacuaugacgaggauaaccccuacaaaaccugggcuuaucauggcagcuacgaaguuaagcccucuggguccgccagcuccauggugaauggaguggucaaacuucugacaaaaccuugggacgugauucccaugguuacccaaaucgcgaugacagauaccacgccuuuuggccagcagcggguguucaaggagaaagucgacacacgcaccccgaaggccaaaagaggcaccgcucaaaucauggaagugacagcccgguggcucuggggguuucugagcagaaacaagaagccccggauuuguacgcgcgaggaguucaccagaaaaguucggucuaaugcugccaucggagccguguuugucgacgagaaccaguggaauagcgcgaaggaggcuguggaagaugagcgcuucugggaccuuguucacagagaacgggagcugcauaaacagggcaagugcgccacaugcguguacaacaugauggggaaacgcgaaaagaagcucggagaguuuggcaaagccaagggguccagagcuauuugguauauguggcugggcgcccgguuccuggaguucgaagcucucggauuuaugaaugaggaucacugguucucucgcgaaaacagccuguccggcgucgagggggagggacuucacaaacugggcuacauccucagagacauuucuaagaucccugggggaaauauguaugccgaugacaccgcgggcugggauacacggaucaccgaagacgaucugcagaacgaggccaaaauuacagacaucauggaacccgagcaugcccuucuggccaaggcuauuuuuaaacucaccuaccaaaauaaggugguccgcgugcagagaccugccaagaacgggacgguuauggaugugaucagccggcgcgaccagagaggcuccggacaggucggcaccuaugggcugaauacauucaccaacauggaagcgcaacugauucggcagauggagucugagggaaucuuucuccccagcgaacuggagacaccgaaccuugccgaaagagugcuggauuggcucgagaaauacggcguggaacgccugaagcggauggcuaucuccggggacgacuguguugugaaaccuauugaugacagauucgccaccgcucuuacggcccugaaugauaugggaaagguccgcaaagacaucccccagugggagccuagcaagggcuggaacgauuggcagcaagugcccuuuugcucucaccauuuccaccagcucauuaugaaggacgggcgggagaucguugugccuuguagaaaucaggaugaacuggucggccgcgcucgggugucccagggagccggcuggagccugagagagacagcgugccucgggaaaucuuaugcccaaauguggcagcugauguacuuucaccgccgggaccuuagacuggcugccaacgccauuuguuccgcuguccccguggauuggguuccgaccagccgcacaaccugguccauccaugcccaccaucaguggaugacgaccgaagacaugcucucuguguggaaucgggucuggauugaggaaaacccuuggauggaggauaagacacacaucagcuccugggaggacgugcccuaccugggaaaaagagaagaccaauggugcggcagccuuaucgggcugaccgcgcgggcuacaugggccaccaauauucagguugccaucaaccaggugagacgccucauuggaaaugagaacuaucuggauuacaugacaucuaugaagcgguucaaaaaugaauccgaccccgagggcgcucugugguga

SEQ ID NO: 19488 - RNA, 9879 nt, Artificial Sequence
  derived and/or modified CDS sequence (opt5) from DENV-1__KC172834__SS-prME
agcgugaccaugcugcucaugcugaugcccacagcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccgagaaucacagaggcugaacccgacgauguggacuguuggugcaaugccaccgauacgugggugaccuauggaacauguucccaggccggcgagcacagacgggacaagcgcucugucgcucuggccccucauguggggcugggacucgagaccagaacagaaaccuggaugagcuccgagggcgcuuggaaacagauucagcggguugaaacgugggcccugcgccaccccggcuucacagugaucgcgcuuuuucuggcccaugcuauugggaccucuaucacacagaagggaaucauuuucauccuccugaugcuugucaccccuagcauggccaugagaugcgugggcauugggucccgggauuuuguugagggacugagcggcgcuaccuggguggacgucgugcucgagcacgggucuugugugacaacgauggccaaggauaaacccacccuggacaucgaacugcucaagacagaggucaccaacccugcgguucugcgcaaacuuugcauugaagccaagaucuccaauacaaccacggauagcagauguccgacacaaggagaggcuacccugguggaagaacaggacgccaacuucgugugccggcgcaccuuugucgauagaggcuggggcaauggguguggacucuucggcaaagggucucugcuuacaugcgcuaaguuuaagugcgugaccaaacuggagggaaagauuguucaguacgaaaaccucaaauauuccgugaucgucacagugcacacgggcgaccagcaucaaguugggaaugagagcaccgaacacggaacaaccgccacaaucacaccccaggccccuacgaccgagauucagcugacagacuacggcgcucugacccucgauuguucuccccggacaggccuggacuucaacgaaauggugcuucugaccaugaaggagaaauccuggcucguccauaagcagugguuucuggaucuuccucugcccuggacgagcggggcguccacaucucaagagaccuggaaucgccaggaccuccuggugacauucaaaaccgcccacgcuaagaagcaggaagucgugguucugggaagccaagagggcgccaugcacaccgcccucacaggggcuacggaaauccagaccuccggaacaaccacaauuuuugccggccaucugaaaugcagacuuaagauggauaaacugacccucaaggggaugagcuaugugauguguacgggcucuuucaaacuggagaaggaagucgcggagacacagcacggaaccgugcugguucagaucaaguacgagggcaccgacgcuccgugcaaaauuccuuucuccacacaagaugaaaagggggugacccagaacggacggcuuaucacagccaaucccaucgucacggacaaagagaagccugugaacauugaagccgagccgcccuuuggcgagagcuauaucgugauuggggcuggagaaaaagcccucaagcugucuugguucaagaaaggcagcuccaucgggaagauguuugaggcuaccgccagaggcgcgcgccggauggccauucugggagauacagcuugggacuucggcucuaucgggggaguuuuuaccagcgucggcaaacucgugcaucagaucuucgggacagccuacggagugcuguuuuccggcgucagcuggaccaugaagauugggaucggcgugcuucugacguggcucggacucaauucuagauccaccagccugucuaugacauguauugcuguuggccuugugacccucuaccugggggucauggugcaggccgauuccggaugcguuaucaacuggaaaggccgcgaacugaagugugggagcggaauuuucgugacaaaugagguccacaccuggacagaacaauauaaguuucaggcggacuccccuaaacggcucucugccgcuaucggcaaggccugggaggagggggugugcggcauuagaagcgcuacccgccuggaaaacaucauguggaaacagaucuccaacgagcuuaaucauauucugcucgaaaacgacaugaaguucacgguuguggucggagauguggccggcauccuggcccaggggaaaaagaugauucggccgcaacccauggaguacaaauauucuuggaaaagcuggggaaaggcuaagaucauuggcgcggacgugcaaaauuccacauuuaucaucgaugggccuaacacccccgaauguccugacgaucagagagccuggaauauuugggaggucgaggacuacggauucggcaucuuuaccacaaacauuuggcugaaacuucgcgauagcuauacccagguuugcgaccaccggcucaugucugcugccaucaaagauuccaaggccgugcacgcugacaugggcuacuggauugaaagcgagaaaaaugaaacguggaagcuggccagagcgucuuucaucgaggugaagacauguaucuggcccaaaucccauacccuguggagcaacgggguccucgaaucugagaugauuaucccgaagauuuauggaggcccuaucagccaacacaauuaccgccccggguacuucacacagaccgcuggaccuuggcaucugggcaaacuugagcuggauuuugaccucugcgaagggacaaccgugguuguggaugagcacugcggaaaccggggccccucccugagaacgaccacagucaccggcaagauuauccacgaaugguguugccggagcuguacacugccuccccuucgcuucagaggggaggacggaugcugguauggcauggagauccggccggugaaagaaaaggaggaaaaucucguuaagucuaugguguccgccgggagcggagaggucgacuccuuuucucugggccugcucuguauuagcaucaugauugaagaggugaugagaucccgcuggucucggaaaaugcugaugaccgggacgcuugccguuuucuuucugcucaucaugggacagcugacauggaacgaucugauuagacuuugcaucauggugggcgcuaaugccagcgaccgcaugggcauggggaccacauaccuggcgcucauggcuaccuucaagaugagaccuauguuugccgucggacugcuguuccggcgccugaccuccagagaggugcuucugcucacaauuggccugucucugguggccagcgucgaacuucccaacucccuggaggaacucggggauggacuggcuaugggcaucaugauccucaaacugcuuacggacuuucaaagccaucagcugugggccacccuccugucucugacauucauuaagaccacauuuucccuucacuaugcuuggaaaaccauggccaugguucugagcaucgugucucucuucccccugugucucuccacgacaagccagaagaccaccuggcugccugugcuucuggggucucugggaugcaagccgcucacaauguuucugauugcggagaauaaaaucuggggccggaaguccuggccccuuaacgaaggcauuauggccgucgggaucgugagcauccugcucuccagccugcucaaaaacgauguuccucuggcuggaccccuuauugccggcgggaugcugaucgcuuguuacgugauuucuggaagcuccgccgaccugucucucgagaaggccgcugaggucagcugggaagaggaagcggagcauuccggcgccucucacaauauccugguggaaguucaggaugacgggaccaugaaaauuaaggaugaggagcgcgacgauacacuuacgauccugcucaaagcuacccugcucgccgugagcggagucuauccucuguccauccccgccacacuuuucgugugguacuucuggcaaaagaagaaacagagaucuggcguccugugggacaccccuagcccucccgaaguggagcgggcuguucuggaugacggcauuuaucgcaucaugcagagagggcuccugggacggucccaggugggcgucgggguguuucaagaaaacguuuuccauacaauguggcacgugacccgcggagccguccuuauguaccagggcaagagacuggagcccagcugggcgucugugaaaaaggaccucauuuccuacgggggaggcuggcgguuucagggcagcuggaauacgggggaggaagugcagguuaucgcugucgagcccggcaagaauccuaagaaugugcaaaccgcccccggcacauucaagaccccggaaggggaggugggagccauugcucuggauuuuaaaccuggcacaucugggucccccaucgucaacagagaaggaaagauugugggccucuauggcaaugggguugugaccacaagcggaacguacgucuccgccaucgcgcaggcuaaagccucucaggagggcccucugcccgagaucgaagacgagguguuccgcaagcggaaccuuaccauuauggaucugcaccccgggagcggaaaaacaagacgcuaucugccugccaucguucgggaagcuauuaagagaaagcuccgcacccugauccuugccccgacccggguggucgcuuccgagauggccgaagcgcugaaaggcaugcccauuagauaccaaacaacggccgucaagagcgagcauaccgggaaagagaucguugaccucaugugccacgcuacauuuaccaugcgccugcugucuccugugcggguccccaauuauaacaugaucauuauggaugaagcccauuucacagacccuuccagcaucgcugccagaggcuacauuucuacccgggugggaaugggcgaggccgcugcgaucuuuaugacggccacacccccugggagcauggaggcuuucccgcaguccaaugccgugauucaggaugaggaacgcgacauccccgagagaucuuggaaccucggacacgaguggaucaccgauuuuccuggcaagaccgucugguucguucccagcauuaaagccgggaaugacaucgcuaacugucuucggaagaauggaaagcgcgugauucagcuguccagaaaaacauucgauaccgaauaucaaaagaccaagaacaacgacugggacuacguggucaccacggauaucucugagaugggcgccaauuuucgggcggacagagugauugauccucgccggugccugaagcccguuauccucaaagacgggccggaaagagugauucuggcuggcccuaugcccgucacaguggccagcgccgcucagcgccggggaagaaucggccgcaaccauaauaaggagggggaucaguacaucuauaugggacagccccuuaacaaugacgaggaucacgcccacuggaccgaagcgaagaugcugcucgacaacauuaauacaccugagggcaucauucccgcccuguucgaaccugagcgggaaaaauccgcugccaucgauggggaguacagacugcgcggagaggcuagaaagaccuuuguugaacucaugcggcgcggcgaccuuccgguguggcugagcuauaaagucgccucugagggguuccaauacuccgauagacgguggugcuuugacggcgaacgcaacaaucaggugcuggaggaaaacauggaugucgagauuuggacgaaggagggagaacgcaaaaagcuccggcccagauggcuggacgcucgcaccuauagcgacccucuugcccugcgggaguucaaagaauuugcggccggcagacgcuccgugucuggggaucucauccuggagaucggaaagcugccccagcaucucacacagcgggcucaaaaugcccuugacaaccugguuauucugcacaauagcgaacagggcgggagagcuuaccggcaugccauggaggagcucccugauaccaucgaaacacugaugcuucuggcccucauugcugugcugaccggaggcgugacacuguucuuucucuccggcaaggggcuuggaaaaaccucuaucggccugcugugugucauggcgagcuccguucuccuguggauggccagcguggagccccacuggauugcugccucuaucauccuugaguucuuucugauggugcuccugauuccggagccugaccgccagagaacgccccaggauaaccaacuggccuaugucgugaucgggcuccuuuucaugauucugacaguugcugccaaugagaugggacugcucgaaaccaccaagaaagaccugggcaucgggcacguggcggucgagaaccaucaccaugccgcuaugcuugauguggaccugcacccugccuccgcuuggacacucuacgccgucgcgaccacaauuaucacgcccaugaugcggcauaccauugaaaacacaaccgccaauaucagccugacagcuaucgccaaccaggcugccauucugaugggacucgauaagggcuggccuaucucuaaaauggacauuggcgugccccuucuggcucuggggugcuacucccagguuaauccgcucacccugacggccgcggugcuuaugcuggucgcccacuaugcuaucauuggaccuggccuccaagccaaggcuacccgcgaggcccagaagagaacagccgcggggaucaugaaaaaccccaccaucgauggaauuguggcuaucgaccuggaucccguuguguacgacgccaaguuugaaaaacagcugggccagauuaugcuccuuauccuguguacaagccaaauucugcucaugcggaccacgugggcucugugcgagucuaucacacuugccaccgggccucugacaacccucugggagggaagcccgggcaaguucuggaauaccacaaucgccgucuccauggcuaacauuuuccgcggcucuuaucuggccggggcgggacuggccuuuagccucaugaaaucccuuggcgggggaagacggggcacgggggcucagggagaaacccugggcgagaaguggaagcgccagcugaaucagcucagcaaauccgaguucaacacauacaagagaucuggcaucauggaaguggaccggagcgaagccaaagaggggcugaagagaggagagaccacaaaacacgcugugucccgcggcaccgccaaacuucggugguuuguugaaagaaaucuggucaagcccgaggggaaagugauugaucucggauguggccgcgggggauggucuuauuacugcgcgggccugaagaaagugacggaagucaagggcuauacaaaagggggaccuggccaugaggaacccaucccuauggccaccuacggguggaaccugguuaagcuccacagcggaaaagacguguucuuugugcccccugagaagugugauacccuucugugcgacauuggcgaguccucuccgaaucccacaaucgaagaggggcggacccugagaguccucaagaugguggaaccuuggcugcgcggaaaccaauucuguauuaaaauccuuaaucccuacaugccuagcguuguggagacacuggagcagaugcagcggaagcauggcggcaugcucgucagaaacccccugucccgcaauagcacgcacgaaauguauugggugucuugcgggaccggaaacaucguuuccgcugugaauaugacaagccggaugcugcucaacagauuuaccauggcccaccgcaaaccgacauacgagcgggaugucgaccugggcgcugggaccagacauguggccguggaaccugaggucgcuaaccuugauauuaucggacagcgcauugaaaauaucaagcacgagcauaaaucuacguggcacuaugacgaggauaaccccuacaagaccugggccuaucauggcuccuacgaaguuaagcccagcgggucugcguccagcauggugaauggaguggucaaacugcucacaaagccuugggacgugauucccaugguuacccaaaucgccaugacagauaccacaccuuucggccagcagagaguguuuaaagagaaggucgacacccggacgccgaaagcuaagcgcggcacagcccaaaucauggaagugaccgcuagauggcuguggggguuccuuucccggaacaagaaacccagaauuuguacccgggaggaauuuacacgcaagguuagaagcaaugccgccaucggagcgguguucgucgacgagaaccaguggaacucugcuaaagaggccguggaagaugaccgguuuugggaucugguucaccgcgagagagaacuccacaagcagggcaaaugcgccacgugcguguauaacaugauggggaagcgggagaagaaacugggagaguucggcaaggcuaaagggagccgcgccauuugguacauguggcugggcgcuagauuccucgaguuugaggcccugggauucaugaaugaagaccauugguuuucccgggagaacucucuuagcggcgucgaaggggagggacugcacaagcucggcuacauccugcgcgauauuuccaaaaucccugggggaaauauguaugcggacgauaccgccggcugggacacaagaaucaccgaggaugaccuucagaacgaagcuaagauuacagauaucauggagcccgaacaugcccugcucgcuaaaucuauuuucaagcugaccuaccaaaauaaggugguccgggugcagcgcccugccaaaaacgggacaguuauggacgugaucagcagacgggaucagcgcggcuccggacaggucggcaccuaugggcugaauacguuuaccaacauggaggcgcaacucauuagacagauggaaucugagggaaucuucagccccaacgagcuggaaacaccgaaucuugccgagcgggugcuggacuggcucgaaaaguacggcguggagagacugaaacgcauggcuaucuccggggacgauuguguugugaagccuauugacgaucgguuugccaccgcucuuacagcccugaacgacaugggaaaagucagaaaggauaucccccagugggaaccuagcaagggcuggaaugacuggcagcaagugcccuucugcucucaccacuuucaucagcucauuaugaaagaugggcgcgagaucguugugccuugucggaaccaggacgagcuggucggcagagcucgcgugucccagggagccggcugggggcugcgggaaaccgcgugccucggaaagagcuaugcccaaauguggcagcugauguacuuccacagacgcgaucuucggcuggcugccaaugccauuuguucugcuguccccguggacuggguuccgacguccagaacaaccuggagcauccaugcccaccaucaguggaugacaaccgaggauaugcucuccguguggaaccgcgucuggauugaagagaauccuuggauggaagacaaaacgcggaucucuagcugggaggacgugcccuaucugggcaagagagaggaucaauggugcgggucccuuaucggacugaccgcgcgggcuacaugggccaccaacauucagguugccaucaaucaggugagacgccucauuggcaacgaaaauuacagcgacuacaugacaucuaugaaacgguuuaagaacgaguccgaacccgagggggcucugugguga

SEQ ID NO: 19489 - RNA, 9879 nt, Artificial Sequence
  derived and/or modified CDS sequence (opt5) from DENV-1__KJ933413__SS-prME
agcgugaccaugcugcucaugcugcuucccacagcucuggcuuuccaccucacgacccggggcggggaaccucauaugaucgucuccaagcaagaacggggaaaaucucugcuuuuuaagaccagcaccggcguuaauaugugcacacugauugccauggaccucggggagcugugugaagauaccaugacauacaaaugcccccgcaucaccgagacggaacccgacgauguggacuguuggugcaaugcgaccgagacaugggugaccuauggaacauguucccaaaccggcgagcacagacgggauaagcgcucugucgcucuggccccucauguggggcucggacuggaaacgagaacagagaccuggaugagcuccgaaggcgccuggcggcagauucagaaaguugagacaugggcccuucgccaccccggcuucaccgugaucgcccuguuucucgcucaugccauugggaccucuaucacacagaagggaaucauuuucauccugcuuaugcuggucacgccuagcauggcgaugagaugcgugggcauugggaaccgggacuuuguugagggacucuccggcgccaccuggguggaugucgugcuggaacacgggagcugugugacaaccauggcuaaggacaaacccacacuggauaucgagcuccugaagaccgaagucacgaauccugccguucuucgcaaacugugcauugaggcuaagaucucuaacacaaccaccgacuccagauguccgacacaaggagaagccacccucguggaggagcaggauacaaauuucgugugccggcgcacgcuggucgacagaggcuggggcaacggguguggacuuuuuggcaaagggagccugauuaccugcgcgaaguucaagugcgugacaaaacucgaaggaaagaucguucaguacgagaaucugaaauauucugugaucgucaccgugcacacaggcgaucagcaucaaguugggaacgaaaccacggagcacggaaccacagccaccauuacaccccaggcuccuaccuccgaaauccagcugacggacuacggcgcccucacacuggacuguagcccccggaccggccuugauuuuaaugagauggugcugcucacaaugaaggagaaaucuuggcugguccauaagcagugguuccuugaccugccucuccccuggaccuccggggcuagcaccucccaagaaacauggaaccgccaggaucugcuggugacguuuaaaaccgcccacgccaagaagcaggaggucgugguucucggaucucaagaaggcgcuaugcacacagcgcugaccggggccacagagauucagaccagcggaacgacaaccaucuucgcuggccaucuuaaaugcagacugaagauggacaaacucacccugaaggggguguccuaugucauguguacaggcagcuuuaaacuggaaaaggagguggccgagacccagcacggaacaguucuugugcaggucaaguacgaaggcacggaugccccgugcaaaauuccuuucaccucucaagacgagaagggggugacacagaauggacggcucaucaccgcuaaccccaucgugacagauaaagaaaagccuguuaauauugaggccgagccgcccuucggcgaauccuaucuggucgugggggcgggagagaaagcucugaagcucagcugguuuaagaaaggcucuagcaucgggaagauguucgaagccaccgccagaggcgcucgccggauggccauucugggagacacggcuugggauuuuggcuccaucgggggaguguucaccucugucggcaaacuuauucaucagaucuuugggacagccuacggagugcuguucagcggcguuuccuggaccaugaagaucgggauuggcauccuccugacauggcugggacuuaacagcagaucuaccucccucagcaugacauguauugcggugggcauggucacccuguaccugggggugaugguucaggccgacucuggaugcgugaucaauuggaaaggccgcgagcucaaguguggguccggaauuuuugucacgaacgaagugcacacauggaccgagcaauauaaguuccaggcugauagcccuaaacggcuguccgccgcuaucggcaaggccugggaggaagggguuugcggcauuagaucugugacccgccuugagaacaucauguggaaacagaucagcaaugaacugaaccauauucuccuggagaaugacaugaaguuuacagucguggugggagacgucaacggcauccuggcgcaggggaaaaagaugauucggccgcaacccauggaacacaaauacuccuggaagucuuggggaaaggccaaaguuaucggcgcugaugugcagaauagcaccuucauuaucgacgggccuaacacgcccgaguguccugaugaccagagagccuggaauaucugggagguggaagauuauggauuuggcauuuucacaaccaacaucuggcuuaagcuccgcgacuccuacacacaggucugcgaucaccggcugaugagcgcugccauuaaagacucuaaggccgugcaugcugauaugggcuauuggaucgaguccgagaaaaaugagaccuggaagcugacaagagcgagcuuuauugaaguuaagaccuguguguggcccaaaucucacacgcucugguccaacgggguccuggagagcgagaugaucaucccgaagauuuacggaggcccuaucucucaacauaauuaucgccccggguacuucacccagacagccggaccuuggcaccuuggcaaacuggaacucgacuucgggcugugcgagggaaccacagugguuguggaugaacacugcggcaaccggggccccagccugagaaccacgacagucaccgggaagauuauccaugagugguguugccgguccuguacacuuccuccccuccgcuuuaaaggagaggacggcugcugguacgggauggaaauuagaccggugaaggagaaggaagagaaucugguuaaaagcauggugucugcuggauccggcgaagucgauagcuucucccuggggcuccuguguaucucuaucaugauugaggaggugaugcggagcagauggucccgcaagaugcuuaugaccggaacccuggccguguuucuccugcugaucaugggccagcuuacauggaacgaccugauucggcucugcaucauggucggcgccaaugcuucugacaaaauggggaugggaacgaccuaucuggcccucauggcgacauucagaaugcgcccuauguuugcuguuggccugcuuuucagacggcugaccagccgcgaagugcuccugcugacaguggggcuuucccuggucgccucuguggagcuccccaacagccuggaagaacucggagauggccuggccauggggauuaugaugcuuaagcugcucaccgacuuucaaucccaccagcugugggcugcccugcuuagccugacguucguuaaaacaaccuuuucucuccauuacgcguggaagaccauggcuaugauccuguccauugugagccucuucccccugugucuuucuacaaccucccagaagacaacguggcugccuguccugcucggaagccugggcugcaaaccgcuuaccauguuucugaucacagaaaacagaaucuggggccggaagucuuggccccucaaugaggggauuauggccgugggaaucguuuccauucugcucagcucccugcuuaaaaacgaugugccucuggccggcccccugaucgcugggggaaugcucauugccuguuaugucaucagcggcucuagcgcugaccugucccuugagaaggccgcggaagugucuugggaggaagaggccgaacacagcggggcuucccauaauauccuggucgaggugcaggaugacggaaccaugaaaauuaaggaugaggaacgcgacgauacacucaccauccugcucaaagccacgcugcuugcuauuucuggcguuuacccuaugagcauccccgccacccuguucgugugguauuuuuggcaaaagaagaaacagagauccggcguccugugggacacaccuucucccccggagguggaacgggccguucucgaugacgggauuuaccgcauccugcagagaggacuucugggcaagagccaggugggggucggaguguuccaagagggcguguuccacaccauguggcacguuacaagaggggcuguccucauguaucagggaaaacgccuggagccuuccugggcgagcgugaagaaagaucucaucucuuacggcggcggguggagauuucagggauccuggaacaccggcgaagaggugcaggucauugccguggaacccgggaagaauccuaagaacguucaaacagcucccggaacguucaaaaccccggagggcgaagugggggccaucgcccuggacuuuaagccuggaacaagcggcucucccauugucaaucgggagggcaaaaucguggggcuuuacggaaacggcguugugaccaccuccgggacauaugucagcgcuauugcccaggcgaaggcuucccaggagggaccucugcccgaaaucgaggacgaaguguucagaaaacgcaaucugacgauuauggaucuccaucccggcucugggaagacccggagauaccugccugccaucguucgcgaggccaucaagcggaaacuuagaacacuggugcucgcuccgacccgcgucguggccagcgaaauggcggaggcucugaagggcaugcccauucgguaucaaacaaccgccgugaaauccgagcacacgggaaaggaaaucgucgaccugaugugccaugccacauuuaccaugagacuccuuagcccuguucgcgugcccaacuacaauaugauuaucauggaugaggcucacuucaccgacccugccucuauugcugcccggggcuauaucuccacaagaguggggaugggagaagcggccgcuaucuuuaugaccgccacacccccuggcagcauggaggcuuucccgcagucuaacgccgccauucaggaugaagaacgggacauccccgagcgcagcuggaacuccggguacgauuggauuaccgacuuuccuggaaaaacggucugguucgugcccucuaucaagagcggcaacgauauugcuaauugucugagaaagaacgggaaacggguugugcagcugucccgcaagacauuugacaccgaauaucagaaaaccaagaacaaugauugggacuacgucgugaccacggacaucucugagaugggcgcgaacuucagagccgaucggguuaucgacccuagacgcugccucaaacccgugauucugaaggauggaccggaacgggucauccuugcuggcccuaugcccgugaccgucgccagcgccgcucagagacgcgggcggauuggaagaaaucagaacaaggagggcgaccaguacaucuauauggggcaaccccugaauaacgaugaggaccaugcccacuggacagaagcgaaaaugcuccuggauaauauuaacaccccugagggaaucauucccgcucuguucgaaccugagcgcgaaaaguccgccgccaucgacggcgaguaccggcucagaggggaggcucgcaaaacauuuguggaacuuaugagacggggcgaucugccgguuuggcugagcuauaagguggccucugagggauuccaguacuccgaccgcagauggugcuuugauggcgaacggaauaaccaggugcucgaggaaaauauggacgucgagaucuggaccaaagagggggaacgcaagaaacugagaccccgguggcuugaugcgagaacauauagcgacccucuggcccuccgcgaguucaaggaauuugcugccggacggagauccguuucuggcgaccugauucuggagaucgggaagcucccccagcaccuuacccaacgcgcucagaacgcccuggauaaucuggugaugcuccauaacagcgaacagggaggcaaggcuuaccggcacgccauggaggagcugccugacacgauugaaacacuuaugcugcucgcgcugaucgccgugcugaccggcggggucacccucuucuuucuuuccggaagaggccuggggaagacaucuauuggacugcucugugugauggcuagcuccgcccugcuuuggauggcuagcguugagccccauuggaucgccgccucuaucauucuggaguucuuucucauggugcugcugaucccggagccugaucggcagcgcacaccccaagacaaucagcucgcuuaugucgugauuggccuucuguucaugauccugacagucgcggccaacgagauggggcuccuggaaacgaccaaaaaggaucuuggaauuggccacguggcugccgagucccaccaucacgccgcuaugcuggacguugaucuccauccugccagcgcguggacacuguacgccguggcuaccacagucaucacccccaugaugagacacacgaucgaaaacaccacagccaauauuucucugaccgcuaucgccaaccaggcggccauucucaugggccuugacaaaggguggccuaucuccaagauggauauuggagugccccugcuggcucucggcugcuacagccaaguuaauccgcugacacuuaccgccgcugugcugaugcucgucgcccauuaugcuaucauugggccuggacugcaggccaaggcgacgcgggaggcccagaaacgcacagcugccggcaucaugaagaaccccaccguggacgggaucguggcuauugaucuggaccccguugucuacgaugccaaauuugaaaagcagcucggacaaaucaugcuucugauucuguguacaucucagauccuccugaugagaaccaccugggcccuuugcgagagcauuacacuggcgacgggcccucucaccacacugugggagggcuccccggggaaauucuggaauaccacaaucgcugugucuauggccaacaucuuucggggaagcuaucuggcuggcgccgggcucgccuucucccuuaugaaaagccugggaggcgggcgcagaggaaccggcgcucagggcgaaacgcugggggagaaguggaaacggcagcucaaucaacuguccaagucugaguucaacacauacaaacgcagcggaauuaucgagguggacagauccgaagccaaggagggccuuaaaagaggggaaaccaccaagcacgcggucucucggggaacagccaagcugcgcugguuuguugaacggaaucucgugaaacccgagggcaaggugauugaccugggguguggaagaggcggcuggagcuauuacugcgcugggcugaaaaaggucaccgaagugaaaggauauacaaagggcgggccuggacacgaggaacccaucccuauggccacguacggcuggaaccucguuaaacuucauuccgggaaggauguguucuuuacacccccugagaagugugacacacugcugugcgauauuggagagucuagcccgaaucccaccaucgaagagggccgcacacuccggguccugaaaaugguggaaccuuggcuuagaggcaaccaguucuguaucaagguucugaaucccuacaugccuuccguggucgagacccucgagcagaugcagcgcaaacacgggggaaugcuggugcggaacccccugagcagaaauucuacgcaugaaauguauuggguguccugcggcaccgggaacauugucagcgcuguuaauaugacaucucgcaugcuccugaaccgguuuaccauggcccacagaaagccgacauacgagcgcgacguggaucuuggagcgggcacccggcacguggccgucgaaccugagguggcuaaccuggacaucauugggcaaagaaucgaaaauauuaaaaacgagcauaaguccacauggcacuaugaugaggacaaucccuacaagaccugggccuaucauggaagcuacgaaguuaaacccucuggcuccgcuagcuccauggugaacggcgucgugcgccuccugacgaagccuugggauguuauccccauggugacacagauugccaugaccgacaccacaccuuucgggcagcaaagagucuuuaaagagaagguggauacgcggaccccgaaagcuaagcgcggaacagcccagaucauggaaguuaccgcgagauggcuuuggggcuuccugagccggaauaagaaacccagaaucuguacacgggaggaauuuaccaagaaagugcgcucuaacgccgcuauuggggccgucuucguggacgagaaucaguggaacagcgcuaaggaggccgucgaagacgagagauuuugggaucucgugcaccgggaacgcgagcugcauaaacagggaaagugcgccacaugcguuuauaauaugaugggcaagagagagaaaaagcugggggaguucggcaaagcgaagggaucccgggcuaucugguacauguggcucggcgcccgcuuucuggaguucgaagcccuuggguucaugaacgaggaccacugguuuucuagagaaaauagccuguccggaguggagggcgaggggcuccacaaacugggauacauucuucgggauaucucuaagauuccuggcgggaacauguaugcugacgauaccgccggcugggacacgcgcaucaccgaagaugaccugcaaaaugaggcuaaaaucacagauauuauggaacccgagcaugcccuccuggcgaccagcaucuucaagcugacauaccagaacaaggucgugagagugcagcggccugccaaaaauggaaccguuauggacgugauuucccgcagagaucagcggggcucugggcaagucggaacguauggccucaacacauuuaccaacauggaagcucagcugauccgccagauggagagcgaggggauuuuccuucccuccgaacuggagacaccgaaucucgccgaaagagugcuggacuggcuugagaaguacggaaucgaacggcugaaaagaauggcuaucagcggcgaugacuguguugugaagccuauugacgaucgcuuugccaccgcgcucacggcccugaacgacauggggaaaguccggaaggauaucccccagugggagccuucuaagggcuggaaugacuggcaacaggugcccuucugcucccaccauuuucaccagcugauuaugaaagauggaagagagaucgucgugccuugucgcaaccaggacgaacucguuggccgggcuagagugagccaaggggccggauggucucugcgcgagaccgcuugccuuggcaaguccuaugcccagauguggcagcugauguacuuccaccggagagaucuccgccuggcugccaaugcgauuuguagcgccguccccguggacuggguuccgacaucccggaccacauggucuauccaugcucaccaucaauggaugaccacagaagauaugcuuagcguguggaacagagucuggaucgaggaaaauccuuggauggaggacaaaacccacguguccagcugggaggaugugcccuaucuggggaagcgcgaagaccaguggugcggaucucucauuggccugacggcccgggccacaugggcuaccaacauccagguugccauuaaucaggucagacggcugaucgggaacgagaauuaccucgacuacaugaccuccaugaaaagauuuaagaacgaaagcgaucccgagggcgcgcugugguga

SEQ ID NO: 19490 - RNA, 9879 nt, Artificial Sequence
  derived and/or modified CDS sequence (opt5) from DENV-1__KU666942__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggaguuaacaugugcacccuuauugcgauggaccugggggaacucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaggacgcuaacuucgugugccggcgcacauuuguggauagaggcuggggcaauggguguggacucuucggcaaagggucucugaucacaugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucuacggcgaucggcaaggccugggaggagggggucugcggcaucagaagcgcuacacgccucgaaaacauuauguggaaacagaucuccaacgagcugaaucauauucuucuggaaaacggaaugaaguucaccgugguugugggcgacgucgccgggauccucgcucagggcaaaaagaugauucggccgcaacccauggagcacaaauacucuuggaaaagcuggggcaaggccaagaucaucggggccgaugugcagaauaccacauuuauuaucgacggaccuaacacccccgaauguccugaugaccagagagcuuggaauauuugggagguggaggauuauggcuucggcaucuuuacgacaaacauuuggcugaagcugcgcgacuccuacacccaggucugcgaucaccggcuuaugagcgcggccaucaaagacucuaaggcuguucaugccgauaugggguauuggaucgaauccgagaaaaaugaaacauggaagcucgccagagcuagcuucauugaggugaagaccuguaucuggcccaaaucucacacacugugguccaacggagugcuggaaagcgagaugauuaucccgaagauuuacggcgggccuaucucucaacauaauuaucgccccggauacuucacccagacggccggcccuuggcaccucgggaaacuggagcuugacuuugaucugugcgaaggaaccacagucgugguugacgagcacugcggcaaccggggccccagccucagaaccacaaccgugacggggaagaucauucaugaaugguguugccgguccuguacacugccuccccugcgcuacagaggagaggauggcugcugguaugggauggagauccggccggucaaagaaaaggaggaaaaucuugucaagagcaugguuucugcgggauccggcgagguggacagcuucucccucgggcugcuguguauuucuaucaugauugaagaggucaugagaagccgcuggucccggaaaaugcucaugaccggaacacuggcuguguuuuuccuucugaucaugggccagcucaccuggaacgaccugauuagacugugcaucaugguuggcgccaaugccucugaucgcauggggaugggaaccacauaccuugcucugauggccacguuuaagaugagaccuauguucgcggugggccuccuguuucggcgccucaccagcagagagguccugcuucugacaaucgggcucucccugguggcuucuauggaacugcccaacagccuugaggaacugggagacggccucgccauggggauuaugauccugaaacuccugaccgauuuccaaucccaccagcuuugggccacacugcucagccugaccuuuauuaagacgacauucucucugcauuaugcuuggaaaaccaucgccauggugcuuuccauugucagccuguuuccccucugucugucuaccacaucccagaagaccacauggcucccuguucugcuuggaagccugggcugcaagccgcugacgauguuccucaucgcugagaauaaaaucuggggccggaagucuuggccccugaacgaagggauuauggccgugggaaucguguccauucuucugagcucccuccugaaaaacgacgucccucucgcgggcccccugaucgccgggggaaugcuuauugcuuguuacgugaucagcggcucuagcgccgaucugucccuggagaaggcugccgagguuucuugggaagaggaagccgagcacagcggggcuucccauaauauccucguggaaguccaggacgauggaaccaugaaaauuaaggacgaggagcgcgaugacacacugaccauccuucugaaagcgacacuccuggccgugucuggcguuuauccucucagcauucccgcuacccuguuugugugguacuucuggcaaaagaagaaacagagauccggcguccuuugggauacgccuucucccccggaaguggagcgggccguccuggacgaugggaucuaucgcauuaugcagagaggacugcucggccggagccagguggggguuggaguguuccaagaaaacgucuuucacaccauguggcacgugacacgcggcgccguucugauguaccaggggaagagacuugagccuuccugggcuagcgugaaaaaggaccugaucucuuacggaggcggcuggcggcuccagggguccuggaauaccggagaggaaguccaggugauugccguggagcccggcaaaaacccuaagaauguucaaacagcgcccgggaccuucaagacaccggaaggagaggucggcgcuaucgcccuggacuuuaaaccugggacgagcggaucucccaucgugaacagagaaggcaagauugugggccucuaugggaauggagucgugaccacauccggcaccuacguuagcgccaucgcucaggccaaagcgucccaggaggggccucugcccgagauugaagaugagguguuccgcaagcggaaccuuaccaucauggaccugcaucccggaucuggcaaaacaagacgcuaucugccugcuauuguccgggaagccaucaagagaaagcuccgcacgcugauccuugccccgacccgggugguugcuagcgagauggccgaagcucugaaagggaugcccauuagauaccaaacaaccgccgugaaguccgagcacacaggcaaagagaucgucgaucucaugugccaugcgaccuuuacgaugcgccugcugagcccugugcggguucccaauuauaacaugauuaucauggacgaagcccacuucacagauccuucuuccauugcugccagaggauacaucagcacccgggugggcaugggggaggcugccgccaucuuuaugaccgcuacacccccuggaucugucgaagcguucccgcagagcaaugccgugauucaggacgaggaacgcgauauccccgagagauccuggaacucuggcuaugaguggauuaccgacuuuccugggaagacagugugguucguccccagcaucaaauccggaaaugauauugcuaacugucuccggaagaauggcaagcgcguuauccagcuuucuagaaaaaccuuugacacggaauaccaaaagaccaaaaacaacgauugggacuacguggugaccacagacauuagcgagaugggggccaauuuccgggccgauagagucaucgacccucgccggugccugaagcccgugauccugaaagauggcccggaaagaguuauucucgcuggaccuaugcccgugaccgucgccuccgcggcucagcgccggggcagaaucgggcgcaaccauaauaaggagggagaccaguauauuuacaugggccagccccugaacaaugaugaggaccacgcccacuggacggaagccaagaugcuucuggauaacaucaauaccccugaggggauuauccccgcucucuucgaaccugagcgggagaaaagcgccgcgaucgacggagaguauagacugcgcggcgaggccagaaagacauuuguggaacugaugcggcgcggggaucucccgguuuggcuuucuuacaaaguggcuuccgagggcuuccaauauagcgacagacgguggugcuuugauggagaacgcaacaaucagguccuggaggaaaacauggacguggagauuuggaccaaggagggcgaacgcaaaaagcugcggcccagauggcucgaugcccgcacauacuccgacccucuggcccuucgggaguucaaagaauuugccgcugggagacgcucugucagcggagaccugauccucgagauuggcaagcugccccagcaucugacccagcgggcccaaaaugcgcucgauaaccuugugaugcugcacaauuccgaacaagggggcagagcuuaucggcaugcuauggaggagcugccugacacaaucgaaacccucaugcugcuugcccugauugcuguucucacgggaggcgugacacuguucuuucugucugggaagggacucggcaaaaccagcaucgggcuucugugugugauggccuccagcgcccugcucuggauggcuucugucgagccccacuggaucgcggccuccauuauccuggaguucuuucuuaugguucugcucauuccggagccugaucgccagagaacaccccaggacaaccaacuggcuuacguggugaucggacuccuguucaugauucuuacagucgccgccaaugagaugggccugcuggaaaccacaaagaaagaucucgggaucggacacguggcuguugagaaccaucaccaugccgcgaugcuggacguggaucuucacccugccagcgcuuggacgcuguacgccgucgcuaccacaauuaucacccccaugaugcggcauacaaucgaaaacaccacggccaauauuucucucaccgcgaucgccaaccaggcugccauucugaugggccuggacaagggcuggccuaucuccaaaauggauauuggggugccccuccuugcucugggaugcuauagccaggucaauccgcugacacucaccgccgcugugcugaugcuuguugcccacuacgcgaucaucggcccugggcugcaagccaaggcuacacgcgaggcccagaagagaaccgcugccggaauuaugaaaaaccccacgguggacggcaucgucgccauugaucucgaccccgugguuuaugaugcgaaguuugaaaaacagcuggggcagaucaugcugcucauucuuuguacaucucaaauccugcugaugcggaccacaugggcucucugcgagagcaucacccuggccaccggaccucuuacaacgcugugggagggcuccccgggcaaguucuggaauaccacaauugcugugucuauggccaacaucuuucgcgggagcuaccucgccggagcuggccuggccuucucccugaugaaaagccucgggggaggcagacgggggaccggagcgcagggcgaaacacuuggcgagaaguggaagcgccagcugaaucagcuguccaaaucugaguucaacaccuauaagagaagcgggauuauggaggucgaccgguccgaagccaaagagggacucaagagaggcgagacgacaaaacacgcugugucucgcgggaccgccaagcugcggugguuuguggaaagaaaucuuguuaagcccgagggaaaagucaucgaccugggcugugggcgcggaggcuggagcuacuauugcgcuggccucaagaaagugaccgaagugaagggguacacaaaaggaggcccugggcaugaggaacccgucccuauggccaccuacggauggaaccugguuaagcugcacuccggcaaagauguguucuuuauucccccugagaagugugacacacuccuuugcgauaucggggagucuagcccgaaucccacgauugaagagggacggacccugagagugcugaagauggucgaaccuuggcuccgcggcaaccaauucuguaucaaaauccugaaucccuauaugccuuccgugguugagacacuugagcagaugcagcggaagcauggcgggaugcuggugagaaacccccucagccgcaauucuacccacgaaauguacugggucuccugcggaacaggcaacauugugagcgcgaucaauaugaccucucggaugcugcugaacagauuuacgauggcccaccgcaaaccgaccuaugagcgggacguugaucucggggcuggaacaagacauguggccgucgaaccugagguggcuaaccuggacauuaucggccagcgcauugaaaauaucaagugugagcacaaauccaccuggcauuacgaugaggacaaccccuauaagacaugggccuaccacgggagcuaugaagugaagcccucuggauccgcuagcuccauggucaauggcguugugaaacuucugaccaagccuugggaugugauccccauggucacacaaauugccaugaccgacacgacaccuuucggccagcagagaguguuuaaagagaagguugauacccggaccccgaaagcgaagcgcgggacagcccaaaucauggaagugacggcuagauggcucuggggauuccugagccggaacaagaaacccagaauuugcacccgggaggaauuuacacgcaaggucagaucuaaugccgcuaucggcgccguguucguugacgagaaccaguggaauagcgccaaagaggcgguggaagacgagcgguuuugggaucuuguccaucgcgaaagagagcugcacaagcaggggaaaugcgcuaccuguguguacaacaugaugggaaagcgggaaaagaaacucggcgaguucgggaaggccaaaggcucccgcgccauuugguacauguggcugggagcuagauuucuggaguucgaagcccucggcuucaugaaugaggaccacugguuuucucgggaaaacagccuguccgggguugagggagagggccuucauaagcugggguauauccuccgcgauaucucuaaaauuagcggaggcaauauguacgcugacgauacagccgggugggacaccagaaucacagaagaugaccugcagaacgaggcgaagauuaccgaaaucauggagccugaacacgcccaacuugcuaaagccauuuucaagcugacguaucagaauaaggugguccgggugcagcgccccgcuaaaaacggcaccgucauggaugugaucuccagacgggaccagcgcggaucuggccaaguugggacauacggacucaauaccuuuacaaacauggaggcccagcugaucagacagauggagagcgaaggcauuuucuccccuagcgagcuggaaacccccaaccucgcggagcgggugcuggauuggcuugaaaaguauggggucgagagacugaaacgcauggccaucucuggagacgauugcguggugaagccgauugacgaccgguuugcuacggcccucacagcucugaaugauaugggcaaaguuagaaaggacaucccucagugggagcccuccaagggguggaacgauuggcaacaggugccuuucuguagccaucacuuucaccagcuuauuaugaaagacggccgcgaaaucgucgugcccugccggaaucaggaugagcugguuggcagagcccgcgugucucaaggcgcuggguggucccuccgggaaaccgccugucugggaaagagcuacgcgcagauguggcagcugauguauuuccauagacgcgaccuccggcuggccgcuaacgccauuugcuccgccgucccuguggauuggguccccacaucuagaaccacguggagcauccacgcucaucaccaauggaugaccacagaggacaugcuuuccguguggaaucgcguuuggaucgaagagaacccguggaugaaagauaagacccauauuagcucuugggaggacgugccuuaccugggcaaacgggaagaucaguggugugggucccucaucggacugacagccagagcgaccugggcuacaaauauucaggucgccaucaaccaggugcggagacuuauuggcaaugagaacuaccuggacuauaugaccagcaugaagcgcuuuaagaaugaaucugaccccgagggggcccucugguga

SEQ ID NO: 19491 - RNA, 9879 nt, Artificial Sequence
  derived and/or modified CDS sequence (opt5) from DENV-1__KU666939__SS-prME
agcgugaccaugcugcucaugcugaugcccaccgcccuugcuuuccaccugacgacccggggaggggaaccucauaugaucgucuccaagcaggaacggggaaagucucuccuguuuaagaccagcgccggcguuaacaugugcacccuuauugccauggaccugggggaacucugugaagauacgaugaccuacaaaugcccgagaaucacagaggcugaacccgacgauguggacuguuggugcaaugccaccgauacgugggugaccuauggaacauguucccaaaccggcgagcaccggcgggacaagcgcucugucgcccuggcuccucauguggggcugggacucgagacacggaccgaaacguggaugagcuccgagggcgccuggaaacagauucagcggguugaaacaugggugcugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaggacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccacagagauccagcucaccgacuacggcgcccugacacuggauugucucccccggaccggccuggacuucaacgaaaugguccuucugacgaugaaggagaaaucuuggcucgugcauaagcagugguuucuggaucuuccucugcccuggacauccggggccagcaccucccaagagacauggaaucgccaggaccuccuggucaccuucaaaaccgcucacgcgaagaagcaggaagugguugugcugggaucucaagagggcgccaugcacacagcucucacgggggccaccgaaauucagacaagcggaaccacaaccaucuuugccggccaucugaaaugcagacuuaagauggauaaacugacgcucaaggggauguccuaugucauguguacaggcagcuucaaacuggagaaggaaguggcugagacccagcacggaaccguucuggugcagauuaaguacgagggcacagacgccccgugcaaaaucccuuucucuacccaagaugaaaagggggucacacagaacggacggcuuaucacggcgaaucccauugugaccgacaaagagaagccugugaacaucgaagcugagccgcccuuuggcgaguccuauauuguuaucggggccggagaaaaagcccucaagcugagcugguucaagaaaggcucuagcauugggaagauguuugaggcuacagccagaggcgcucgccggauggccauccugggagauaccgcgugggacuucggcuccaucgggggagucuuuacaucugugggcaaacucgugcaucagauuuucgggaccgccuacggaguccuguuuagcggcguguccuggacgaugaagaucgggauuggcguucuucugaccuggcucggacugaauagcagaucuacaucccugagcaugaccuguaucgcugugggccuugucacacucuaccugggggugaugguucaggccgauucuggaugcgugauuaacuggaaaggccgcgaacugaaguguggguccggaaucuucgucaccaaugaggugcacacauggaccgaacaauauaaguuucaggcugacagcccuaaacggcucuccgccgcgauuggcaaggccugggaggaggggguuugcggcaucagaucugcuacgcgccuggaaaacaucauguggaaacagauuagcaacgagcuuaaucauauccugcucgaaaacgacaugaaguucacaguggucgugggagauguggccggcauucuggcucaggggaaaaagaugauccggccgcaacccauggagcacaaauacuccuggaagucuuggggaaaggccaaaauuaucggcgccgacguccagaauaccaccuuuaucauugaugggccuaacacacccgaauguccugacgaucagagagcuuggaauaucugggagguugaggacuauggauucggcauuuuuaccacgaacaucuggcugaaacuucgcgauagcuacacacaggugugcgaccaccggcucauguccgcggccauuaaagauagcaaggcugugcaugccgacaugggcuauuggaucgaaucugagaaaaaugaaaccuggaagcuggccagagcuuccuucaucgaggucaagacauguauuuggcccaaaagccacacccuguggucuaacggggugcucgaauccgagaugaucauuccgaagaucuacggaggcccuauuagccaacauaauuaucgccccggguacuucacacagaccgccggaccuuggcaccugggcaaacuugagcuggauuuugaccucugcgaagggacgaccguuguggucgaugagcacugcggaaaccggggccccucucugagaacaaccacagugaccggcaagaucauccaugaaugguguugccggagcuguacgcugccuccccuucgcuucagaggggaggacggaugcugguacggcauggagauucggccgguuaaagaaaaggaggaaaaucucgugaaguccauggucagcgcggggucuggagagguggacuccuuuagccugggccugcucuguaucuccauuaugaucgaagagguuaugagaucucgcuggagccggaaaaugcugaugacagggacccuugcuguguucuuucugcucauuaugggacagcugacauggaacgaucugaucagacuuugcauuauggucggcgccaaugccuccgaccgcaugggcauggggaccaccuaucuggcucucauggccacauucaagaugagaccuauguuugcggugggacuccuguuccggcgccugacgucuagagaggugcuucugcucaccaucggccugagccuggucgcuuccguugaacuucccaacucucuggaggaacucggggauggacuggccaugggcaucaugauucucaaacugcuuacagacuuucaaagccaccagcugugggccacccuccugucccugacauucaucaagaccacguuuagccuucauuacgcuuggaaaacaauggccauggugcugucuauugugucccucaucccccugugucucagcaccaccucucagaagacaaccuggcugccuguccuucuggggucccugggaugcaagccgcucacaauguuccugauugcugagaauaaaaucuggggcagaaagagcuggccccuuaacgaaggcaucauggccguggggauuguuucuauccugcucuccagccugcucaaaaacgaugugccucuggcgggaccccuuauugccggcgggaugcugaucgcuuguuaugucauuuccggaagcucugccgaccugcuccuggagaaggcugccgaggugagcugggaagaggaagccgagcacuccggcgcuucucauaauauccuuguugaagugcaggaugacgggacgaugaaaaucaaggaugaggagcgcgacgauacccugacaauucuccugaaagcgacccuccuggccaucagcggagucuacccucuuuccauucccgcuacacuguuugugugguauuucuggcaaaagaagaaacagagaucuggcguccugugggacaccccuagcccucccgaaguggagcgggccguucucgaugacggcaucuaccgcauuaugcagagagggcugcuuggacggucccaggugggcgucgggguguuccaagaaaacguuuuucacacgauguggcacgugacccgcggagccguccugauguaucagggcaagagacucgagcccucuugggcuagcgugaaaaaggaccugaucuccuacgggggaggcuggcggcuccagggcagcuggaauacaggggaggaagugcagguuauugccgucgagcccggcaagaacccuaagaaugugcaaaccgcgcccggcacauucaagaccccggaaggggaggugggagcuaucgcccuggauuuuaaaccuggcacaucugggucccccaucgucaacagagaaggaaagauugugggccuuuacggcaaugggguugugacgaccagcggaacauaugucucugccaucgcucaggccaaagcgucccaggagggcccucugcccgagauugaagacgagguguuccgcaagcggaaccugaccaucauggaucuccaucccgggagcggaaaaaccagacgcuaccugccugcuauuguucgggaagccaucaagagaaaacuucgcacacugauccucgccccgacgcggguggucgcuuccgagauggccgaagcucugaaaggcaugcccauuagauaucaaaccacagccgugaagucugagcacaccgggaaagagaucguugaccugaugugccaugcgacauuuaccaugcgccuccuuagcccugugcggguccccaauuacaacaugauuaucauggaugaagcccacuucacggacccuuccagcauugcugccagaggcuauaucucuacacgggugggaaugggcgaggcugccgccaucuuuaugaccgcuacacccccuggguccguggaagcguucccgcagagcaaugccgucauucaggaugaggaacgcgacauccccgagagaucuuggaacagcggauacgaguggauuacagauuuuccuggcaagaccguuugguucgugcccuccaucaaaucugggaaugacauugcuaacugucugcggaagaauggaaagcgcgugauccagcugagcagaaaaacauuugauaccgaauaucaaaagacgaaaaacaacgacugggacuacgucgugacaaccgauauuuccgagaugggcgccaauuuccgggccgacagaguuaucgauccucgccggugccucaagcccgugauccugaaagacgggccggaaagagucauucuugcuggcccuaugcccgugacaguugccucugcggcucagcgccggggaagaaucggccgcaaccauaauaaggagggggaucaguacauuuauaugggacagccccugaacaaugacgaggaucacgcccacuggaccgaagccaagaugcuccuggacaacaucaauacgccugagggcauuauccccgcucuguucgaaccugagcgggaaaagagcgccgcgaucgauggggaguacagacuccgcggagaggccagaaagaccuuuguggagcuuaugcggcgcggcgaccugccggucuggcuguccuauaaaguggcuagcgagggguuccaauacucugauagacgguggugcuuugacggcgaacgcaacaaucagguccucgaggaaaacauggauguggagauuuggacaaaggagggagaacgcaagaagcugcggcccagauggcuugacgcccgcaccuauuccgacccucuggcucuccgggaguucaaagaauuugccgcuggcagacgcagcguuuccggggaucugauccuggagauuggaaagcucccccagcaucuuacacagcgggcccaaaaugcgcuggacaaccuggugaugcuccacaauucugaacagggcgggagagccuaccggcaugcuauggaggagcugccugauaccaucgaaacacuuaugcugcucgcccugauugcugugcugaccggaggcgucacacucuucuuucuuagcggccgcgggcugggaaagacauccaucggccugcucuguguuauggccucuagcgugcugcuuuggauggccuccguggagccccacuggaucgcugcgagcauuauccuggaguucuuucucaugguccugcugauuccggagccugacagacagcggacaccccaggauaaccaacucgccuaugugguuaucgggcuucuguucaugauucugaccguggcugccaaugagaugggacuccuggaaacaaccaaaaaggaccuuggcaucgggcacgucgccguggagaaccaucaccaugcuacaaugcuggaugucgaccuccacccugccucugcguggacgcuguacgccguggcuaccacaauuaucacccccaugaugcgccauacaaucgaaaacaccacggccaauauuucccugaccgcuaucgccaaccaggcggccauucucaugggacuugauaaaggcuggccuaucagcaagauggacauuggcguuccccugcuggcucucgggugcuacucucaggugaauccgcugacacuuaccgccgcuguccugaugcucguggcccacuaugcuaucaucggaccuggccugcaagccaaagcgacaagagaggcccagaagcggaccgcugccgggauuaugaagaaccccacgguugauggaaucguggcuauugaccuggaucccgucguguacgacgccaaauuugaaaagcagcucggccagaucaugcuucugauucuguguacaucccaaauccuccugaugcgcaccacaugggcccuuugcgagagcaucacccuggcgaccgggccucucacaacgcugugggagggaucuccgggcaaauucuggaauaccacaauugcugugagcauggccaacaucuuuagaggcuccuaucuggcuggggccggacucgccuucucucuuaugaaaagccugggcgggggacggcgcggcaccggggcucagggagaaacacugggcgagaaauggaagagacagcucaaucagcuguccaagagcgaguucaacaccuacaaacgguccggcauuauggagguugacagaucugaagccaaggaggggcuuaaacgcggagagacgacaaagcacgcggucagccggggcaccgccaaacugagaugguuuguggaacgcaaucucgugaagcccgaggggaaggucaucgaucugggauguggcagagggggaugguccuauuacugcgcuggccugaaaaagguuaccgaagugaaaggcuauacaaaagggggaccuggccaugaggaacccauuccuauggccaccuacggguggaaccucgugaaacuuuacucuggaaaggacgucuucuuuauucccccugagaaaugugauacacugcugugcgacaucggcgagagcuccccgaaucccacgaucgaagaggggagaacccuccgcgugcugaagaugguugaaccuuggcuucggggaaaccaauucuguaucaagauucugaaucccuauaugccuucuguggucgagacacucgagcagaugcagagaaaacacggcggcaugcuggugcgcaacccccugagcagaaauuccacccaugaaauguacuggguuagcugcgggacaggaaacaucgugucugcugucaauaugaccuccagaaugcuccugaaccgcuuuacgauggcccaccggaagccgaccuaugagagagauguggaccuuggcgcggggacacgccacguggccgucgaaccugagguugcuaaccuggauauuaucggacagagaauugaaaauaucaaacaugagcacaagagcaccuggcauuacgacgaggauaaccccuauaaaacaugggccuaccacggcucuuaugaagugaagcccuccgggagcgcuucuuccauggugaauggagucgugaagcuccugaccaaaccuugggacguuauccccauggugacacaaauugccaugaccgauacgacaccuuucggccagcagcgggucuuuaaggagaaaguggacacccgcaccccgaaggcuaaaagaggcacagcccaaaucauggaaguuacggcgcgguggcuuuggggguuccugagcagaaacaagaagccccggauuuguacccgcgaggaauuuacaagaaaagugcgguccaaugccgcuaucggagccgucuucauugacgagaaccaguggaauagcgcuaaggaggccguggaagaugagcgcuuuugggaccucguucauagagaacgggagcugcacaaacagggcaagugcgcgaccugcguguacaacaugauggggaaacgcgaaaagaagcugggagaguucggcaaagcgaaggggucuagagcuaucugguacauguggcucggcgcccgguuucuggaguucgaagcccuuggauucaugaaugaggaucacugguuuagccgcgaaaacucccugucuggcgucgagggggagggacuccauaaacugggcuauauccuuagagacauuagcaagaucccugggggaaauauguacgcugaugacacagccggcugggauacccggauuacagaagacgaucugcagaacgaggcuaaaaucaccgacauuauggaacccgagcacgcccuccuggcgaaggccaucuucaaacugacguaucaaaauaaggugguccgcgugcagagaccugcuaagaacgggaccguuauggaugugaucucccggcgcgaccagagaggcucuggacaggucggcacauacgggcucaauaccuuuacaaacauggaagcccaacugauucggcagauggagagcgagggaaucuucucccccucugaacuugagaccccgaaccuggcugaaagagugcucgauuggcugggcaaauaugggguggagcgccuuaagcggauggccauuagcggagacgacuguguugugaaaccuaucgaugacagauuugcgacggcccugacagcucucaaugauaugggcaagguccgcaaagacauuccccagugggaaccuuccaagggguggaacgauuggcagcaagugcccuucugcagccaucacuuucaccagcugaucaugaaggacggccgggagauuguugugccuuguagaaaucaggaugagcuggucggacgcgcccgggugucucagggcgcuggguggucccucagagaaaccgccugccugggaaaaagcuacgcucaaauguggcagcuuauguauuuccaucgccgggaccugagacucgccgcgaacgccaucuguucugcuguccccguggauuggguuccgacaucccgcaccacguggagcauccacgcccaucaccaguggaugaccacagaggacaugcuguccguguggaaucgggucuggauugaagagaacccuuggauggaagauaagacccauaucucuagcugggaggacgugcccuaccuuggcaaaagagaggaccaauggugcgggucccugauuggacucacagcccgggcuaccugggccacaaauauccagguugcgauuaaccaggugagacgccugaucggcaaugaaaacuaccuggauuauaugaccagcaugaagcgguuuaaaaaugagucugaccccgaaggggcucucugguga

SEQ ID NO: 19492 - RNA, 9879 nt, Artificial Sequence
  derived and/or modified CDS sequence (opt5) from DENV-1__KU666940__SS-prME
agcgugaccaugcugcucaugcugacccccacggcccuugcuuuccaccugaccacaagaggaggggaaccucauaugaucgucuccaagcaggaacgggggaaaucucuccuguuuaagaccagcgccggcguuaacaugugcacacuuaucgcgauggaccugggggaacucugugaagauaccaugacauacaaaugccccagaaucaccgaggcugaacccgacgauguggacuguuggugcaaugccacggauaccugggugacauauggaaccuguucccaaacaggcgagcacagacgggacaagcgcucuguugcccuggcuccucauguggggcugggacucgagaccagaacggaaacauggaugagcuccgagggcgccuggaaacagauucagcggguugaaaccugggcucugcgccaccccggcuucacagugaucgcccuuuuucuggcgcaugccauugggaccucuaucacccagaagggaaucauuuucauccuccugaugcuugucacaccuagcauggcuaugagaugcgugggcauugggucccgggauuuuguugagggacugagcggcgccacguggguggacgucgugcucgagcacgggucuugugugaccacaauggcuaaggauaaacccacccuggacaucgaacugcucaagacagaggucaccaacccugccguucugcgcaaacuuugcauugaagcgaagaucuccaauacgacaaccgauagcagauguccgacccaaggagaggccacacugguggaagaacaggacgcuaacuucgugugccggcgcaccuuugucgauagaggcuggggcaauggguguggacucuucggcaaagggucucugauuacaugcgccaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgcuacgauuacaccccaggccccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggcuuccacaucucaagagaccuggaaucgccaggaccugcucgugaccuucaaaacagcgcacgccaagaagcaggaagucgugguucugggaagccaagagggcgcuaugcacacggcccugaccggggccacagaaauucagaccuccggaacaaccacgaucuuugcuggccaucucaaaugcagacugaagauggauaaacuuacacugaaggggaugagcuaugugauguguaccggcucuuucaaacucgagaaggaagucgccgagacccagcacggaacagugcugguucagauuaaguacgagggcaccgacgcgccgugcaaaaucccuuucuccacacaagaugaaaagggggugacgcagaacggacggcugaucaccgcuaaucccauugucacagacaaagagaagccugugaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguuuuuaccagcgucggcaaacuggugcaucagauuuucgggacggcuuacggagugcucuuuuccggcgucagcuggaccaugaagaucgggauuggcgugcugcuuacauggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuucgugacaaaugagguccacaccuggacggaacaauauaaguuucaggccgacuccccuaaacggcugucugcggccauuggcaaggcuugggaggagggggugugcggcaucagaagcgccacacgccucgaaaacaucauguggaaacagauuuccaacgagcugaaucauauccuucuggaaaacgacaugaaguucaccguuguggucggagauguggcuggcauucucgcccaggggaaaaagaugauccggccgcaacccauggagcacaaauacucuuggaaaagcuggggaaaggccaaaauuaucggcgcugacgugcagaauaccacauuuaucauugaugggccuaacacccccgaauguccugacgaucagagagcguggaauaucugggaggucgaggacuauggauucggcauuuuuacgacaaacaucuggcugaagcugcgcgauuccuacacccagguuugcgaccaccggcuuaugagcgccgcuauuaaagauucuaaggccgugcaugccgacaugggcuauuggaucgaauccgagaaaaaugaaacauggaagcucgcuagagccagcuucaucgaggugaagaccuguauuuggcccaaaucucacacacugugguccaacgggguccuggaaagcgagaugaucauuccgaagaucuacggaggcccuauuucucaacauaauuaucgccccggguacuucacccagacggcgggaccuuggcaccucggcaaacuggagcuugauuuugaccugugcgaagggaccacagugguuguggaugagcacugcggaaaccggggccccagccucagaaccacaaccgucacgggcaagaucauccaugaaugguguugccgguccuguacacugccuccccugcgcuacagaggggaggacggaugcugguauggcauggagauucggccggugaaagaaaaggaggaaaaucuuguuaagagcauggugucugcuggguccggagaggucgacagcuucucccucggccugcuguguaucucuauuaugaucgaagaggugaugagaagccgcuggucccggaaaaugcucaugaccgggacacuggccgucuuuuuccuucugauuaugggacagcucaccuggaacgaucugaucagacugugcauuauggugggcgccaaugcuucugaccgcaugggcauggggaccacauaccuugcccugauggcgacguuuaagaugagaccuauguucgcugucggacuccuguuucggcgccucaccagcagagaggugcugcuucugacaaucggccucucccugguggccucugucgaacugcccaacagccuugaggaacugggggauggacucgccaugggcaucaugauucugaaacuccugaccgacuuccaaucccaccagcuuugggcuacacugcucagccugaccuuuaucaagacgacauucucucugcauuaugccuggaaaaccauugcuaugguucuuuccaucgugagccuguuuccccucugucugucuaccacaucccagaagaccacauggcucccugugcugcuugggagccugggaugcaagccgcugacgauguuccucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcacagcggcgcgucccauaauauccucguggaaguucaggaugacgggaccaugaaaaucaaggaugaggagcgcgacgauacacugaccauucuucugaaagccacacuccuggcugugucuggagucuauccucucagcauccccgccacccuguuugugugguacuucuggcaaaagaagaaacagagauccggcguccuuugggacacgccuucucccccggaaguggagcgggccguucuggaugacggcauuuaucgcaucaugcagagagggcugcucggacggagccaggugggcgucgggguguuccaagaaaacguuuuucacaccauguggcacgugacacgcggagcuguccugauguaccagggcaagagacuugagccuuccugggccagcgugaaaaaggaccugauuucuuacgggggaggcuggcggcuccagggcuccuggaauaccggggaggaagugcagguuaucgcggucgagcccggcaaaaacccuaagaaugugcaaacagcucccggcaccuucaagacaccggaaggggaggugggagccauugcccuggauuuuaaaccuggcacgagcgggucucccaucgucaacagagaaggaaagaucgugggccucuauggcaaugggguugugaccacauccggaaccuacgucagcgcuauugcccaggcgaaggcuucccaggagggcccucugcccgagaucgaagacgagguguuccgcaagcggaaccuuaccauuauggaucugcaucccgggucuggaaaaacaagacgcuaucugccugccaucguucgggaagccauuaagagaaagcuccgcacgcugauccuugcuccgacccggguggucgccagcgagauggcugaagcccugaaaggcaugcccaucagauaccaaacaaccgcggugaaguccgagcacacagggaaagagauuguugaccucaugugccaugccaccuuuacgaugcgccugcugagcccugugcggguccccaauuauaacaugaucauuauggaugaagcucacuucacagacccuucuuccaucgccgcuagaggcuacauuagcacccgggugggaaugggcgaggccgccgcuaucuuuaugaccgcgacacccccugggucuguggaagccuucccgcagagcaaugcugucauccaggaugaggaacgcgacauucccgagagauccuggaacucuggauaugaguggaucaccgauuuuccuggcaagacaguuugguucgugcccagcauuaaauccgggaaugacaucgccaacugucuccggaagaauggaaagcgcgugauucagcuuucuagaaaaaccuuugauacggaauaccaaaagaccaaaaacaacgacugggacuacgucgugaccacagauaucagcgagaugggcgccaauuuccgggcugacagaguuauugauccucgccggugccugaagcccgugauccugaaagacgggccggaaagagucauccucgccggcccuaugcccgugaccguugcguccgcugcccagcgccggggaagaauuggccgcaaccauaauaaggagggggaucaguauaucuacaugggacagccccugaacaaugacgaggaucacgcccacuggacggaagcuaagaugcuucuggacaacauuaauaccccugagggcaucauucccgcccucuucgaaccugagcgggagaaaagcgcggccaucgauggggaguauagacugcgcggagaggcuagaaagacauuuguggaacugaugcggcgcggcgaccucccggucuggcuuucuuacaaaguggccuccgagggguuccaauauagcgauagacgguggugcuuugacggcgaacgcaacaaucagguccuggaggaaaacauggauguggagaucuggaccaaggagggagaacgcaagaaacugcggcccagauggcucgacgcucgcacauacuccgacccucuggcccuucgggaguucaaagaauuugcugccggcagacgcucuguuagcggggaucugauucucgagaucggaaagcugccccagcaucugacccagcgggcgcaaaaugcccucgacaaccuugugaugcugcacaauuccgaacagggcgggagagcuuaucggcaugccauggaggagcugccugauacaauugaaacccucaugcugcuugcucugaucgccgugcucacgggaggcgucacacuguucuuucugucuggcaaggggcucggaaaaaccagcauuggccuucuguguguuauggccuccagcgugcugcucuggauggcuucuguggagccccacuggaucgcggccuccaucauucuggaguucuuucuuaugguccugcucaucccggagccugaccgccagagaacaccccaggauaaccaacuggcuuacgugguuauugggcuccuguucaugauccuuacaguggccgccaaugagaugggacugcuggaaaccacaaagaaagaccucggcauugggcacgucgcuguggagaaccaucaccaugccgcgaugcuggaugucgaccuucacccugccagcgcuuggacgcuguacgccguggcuaccacaaucauuacccccaugaugcggcauacaaucgaaaacaccacggccaauaucucucucaccgcgauugccaaccaggcugccauccugaugggacuggauaagggcuggccuauuuccaaaauggacaucggcguuccccuccuugcucuggggugcuauagccaggugaauccgcugacacucaccgccgcuguccugaugcuuguggcccacuacgcgauuaucggaccuggccugcaagccaaggcuacacgcgaggcccagaagagaaccgcugccgggaucaugaaaaaccccacgguugauggaauuguggccaucgaccucgaucccgucguguaugacgcgaaguuugaaaaacagcugggccagauuaugcugcucauccuuuguacaucucaaauucugcugaugcggaccacaugggcucucugcgagagcaucacccuggccaccgggccucuuacaacgcugugggagggauccccgggcaaguucuggaauaccacaaucgcugugucuauggccaacauuuuucgcggcagcuaccucgccggggcuggacuggccuucucccugaugaaaagccucggcgggggaagacggggcaccggggcgcagggagaaacacuuggcgagaaguggaagcgccagcugaaucagcuguccaaaucugaguucaacaccuauaagagaagcggcaucauggagguugaccgguccgaagccaaagaggggcucaagagaggagagacgacaaaacacgcugucucucgcggcaccgccaagcugcggugguuuguggaaagaaaucuugugaagcccgaggggaaagucauugaucugggauguggccgcgggggauggagcuacuauugcgcuggccucaagaaaguuaccgaagugaagggcuacacaaaagggggaccuggccaugaggaacccgugccuauggccaccuacggguggaaccuggucaagcugcacuccggaaaagacguguucuuuauucccccugagaagugugauacacuccuuugcgacauuggcgagucuagcccgaaucccacgaucgaagaggggcggacccugagaguucugaagaugguggaaccuuggcuccgcggaaaccaauucuguauuaaaauccugaaucccuauaugccuuccgucguggagacacuugagcagaugcagcggaagcauggcggcaugcugguuagaaacccccucagccgcaauucuacccacgaaauguacuggguguccugcgggacaggaaacaucgucagcgcgauuaauaugaccucucggaugcugcugaacagauuuacgauggcccaccgcaaaccgaccuaugagcgggauguggaccucggcgcugggacaagacauguggccgucgaaccugagguugcuaaccuggauaucauuggacagcgcaucgaaaauauuaagugugagcacaaauccaccuggcauuacgacgaggauaaccccuauaagacaugggccuaccacggcagcuaugaagugaagcccucuggguccgcuagcuccauggugaauggagucgugaaacuucugaccaagccuugggacguuauccccauggugacacaaaucgccaugaccgauacgacaccuuucggccagcagagagucuuuaaagagaagguggacacccggaccccgaaagcgaagcgcggcacagcccaaauuauggaaguuacggcuagauggcucuggggguuccugagccggaacaagaaacccagaaucugcacccgggaggaauuuacacgcaaggugagaucuaaugccgcuauuggagccgucuucguggacgagaaccaguggaauagcgccaaagaggcgguugaagaugagcgguuuugggaccuugugcaucgcgaaagagagcugcacaagcagggcaaaugcgcuaccugugucuacaacaugauggggaagcgggaaaagaaacucggagaguucggcaaggccaaagggucccgcgccaucugguacauguggcugggcgcuagauuucuggaguucgaagcccucggauucaugaaugaggaucacugguuuucucgggaaaacagccuguccggcguggagggggagggacuucauaagcugggcuauauucuccgcgacaucucuaaaaucagcgggggaaauauguacgcugaugacacagccggcugggauaccagaauuacagaagacgaucugcagaacgaggcgaagaucaccgaaauuauggagccugaacacgcccaacuugcuaaagccaucuucaagcugacguaucagaauaaggucgugcggguucagcgccccgcuaaaaacgggaccgugauggacgucauuuccagacgggaucagcgcggcucuggacaagugggcacauacgggcucaauaccuuuacaaacauggaggcccagcugaucagacagauggagagcgaaggaaucuucuccccuagcgagcuggaaacccccaaccucgcggagcgggugcuggacuggcuugaaaaguauggcguugagagacugaaacgcauggccauuucuggggaugacugcguggucaagccgaucgacgaucgguuugcuacggcccucacagcucugaaugacaugggaaaagugagaaaggauauuccucagugggagcccuccaagggcuggaacgacuggcaacagguuccuuucuguagccaucacuuucaccagcuuaucaugaaagaugggcgcgaaauugugguccccugccggaaucaggacgagcuggugggcagagcccgcgucucucaaggagcuggcuggucccuccgggaaaccgccugucugggaaagagcuacgcgcagauguggcagcugauguauuuccauagacgcgaucuccggcuggccgcuaacgccaucugcuccgccgugccuguugacugggugcccacaucuagaaccacguggagcauucacgcucaucaccaauggaugaccacagaggauaugcuuuccgucuggaaucgcguguggaucgaagagaacccguggaugaaagacaagacccauaucagcucuugggaggauguuccuuaccugggaaaacgggaagaccagugguguggcucccucauugggcugacagccagagcgaccugggcuacaaauauccagguggccauuaaccagguccggagacuuaucggaaaugagaacuaccuggacuauaugaccagcaugaagcgcuuuaagaaugaaucugaucccgagggcgcccucugguga

SEQ ID NO: 19493 - RNA, 9879 nt, Artificial Sequence
  derived and/or modified CDS sequence (opt5) from DENV-1__KU666941__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauuggagcgaagaucuccaauaccacgacagauagcagauguccgacccaaggcgaagccacccugguggaggaacaggacgcuaacuucgugugccggcgcacauuugucgauagaggcugggggaauggauguggccucuucgggaaaggaucucugauuaccugcgccaaguuuaagugcgugacaaaacuugagggcaagaucguucaguacgagaaccugaaauauuccgugaucgucacggugcacaccggggaccagcaucaaguuggaaaugaaagcacagagcacggcaccacagcuaccauuacgccccaggccccuaccacagaaauccagcucaccgacuacggcgcccugacacuggauuguucuccccggaccgggcucgacuucaacgagauggugcugcuuacgaugaaggaaaaauccuggcugguccauaagcagugguuucucgaucugccucuucccuggacaagcggagcuuccaccucucaagagacauggaaucgccaggaccugcucgugaccuucaaaaccgcgcacgccaagaagcaggaggucgugguucugggcagccaagaaggggcuaugcacacagcccugacgggagccaccgagauucagacauccggcaccacaaccaucuuugcugggcaucucaaaugcagacugaagauggauaaacuuacgcugaagggcaugagcuaugugauguguacaggaucuuucaaacucgaaaaggaggucgccgaaacccagcacggcaccgugcugguucagauuaaguacgaggggacagacgcgccgugcaaaaucccuuucuccacccaagaugagaagggagugacacagaacggccggcugaucacggcuaaucccauugucaccgacaaagaaaagccugugaacaucgaggccgaaccccccuuuggggagagcuauauugugaucggagccggcgagaaagcucuuaagcucucuugguucaagaaagggagcuccauuggcaagauguuugaagccacagcuagaggagcccgccggauggcgauccugggcgauaccgccugggacuucgggucuaucggaggcguuuuuacaagcgucgggaaacuggugcaucagauuuucggaaccgcuuacggcgugcucuuuuccggggucagcuggacgaugaagaucggcauuggagugcugcuuaccuggcugggccucaauucuagauccacaagccugucuaugaccuguaucgccguugggcuggugacacuuuaccucggagucauggugcaggcugauuccggcugcguuauuaacuggaaagggcgcgagcugaaguguggaagcggcaucuucgugaccaaugaaguccacacauggaccgagcaauauaaguuucaggccgacuccccuaaacggcugucugcggccauugggaaggcuugggaagagggcgugugcggaaucagaagcgccacgcgccucgagaacaucauguggaaacagauuuccaacgaacugaaucauauccuucuggagaacgacaugaaguucacaguuguggucggcgauguggcugggauucucgcccagggaaaaaagaugauccggccgcaacccauggaacacaaauacucuuggaagagcuggggcaaggccaaaauuaucggggcugacgugcagaauaccaccuuuaucauugauggaccuaacacacccgaguguccugacgaucagagagcguggaauaucugggaagucgaggacuauggcuucggcauuuuuaccacgaacaucuggcugaagcugcgcgauuccuacacacagguuugcgaccaccggcuuaugagcgccgcuauuaaagauucuaaggccgugcaugccgacaugggguauuggaucgaguccgaaaaaaaugagaccuggaagcucgcuagagccagcuucaucgaagugaagacauguauuuggcccaaaucucacacccugugguccaacggaguccuggagagcgaaaugaucauuccgaagaucuacggcgggccuauuucucaacauaauuaucgccccggauacuucacacagaccgcgggcccuuggcaccucgggaaacuggagcuugauuuugaccugugcgagggaacgaccgugguuguggaugaacacugcggcaaccggggccccagccucagaacaaccacagucaccgggaagaucauccaugagugguguugccgguccuguacgcugccuccccugcgcuacagaggagaagacggcugcugguaugggauggagauucggccggugaaagagaaggaagagaaucuuguuaagagcauggugucugcuggauccggcgaagucgacagcuucucccucgggcugcuguguaucucuauuaugaucgaggaagugaugagaagccgcuggucccggaaaaugcucaugacaggaacccuggccguuuuuuuccuucugauuaugggccagcucacauggaacgaucugaucagacugugcauuauggugggcgccaaugcuucugaccgcauggggaugggaaccaccuaccuugcccugauggcgacauuuaagaugagaccuauguucgcugucggccuccuguuucggcgccucacgagcagagaggugcugcuucugaccaucgggcucucccugguggccucugucgagcugcccaacagccuugaagagcugggagauggccucgccauggggaucaugauucugaaacuccugacagacuuccaaucccaccagcuuugggcuacccugcucagccugacauuuaucaagaccacguucucucugcauuaugccuggaaaacaauugcuaugguucuuuccaucgugagccuguuuccccucugucugucuaccaccucccagaagacaaccuggcucccugugcugcuuggaagccugggcugcaagccgcugacaauguuccucauugccgaaaauaaaaucuggggccggaagucuuggccccugaacgaggggaucauggcggucggaauuguguccauccuucugagcucccuccugaaaaacgauguuccucucgccggcccccugauugcugggggaaugcuuaucgccuguuacgugauuagcggcucuagcgcugaccugucccuggaaaaggccgccgaggucucuugggaggaagaggcugaacacagcggggcgucccauaauauccucguggagguucaggaugacggaacgaugaaaaucaaggaugaagagcgcgacgauacccugacaauucuucugaaagccacccuccuggcugugucuggcgucuauccucucagcauccccgccacacuguuugugugguacuucuggcaaaagaagaaacagagauccggcguccuuugggacaccccuucucccccggagguggaacgggccguucuggaugacgggauuuaucgcaucaugcagagaggacugcucggccggagccaggugggggucggaguguuccaagagaacguuuuucacacgauguggcacgugacccgcggcgcuguccugauguaccaggggaagagacuugaaccuuccugggccagcgugaaaaaggaccugauuucuuacggaggcggcuggcggcuccagggguccuggaauacaggagaggaggugcagguuaucgcggucgaacccggcaaaaacccuaagaaugugcaaaccgcucccgggacauucaagaccccggagggagaagugggcgccauugcccuggauuuuaaaccugggacaagcggaucucccaucgucaacagagagggcaagaucgugggccucuaugggaauggaguugugacgaccuccggcacauacgucagcgcuauugcccaggcgaaagcuucccaggaagggccucugcccgagaucgaggacgaaguguuccgcaagcggaaccuuaccauuauggaucugcaucccggaucuggcaaaaccagacgcuaucugccugccaucguucgggaggccauuaagagaaagcuccgcacacugauccuugcuccgacgcggguggucgccagcgaaauggcugaggcccugaaagggaugcccaucagauaccaaaccacagcggugaaguccgaacacaccggcaaagagauuguugaccucaugugccaugccacauuuaccaugcgccugcugagcccugugcggguccccaauuauaacaugaucauuauggaugaggcucacuucacggacccuucuuccaucgccgcuagaggauacauuagcacacgggugggcaugggggaagccgccgcuaucuuuaugaccgcgacccccccuggaucuguggaggccuucccgcagagcaaugcugucauccaggaugaagagcgcgacauucccgaaagauccuggaacucuggcuaugaguggaucacagauuuuccugggaagaccguuugguucgugcccagcauuaaauccggaaaugacaucgccaacugucuccggaagaauggcaagcgcgugauucagcuuucuagaaaaacauuugauaccgaguaccaaaagacgaaaaacaacgacugggacuacgucgugacaaccgauaucagcgaaaugggggccaauuuccgggcugacagaguuauugauccucgccggugccugaagcccgugauccugaaagacggcccggagagagucauccucgccggaccuaugcccgugacaguugcguccgcugcccagcgccggggcagaauugggcgcaaccauaauaaggaaggagaucaguauaucuacaugggccagccccugaacaaugacgaggaucacgcccacuggaccgaggcuaagaugcuucuggacaacauuaauacgccugaagggaucauucccgcccucuucgagccugaacgggagaaaagcgcggccaucgauggagaauauagacugcgcggcgaggcuagaaagaccuuuguggagcugaugcggcgcggggaccucccggucuggcuuucuuacaaaguggccuccgaaggcuuccaauauagcgauagacgguggugcuuugacggagagcgcaacaaucagguccuggaagagaacauggauguggaaaucuggacaaaggagggcgagagaaaaaagcugcggcccagauggcucgacgcucgcaccuacuccgacccucuggcccuucgggaauucaaagaguuugcugccgggagacgcucuguuagcggagaucugauucucgaaaucggcaagcugccccagcaucugacacagcgggcgcaaaaugcccucgacaaccuugugaugcugcacaauuccgagcaggggggaagagcuuaucggcaugccauggaagagcugccugauaccauugagacacucaugcugcuugcucugaucgccgugcucaccggcggcgucacgcuguucuuucugucugggaagggacucggcaaaacaagcauugggcuucuguguguuauggccuccagcgugcugcucuggauggcuucuguggaaccccacuggaucgcggccuccaucauucuggaguucuuucuuaugguccugcucaucccggaaccugaccgccagagaaccccccaggauaaccaacuggcuuacgugguuauuggacugcucuucaugauccuuaccguggccgccaaugagaugggccugcuggagacaaccaagaaagaccucgggauuggacacgucgcuguggaaaaccaucaccaugccgcgaugcuggaugucgaccuucacccugccagcgcuuggacacuguacgccguggcuacgaccaucauuacacccaugaugcggcauaccaucgagaacacaaccgccaauaucucucucacggcgauugccaaccaggcugccauccugaugggccuggauaagggcuggccuauuuccaaaauggacaucgggguuccccuccuugcucugggaugcuauagccaggugaauccgcugacccucacagccgcuguccugaugcuuguggcccacuacgcgauuaucggcccugggcugcaagccaaggcuacccgcgaagcccagaagagaacagcugccggaaucaugaaaaaccccaccguugauggcauuguggccaucgaccucgaucccgucguguaugacgcgaaguuugagaaacagcuggggcagauuaugcugcucauccuuuguacgucucaaauucugcugaugcggacaaccugggcucucugcgaaagcaucacacuggccaccggaccucuuaccacacugugggagggcuccccgggcaaguucuggaauacgaccaucgcugugucuauggccaacauuuuucgcgggagcuaccucgccggagcuggccuggccuucucccugaugaaaagccucgggggaggcagacgggggacaggagcgcagggcgagacccuuggcgaaaaguggaagcgccagcugaaucagcuguccaaaucugaguucaacacauauaagagaagcgggaucauggaaguugaccgguccgaggccaaagaaggacucaagagaggcgagaccacgaaacacgcugucucucgcgggacagccaagcugcggugguuuguggagagaaaucuugugaagcccgaaggaaaagucauugaucugggcugugggcgcggaggcuggagcuacuauugcgcuggccucaagaaaguuaccgaggugaagggguacaccaaaggaggcccugggcaugaagagcccgugccuauggccacauacggauggaaccuggucaagcugcacuccggcaaagacguguucuuuauccccccugaaaagugugauacccuccuuugcgacauuggggagucuagcccgaaucccacaaucgaggaaggacggacgcugagaguucugaagaugguggagccuuggcuccgcggcaaccaauucuguauuaaaauccugaaucccuauaugccuuccgucguggaaacccuugagcagaugcagcggaagcauggcgggaugcugguuagaaacccccucagccgcaauucuacacacgagauguacuggguguccugcggaaccggcaacaucgucagcgcgauuaauaugacaucucggaugcugcugaacagauuuaccauggcccaccgcaaaccgacguaugaacgggauguggaccucggggcuggaaccagacauguggccgucgagccugaaguugcuaaccuggauaucauuggccagcgcaucgagaauauuaagugugaacacaaauccacauggcauuacgacgaggauaaccccuauaagaccugggccuaccacgggagcuaugaggugaagcccucuggauccgcuagcuccauggugaauggcgucgugaaacuucugacaaagccuugggacguuauccccauggugacccaaaucgccaugacagauaccacgccuuucggccagcagagagucuuuaaagaaaagguggacacacggaccccgaaagcgaagcgcgggaccgcccaaauuauggagguuacagcuagauggcucuggggauuccugagccggaacaagaaacccagaaucugcacgcgggaagaguuuacccgcaaggugagaucuaaugccgcuauuggcgccgucuucguggacgaaaaccaguggaauagcgccaaagaggcgguugaggaugaacgguuuugggaccuugugcaucgcgagagagaacugcacaagcaggggaaaugcgcuacaugugucuacaacaugaugggaaagcgggagaagaaacucggcgaauucgggaaggccaaaggcucccgcgccaucugguacauguggcugggagcuagauuucuggaguucgaggcccucggcuucaugaaugaagaucacugguuuucucgggagaacagccuguccgggguggaaggagagggccuucauaagcugggguauauucuccgcgacaucucuaaaaucagcggaggcaauauguacgcugaugacaccgccgggugggauacaagaauuaccgaggacgaucugcagaacgaagcgaagaucacagagauuauggaaccugagcacgcccaacuugcuaaagccaucuucaagcugaccuaucagaauaaggucgugcggguucagcgccccgcuaaaaacggcacggugauggacgucauuuccagacgggaucagcgcggaucuggccaaguggggaccuacggacucaauacauuuaccaacauggaagcccagcugaucagacagauggagagcgagggcaucuucuccccuagcgaacuggagacacccaaccucgcggaacgggugcuggacuggcuugagaaguaugggguugaaagacugaaacgcauggccauuucuggagaugacugcguggucaagccgaucgacgaucgguuugcuaccgcccucacggcucugaaugacaugggcaaagugagaaaggauauuccucagugggagcccuccaagggguggaacgacuggcaacagguuccuuucuguagccaucacuuucaccagcuuaucaugaaagauggccgcgagauugugguccccugccggaaucaggacgaacuggugggaagagcccgcgucucucaaggcgcuggguggucccuccgggagacagccugucugggaaagagcuacgcgcagauguggcagcugauguauuuccauagacgcgaucuccggcuggccgcuaacgccaucugcuccgccgugccuguugacugggugcccaccucuagaacaaccuggagcauucacgcucaucaccaauggaugacgaccgaagauaugcuuuccgucuggaaucgcguguggaucgaggaaaacccguggaugaaagacaagacacauaucagcucuugggaggauguuccuuaccugggcaaacgggaggaccaguggugugggucccucauuggacugaccgccagagcgacaugggcuaccaauauccagguggccauuaaccagguccggagacuuaucggcaaugaaaacuaccuggacuauaugacaagcaugaagcgcuuuaagaaugagucugaucccgaaggggcccucugguga

SEQ ID NO: 19494 - RNA, 9879 nt, Artificial Sequence
  derived and/or modified CDS sequence (opt5) from DENV-1__KC172835__SS-prME
agcgugaccaugcugcucaugcugaugcccacagcccuugcuuuccaccugacgacccggggaggggaaccucauaugaucgucuccaagcaggaacggggaaaaucucuccuguuuaagacaagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcaccggcgggacaagcgcucugucgcccuggcuccucauguggggcugggacucgagacacggaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguugugaacuggaaaggccgcgaacugaagugugggagcggaauuuucgucaccaaugaggugcacacauggaccgaacaauauaaguuucaggccgacuccccuaaacggcugucugcggccaucggcaaggcuugggaggaggggguuugcggcauuagaagcgccacgcgccucgaaaacgugauguggaaacagaucuccaacgagcugaaucauauccuucuggaaaacgacaugaaguucacagucguggugggagaugucgcuggcauucucgcccaggggaaaaagaugauccggccgcaacccauggaguacaaauauucuuggaaaagcuggggaaaggccaagauuaucggcgcugacguucagaauaccaccuuuauuaucgaugggccuaacacacccgaauguccugacgaucagagagcguggaauaucugggagguggaggacuacggauucggcauuuuuaccacgaacaucuggcugcgccugcgggauuccuauacacaggugugcgaccacagacuuaugagcgccgcuauuaaggauucuaaagccguccacgccgacaugggcuacuggaucgaauccgagaagaaugaaaccuggaaacucgcucgcgccagcuucauugaggugaagacauguaucuggcccaagucucauacccugugguccaacgggguucuggaaagcgagaugaucauuccgaaaaucuauggaggcccuauuucucaacacaauuaccggcccggguacuucacacagaccgcgggaccuuggcaucucggcaagcuggagcuugauuuugaccugugcgaagggacgaccguggucguggaugagcacugcggaaacagaggccccagccuccggacaaccacaguuaccggcaaaacgauccacgaaugguguugccgcuccuguacacugccuccccugagauucagaggggaagacggaugcugguauggcauggagauuagaccggugaaggaaaaagaggaaaaucuugucaagagcauggugucugcuggguccggagagguugacagcuuuucccucggccugcuguguaucucuaucaugauugaagaggugaugcgcagccggugguccagaaagaugcucaugaccgggacacuggccgucuucuuucuucugaucauuggacagcucaccuggaacgaucugauccgccugucuauuauggugggcgccaaugcuagcgacaaaaugggcauggggaccacauaccuugcccugauggcgacguucaagaugagaccuauguuugcugugggacuccuguuccggcgccucaccuccagagagguccugcuucugacaaucggccucucucugguugccagcguggaacugcccaacucccuugaggaacugggggauggacucgccaugggcauuaugauccugaaacuccugaccgacuuucaaccccaucagcuuugggcuacacugcucagccugaccuucaucaagacgacauuuucucugcacuaugccuggaaaaccauggcuauggugcuuuccauugucagccuguucccucucugccugucuaccacaucccagaagaccacauggcucccggugcugcuugggagccugggauguaagccccugacgauguuucucaucaccgagaauaaaauuuggggccggaagucuuggccucugaacgaaggcaucauggccguugggauuguguccauccuucugagcucccuccugaaaaacgaugucccccucgcgggaccucugaucgccggcgggaugcuuauugcuugcuacgugaucagcggaucuagcgccgaccugucccuggagaaggcugccgagguuucuugggaagaggaagccgagcauagcggcgcuucccacaauauucucguggaaguccaggaugacgggacaaugaaaaucaaggaugaggagcgcgacgauacccugacaauucuucugaaagcgacccuccuggccgugucuggagucuauccccucagcaucccugcuacgcuguucgugugguacuucuggcaaaagaagaaacagagauccggcguucuuugggacacccccucuccgccugaaguggagcgggccgcccuggaugacggcaucuaucgcauuaugcagagagggcugcucggacggagccaggucggcguggggguuuuucaagaaaacguguuccauacaauguggcacgucacccgcggagcugugcugauguaccagggcaagagacuugagcccuccugggccagcgugaaaaaggaccugaucucuuacgggggaggcuggcggcuccagggcuccuggaauacaggggaggaaguucaggucauugcgguggagccuggcaagaaccccaagaaugugcaaaccgcuccgggcacauuuaagacgccugaaggggaggucggagccaucgcccuggauuucaaacccggcaccagcgggucuccuauugugaacagagaaggaaagaucguuggccucuauggcaaugggguggucacaaccuccggaaccuacgugagcgcuauugcccaggcgaaggcuucccaggagggcccccugcccgagaucgaagacgagguuuuucgcaagcggaaccuuacaaucauggaucugcacccugggucuggaaaaacgagacgcuaucugccggccauugugcgggaagccaucaagagaaagcuccgcacccugauucuugcucccacacgggucguggccagcgagauggcugaagcccugaaaggcaugccuaucagauaccaaaccacagcgguuaaguccgagcauaccgggaaagagauuguggaccucaugugucacgccacguucacaaugcgccugcugagccccguccgggugccuaauuauaacaugaucaucauggaugaagcucauuuuaccgaccccucuuccauugccgcuagaggcuacaucagcacccgggugggaaugggcgaggccgccgcuauuuucaugacagcgaccccuccggggucugucgaagccuuuccccagagcaaugcuguuauccaggaugaggaacgcgacauuccugagagauccuggaacucuggauaugaguggaucacagauuuccccggcaagaccgugugguuugugccuagcaucaaauccgggaaugacauugccaacugccuccggaagaauggaaagcgcgucauccagcuuucuagaaaaacguucgauacagaauaccaaaagaccaaaaacaacgacugggacuacgugguuacaaccgauauuagcgagaugggcgccaauuuccgggcugacagagugaucgauccccgccggugucugaagccggucauucugaaagacgggccugaaagagugauccucgccggccccaugcccguuacgguggcguccgcugcccagcgccggggaagaauuggccgcaaccacaauaaggagggggaucaguauaucuacaugggacagccucugaacaaugacgaggaucaugcccacuggaccgaagcuaagaugcuucuggacaacaucaauacacccgagggcauuaucccugcccucuuugaaccggagcgggaaaagagcgcggccauugauggggaguauagacugcgcggagaggcuagaaagaccuucgucgagcugaugcggcgcggcgaccuccccguguggcuuucuuacaaagucgccuccgagggguuucaauauagcgauagacgguggugcuucgacggcgaacgcaacaaucaggugcuggaggaaaacauggauguugagaucuggacaaaggagggagaacgcaagaaacugcggccuagauggcucgacgcucgcaccuacuccgacccccuggcccuucgggaguuuaaagaguucgcugccggcagacgcucugugagcggggaucugauucucgagaucggaaagcugccucagcaccugacacagcgggcgcaaaaugcccucgacaaccuugugaugcugcauaauuccgaacagggcgggagagcuuaucggcacgccauggaggagcugcccgauaccaucgaaacgcucaugcugcuugcucugauugccguccucacaggaggcguuacccuguuuuuccugucuggccgcgggcucggaaagaccagcaucggccuucugugcgugauggccuccagcgugcugcucuggauggcuucugucgagccgcauuggauugcggccuccaucauucuggaauuuuuccuuauggugcugcucaucccugagcccgacagacagcggacaccucaggauaaccaacuggcuuacguugugaucgggcugcucuuuaugauucuuaccgucgccgccaaugagaugggacugcuggaaacaacgaaaaaggaccucggcaucgggcacguggcugaugagaaccaccaucacgccgcgaugcuggacgucgaucuucaucccgccagcgcuuggacccuguacgccguggcuacaaccauuaucacaccuaugaugcgccacaccauugaaaacacgaccgccaauaucucucucacagcgauugccaaccaggcugccauccugaugggacuggacaaaggcuggcccaucuccaagauggauauuggcguuccgcuccuugcucugggguguuauagccaggugaauccucugacccucacagccgcuguccugaugcuuguggcccauuacgcgaucauuggacccggccugcaagccaaagcuaccagagaggcccagaagcggacggcugccgggaucaugaagaaccccacaguugacggaauuguggccaucgaucucgacccugucguguaugacgcgaaauucgaaaagcagcugggccagaucaugcugcucauucuuugcaccucucaaauccugcugaugcgcacaaccugggcucucugugagagcauuacccuggccacagggccgcuuacgacccugugggagggaucccccggcaaauuuuggaauacaaccaucgcugugucuauggccaacauuuucagaggcagcuaccucgccggggcuggacuggccuucucccugaugaaaagccucggcgggggacggcgcggcacaggggcgcagggagaaacccuuggcgagaaauggaagagacagcugaaucagcuguccaagucugaauuuaacacguauaaacggagcggcaucauggagguugauagauccgaagccaaggaggggcucaaacgcggagagacaaccaagcacgcugucucucggggcaccgccaaacugagaugguucguggaacgcaaucuugugaagccugaggggaaggucaucgaccugggaugcggcagagggggauggagcuacuauugugcuggccucaaaaagguuacagaagugaaaggcuacaccaaagggggacccggccacgaggaaccuauucccauggccacauacggguggaaccuggugaaacugcauuccggaaaggaugucuuuuucaucccuccggagaaaugcgacacgcuccuuugugauauuggcgagucuagccccaauccuaccaucgaagaggggagaacacugcgcgugcugaagaugguugaacccuggcuccggggaaaccaauuuugcauuaagauccugaauccuuauaugcccuccguggucgagacccuugagcagaugcagagaaaacacggcggcaugcuggugcgcaacccgcucagcagaaauucuacacaugaaauguacuggguuuccugugggaccggaaacauugugagcgcggucaauaugacgucuagaaugcugcugaaccgcuucaccauggugcaccggaagccuacauaugagagagacguggaucucggcgccgggacccgccacgucgcuguugaacccgagguggccaaccuggacaucaucggacagagaauugaaaauaucaaacaugagcacaaguccacauggcauuacgaugaggacaaccccuauaaaaccugggcuuaccacggcagcuaugaagugaagccuucuggguccgccagcuccauggucaauggagugguuaaacuucugacaaaacccugggaugugauuccuauggucacccaaaucgcuaugacggacacaaccccguuuggccagcagcggguguucaaggagaaaguugacacccgcacacccaaggccaaaagaggcacggcgcaaauuauggaagugaccgcccgguggcucuggggguuucugagcagaaacaagaagccucggaucugcacacgcgaggaguucaccagaaaaguccggucuaaugcugccaucggagcuguguuuauugaugagaaccaguggaauagcgccaaggaggccguugaagacgagcgcuucugggaucuugugcauagagaacgggagcugcacaaacagggcaagugugcgacaugcgucuacaacaugauggggaaacgcgaaaagaagcucggagaguuuggcaaagcuaagggguccagagccaucugguacauguggcugggcgcccgguuccuggaguucgaagcucucggauuuaugaaugaggaccacugguucucucgcgaaaacagccuguccggcguggagggggagggacuucauaaacugggcuauauucucagagauaucucuaagauucccgggggaaauauguacgccgacgauaccgcuggcugggacacacggaucaccgaagaugaccugcagaacgaggccaaaaucacggauauuauggaaagcgagcacgcgcuucuggccaaguccaucuuuaaacucaccuaucaaaauaaggucgugcgcguucagagaccugcuaagaacgggacagugauggacgucauuucucggcgcgaucagagaggcagcggacaggugggcaccuacgggcugaauacauucaccaacauggaagcccaacugauccggcagauggaguccgagggaauuuuuagccccucugaacucgagacgccgaaccuggcugaaagagcccuugacuggcuggagaaacauggcguggaacgccucaagcggauggcgaucuccggggacgauugcguugugaaaccuaucgacgauagauucgccacagcucugaccgcccuuaaugacaugggaaagguccgcaaagauauuccccagugggagccuagcaagggcuggaacgacuggcagcaagugcccuuuuguucucaccacuuccaucagcugaucaugaaggaugggcgggagauuguugugccuugcagaaaucaggacgaacucgucggccgcgcucgggugucccagggagccggcuggagccugagagagacagcuugucuggggaaauccuaugcccaaauguggcagcucauguacuuucaccgccgggaucugagacuugcggccaacgcuaucugcucugccguccccguggacuggguuccgaccagccgcacgaccugguccauucaugcccaccaucaguggaugacaaccgaagauaugcugagcguguggaaucgggucuggaucgaggaaaacccuuggauggaggacaagacacacauuucuuccugggaggacgugcccuaucucggaaaaagagaagaucaaugguguggcagccugaucgggcuuaccgcucgggccacaugggcgaccaauauccagguugcuauuucucaggugagacgccugaucggaaacgagaauuaccucgacuacaugacgagcaugaagcgguucaaaaacgaauccgaucccgagggcgcccugugguga

SEQ ID NO: 19495 - RNA, 9879 nt, Artificial Sequence
  derived and/or modified CDS sequence (opt5) from DENV-1__EU848545__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcaccauuaucgcgauggaccugggggagcucugugaagauacaaugaccuacaaaugcccgcgcauuacaaaggcugagcccgacgauguggacuguuggugcaaugccaccgauacgugggugaccuauggaacauguuccagaaccggcgaacaccggcgcgacaaaagaucugucgcccuggcuccucauguggggcugggacucgagacacgggccgagaccuggaugagcuccgaaggcgcuuggaagcaaauccagaagguugagacgugggcccugcgccaccccggcuucacagugauugcgcuuuuucuggcccaugcuaucgggaccucuaucacacagaaaggaauuaucuucauucuccugaugcuugucaccccuagcauggccaugagaugcgugggcaucgggaaccgggauuuuguugaaggacuguccggcgcuaccuggguggacgucgugcucgagcacgggagcugugugacaacgauggccaaggauaaacccacccuggacauugagcugcucaagacagaagucaccaaaccugcgguucugcgcaagcuuugcaucgaggccaagauuucuaauacaaccacggauuccagauguccgacacagggagaagcuacccugguggaggaacaagacgccaacuucgugugccggcgcaccuuugucgauagaggcuggggcaauggguguggacucuucggcaaagggagccugaucacaugcgcuaaguuuaaaugcgugaccaagcuugagggaaaaaucguucaguacgagaaccugaaguauucugugauugucacagugcacacgggcgaccagcaucagguugggaaugaaaccacagagcacggaaccaucgccacaauuaccccccaagccccuacguccgaaauccagcucaccgacuacggcgcucugacacuggauuguagcccccggaccggccucgacuucaacgagauggugcugcuuacaaugaaagaaaagucuuggcugguccauaagcagugguuucucgaucugccucuucccuggaccuccggggcgagcacgccgcaggagacauggaaucgcgaggaccugcucgugaccuucaaaacagcccacgcuaagaaacaagaagucgugguucugggaucccaggagggcgccaugcacaccgcccugaccggggcuacagaaauucagacgucuggaaccacaaagaucuuugccggccaucucaaaugcagacugaagaugaacaagcuuacccugaaagggaugagcuaugugauguguacaggcuccuucaagcucgagaaagaagucgcggagacccaacacggaacggugcugguucaggugaaguacgagggcacagaugcuccuugcaaaauccccuucagcacccaggacgaaaagggggucacccagaauggacggcugauuacagccaacccuaucgugaccgauaaggagaaacccgugaauauugaagccgagcccccuuuuggcgagucuuauaucguugucggggcuggagaaaaggcccuuaaacucuccugguucaagaaaggcagcucuauugggaagaugcuggaggcuacagccagaggcgcgcgccggauggccauccugggagacacggcuugggauuuuggcagcaucgggggaguguucaccuccgugggcaagcucguccaucaaauuuuugggacagccuacggagugcuguucucuggcguuagcuggaccaugaaaaucgggauuggcauccuucugacauggcucggacugaacuccagaagcgcuucucuguccaugaccuguauugccgugggcauggucacgcuuuaccucggggugaugguucaggcggacagcggaugcgugaucaauuggaagggccgcgaacugaaaugugggucuggaauuuuugucaccaacgaggugcacacauggaccgaacaguauaaguuccaggccgauuccccgaaacggcugagcgcugccaucggcaaggcuugggaggaggggguuugcggcaucagauccgccacacgccucgaaaacauuauguggaaacaaaucucuaaugagcugaaccauauucuucuggaaaaugacaugaaguuuaccguggucgugggagacgugagcggcauccucacacaggggcggaagaugauuggaccccagccuauggagcacaaauacuccuggaagucuuggggcaaagccaagaucaucggggcugauguccagaacaccacguucauuaucgacggacccaauacaccugaaugucccgaugaccaaagagcguggaacauuugggagguugaggauuauggcuuuggcaucuucaccaccaauauuuggcugaaacugcgcgacagcuacacacaggugugcgauccgcggcuuauguccgccgcuaucaaggacagcaaggccgugcacgccgauaugggguauuggaucgaaucugagaaaaacgaaaccuggaagcucgcuagagccuccuuuauugaggucaaaacguguguguggccuaagagccauacacuguggucuaauggaguucuggaauccgagaugaucauucccaaaaucuacggcgggccuauuagccagcacaacuaucgccccggauacucuacccagacagcgggcccuuggcaucucgggaagcuggagcuugacuucgaucugugcgaaggaaccacaguggucguggacgagcacugcggcaaucggggccccagccucagaaccacgaccguuacagggaagaucauccacgaaugguguugccgguccuguacccugccgccucugcgcuucaaaggagaggauggcugcugguacgggauggagauuagacccgugaaggacaaagaagagaaccuugucaagagccucgugucugcuggauccggcgaaguugacagcuuuucccuggggcugcucuguaucucuauuaugaucgaggaagugaugcggagcagauggucccgcaaaaugcugaugacaggaacccuugccgucuuccugcuccugauuaugggccaacugacguggaaugaucuuauccggcugugcauuauggugggcgccaacgcuucugacagaauggggaugggaacaaccuaucucgcccugauggcgacauuuaagaugcgccccauguucgcugugggccuccuguuuagacggcuuaccagccgcgagguccugcuccugaccaucgggcugucccuuguugccucuguggagcugccuaauagccucgaagagcugggagauggccucgccauggggaucaugauucugaagcuucugacagacuuccagucccaucagcucugggcugcccugcugagccuuacguuuaucaaaaccacauucucucugcacuacgcuuggaagaccguggccaugguccucuccauugugagccuguuuccgcucugucugucuacaaccucccaaaaaacgacauggcuucccguucugcugggaagccucggcugcaagccucugaccauguuccuuaucgcggaaaacaaaauuuggggcagaaagucuuggccccugaacgaggggaucauggccgugggaaucgucuccauucuccugagcucccuccugaaaaaugaugugccucuugcuggcccccugaucgccgggggaaugcugauugcuuguuauguuaucagcggcucuagcgccgaccucucccuggaaaaggccgcugagauuucuugggaggaagaggcggaacauagcggggccucccacaacauccuuguggagguccaggaugacggaaccaugaagaucaaagaugaagagcgggacgauacacugaccauucuccugaaggcuacacuccuggccgugucuggcgucuacccuaucagcauucccgccacgcuuuuugugugguauuucuggcagaaaaagaaacagcgcuccggcguucugugggacaccccgucuccucccgagguggaaagagcuguccuggaugacgggaucuaccggauucuccaacgcggacugcuuggcagaagccagguggggguuggaguguuucaggagggcgucuuccauacaauguggcacgugacccggggggccgugcugauguaucagggaaagcgccucgaaccuuccugggcgagcguuaagaaagaccugaucucuuacggcggcggguggagauuccaaggauccuggaauacaggcgaggagguccaggugauugcuguggaacccgggaagaacccgaaaaauguccagaccgccccuggaacguuuaagacccccgagggcgaagugggggccaucgcucucgauuucaaaccuggaacaagcggcucucccaucguuaaccgggagggcaagauuguggggcuguacggaaauggcgucgugaccacauccgggaccuauguuagcgccaucgcgcaggcuaaggccucccaagaaggaccccuuccugagauugaggacgaaguguuuagaaaacgcaaccugacaaucauggaucugcacccgggcucugggaagacgcggagauaccuccccgccauuguccgcgaggcuaucaaacggaagcugagaacccuuauccuggccccuacacgcgugguugcuagcgaaauggccgaggcgcucaaaggcaugcccauucgguaucagaccaccgccgugaaguccgaacauacaggaagagagaucgucgaccugaugugccacgcuacguucaccaugcgccugcucagcccugugcgggugcccaauuacaacaugauuaucauggaugaggcccauuuuacagacccugcuucuauugccgccagaggcuauaucuccacccgggucgggaugggagaagcugcggccaucuucaugacagcuaccccgcccggcagcguugaggccuuuccucagucuaaugccgugauucaagaugaagagcgcgacauccccgaaagaagcuggaacuccggguacgauuggauuacggacuucccuggaaagacagugugguuuguccccucuaucaaaagcggcaaugauauugcuaacugucuucggaagaaugggaaacgcgugauccagcuguccagaaagaccuucgacaccgaguaucagaaaacaaagaacaacgacugggauuacguugugaccacagacauuucugagaugggcgccaauuuucgggcggauagagucaucgacccgcgccggugccugaagccugugauccucaaagauggacccgaaagaguuauucuggcuggccccaugccugugaccgucgccagcgccgcucagcgccgggggagaaucggacgcaaccaaaauaaggagggcgaccaguacauuuauauggggcagccccuuaacaaugaugaagaccacgcccauuggacggaggcgaaaaugcugcucgauaacaucaauacaccugagggaauuaucccggcccuguucgaacccgagcggggcaaguccgcugccaucgacggggaauacagacugcgcggcgaggcuagaaaaaccuucguggaacucaugcggcgcggagaucuuccugucuggcugagcuauaagguggccucugagggcuuucaguacuccgacagaaaauggugcuucgauggggagcggaacaaucaaguucuggaagagaacauggacguggaaauuuggacaaaggagggagaacgcaagaaacucagaccccgguggcuggacgcuagaaccuauagcgauccucaggcccuucgcgaguuuaaggaguucgcggccggccggagauccgugucuggggaccugauccucgaaauuggaaaacugccccagcaccugacgcagcgcgcucaaaaugcccucgauaaccuugucaugcugcacaauagcgagcagggcggcaaggcuuaccggcaugccauggaagagcugccggacaccaucgaaacacucaugcugcuugcccugauugcuguucucaccgggggagugacacuguuuuuccuguccggcagagggcucggaaaaaccucuaucggccuucugugugugauggcgagcuccguccugcucuggguggccagcguugagccucacuggaucgcugccucuauuauccuggaguuuuuccuuauggugcugcucauucccgaaccugaucggcagcgcacaccccaggacaaccaacuggccuaugucgugaucgggcugcucuuuaugauucuuaccgucgcugccaaugagaugggacugcuggaaacgacaaagaaggaucucggcaucggccauguggcgguugagaaccaccaccaugccaccaugcuggacguggaucuuagaccugcuuccgccuggacccuguacgcugucgccacaaccauuaucacacccaugaugcggcacacgaucgagaacaccacagcgaauauuagccucaccgccaucgcuaaccaggccgcuauucugauggggcuggacaaaggauggccgaucucuaagauggauauuggcgugccucuccuugcccuggggugcuacucccagguuaauccccugacacucaucgcugccgugcugaugcuugucgcgcauuaugccaucauuggacccggccugcaagcuaaagccacccgcgaagcucagaagagaacggccgccgggaucaugaaaaacccuaccguggacggaauuguggcgaucgaucucgacccgguugucuacgacgcuaaguucgagaagcagcugggccagauuaugcugcucauccuuuguacaagccaaauccugcugaugcggaccacaugggcccucugcgaaucuauuacccuggcuacgggcccccuuacaacccugugggaggggagcccuggaaaauuuuggaauacaaccaucgccguguccauggccaacauuuuccgcggcucuuaucucgcuggggccggacuggcguuuagccugaugaagucccucggcgggggaagacggggcaccggcgcccagggggaaacacuuggagagaaauggaagcgccagcugaaucagcugagcaaauccgaguucaacacguacaagagaucuggcaucauggaaguggaucggagcgaggcuaaggaagggcucaaaagaggagagaccacaaagcacgccgucucccgcggcaccgcuaaacugcggugguucguugaaagaaaucuugugaagcccgaggggaaagugauugaccugggauguggccgcggcggguggucuuauuacugcgccggacucaagaaagucacagaggugaagggcuauaccaaggggggaccuggccaugaagagcccaucccuauggcgacguacggguggaaccugguuaaacugcacagcggaaaggauguguuuuucacaccgcccgaaaaaugugacacccuccuuugcgauauuggcgaguccucuccuaaucccaccaucgaagagggccggacacugagaguccugaagaugguggagccuuggcuccgcgggaaccaauuuuguaucaaaauucugaaucccuacaugccgagcguuguggaaacccuugagcagaugcagcggaagcacggaggcaugcuggucagaaacccucucucccgcaauagcacacaugaaauguauugggugucuugcgggacgggaaacaucguguccgccgucaauaugaccagccggaugcugcugaacagauucacaauggcucaccgcaagcccaccuacgagcgggacguugaucucggcgccgggacaagacauguggcuguggagcccgaagucgccaaccuggacauuaucggacagcgcauugagaauaucaaaaacgaacacaagucuaccuggcacuaugaugaggacaauccuuacaaaacgugggcuuaucauggcuccuacgaagugaagcccagcggcucugccuccagcaugguuaacgggguggucagacuucugaccaaaccuugggaugugaucccgaugguuacacaaauugcgaugaccgacacaacccccuuuggacagcagcggguguucaaggagaaggucgacacacgcaccccuaaagccaagagaggcacggcucaaaucauggaggugacagcccgguggcucuggggguuucuguccagaaauaaaaagccccggauuuguacccgcgaagaguucaccagaaaaguucggagcaacgcugccaucggagccguguuugucgaugaaaaucaguggaacucugcgaaggaggcuguggaagacgagcgcuucugggaucuuguccacagagagcgggaacugcauaagcagggcaaaugcgccacaugcguguauaauaugauggggaagcgcgagaaaaagcucggcgaauuuggaaaagccaagggcagcagagcuauuugguacauguggcugggggcccgguuccuggaguuugaagcucucggauucaugaacgaggaccacugguucucccgcgagaauucucugagcggcguugaaggggagggacuucauaaacugggcuacauccucagagauaucuccaagauuccugggggcaacauguaugccgacgauacggcgggaugggacacccggaucacagaagaugaccugcagaaugaggccaagauuaccgauaucauggagcccgaacacgcucuucuggccacaucuauuuuuaaacucaccuaccaaaacaaggugguccgcgugcagagaccggcuaaaaauggcacagugauggacguuaucagccggcgcgaucagagaggguccggacaggugggcaccuaugggcugaacacguucaccaacauggagguccaacugauccggcagauggaaucugagggaauuuuuagcccuuccgaacucgagacacccaaucuggccgagagagugcuugacuggcuggaaaagcacggcguugagcgccucaaacggauggcgaucagcggggacgauuguguggucaagccuaccgacgauagauucgccacagcucugaccgcccuuaacgacaugggcaaggugcgcaaagauauuccccagugggaaccuucuaagggauggaaugacuggcagcaaguccccuuuugcucccaucacuuccaucagcugaucaugaaagauggccgggagauugugguuccguguagaaaccaggacgaacucguggggcgcgcucgggucagccagggagccggcuggucucugagagagacggcuugccuggggaaguccuacgcccaaauguggcagcucauguauuuucaccgccgggaucugagacuugcggccaaugcuaucuguagcgccgugccuauugacuggguucccacaucccgcaccacauggucuauccacgcccaucaccaguggaugaccacggaggauaugcugagcguguggaaccgggucuggaucgaagagaaucccuggauggaagacaaaacccauguguccagcugggaggacgugccuuaccucggaaagagagaagaucaauggugcggcucucugauugggcuuacagcucgggccaccugggcgacaaacauccagguugcuauuaaucaggucagacgccugaucggcaacgagaauuaucucgacuacaugaccuccaugaagcgguucaaaaacgagagcgaucuggaaggagcccugugguga

SEQ ID NO: 19496 - RNA, 9879 nt, Artificial Sequence
  derived and/or modified CDS sequence (opt5) from DENV-1__KR024708__SS-prME
uccgugaccaugcugcucaugcugcuucccacagcccuggcuuuccaccucacgaccagaggcggggaaccucauaugauugucuccaagcaggaacggggaaaaucucugcuuuuuaagacaagcgccggcguuaacaugugcacccugauugcgauggaccucggggaacugugugaagauacaaugaccuacaaaugcccgcgcaucacagaagcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggguguccuaugucauguguacgggcagcuucaagcuggagaaggaaguggccgagacacagcacggaaccguucuugugcaggucaaauacgagggcaccgaugcgccgugcaagauuccuaucucuacacaagacgaaaaaggggugacccagaacggaagacucaucacagcuaaucccauugugacggauaaggagaaaccuguuaacaucgaaaccgagccgcccuucggcgaguccuauauugucaucggggccggagaaaaggcccugaagcugagcugguuuaaaaagggcucuagcauugggaaaauguucgaggcuacagcccggggcgcuagacgcauggccauccucggagacaccgcgugggauuuuggcuccaucgggggaguguucacaucugugggcaagcugguccaucagguguuugggaccgccuacggaguucuuuucagcggcguguccuggacgaugaaaauugggaucggcauucugcucaccuggcugggacugaauagccggucuacaucccuuagcaugaccuguaucgcugucggcauggugacacucuaccuggggguuauggugcaggccgacucuggaugcgucauuaacuggaagggcagagaacugaaguguggguccggaaucuuugugaccaacgagguucacacauggaccgaacaauauaaauuccaggcugauagcccuaagcgccucuccgccgcgauuggcaaagccugggaggagggggugugcggcauccggucugcuacgagacuggaaaauaucauguggaagcagauuagcaacgagcuuaaucauauccugcucgaaaacgacaugaaauuuacagucguggugggagacgccaauggcauucugacccaggggaagaaaaugauccgcccgcaacccauggagcacaaguacuccuggaagucuuggggaaaagcuaagauuaucggcgccgauacccagaacacaaccuucaucauugacgggccugauacgcccgaauguccugacgaucagcgggccuggaauaucugggaggucgaggacuauggauuuggcguuuucacaaccaacauuuggcugaaacuuagagauagcuacacacagaugugcgaccaccgccucauguccgcugcgaucaaggauagcaaagccgugcaugcugacaugggcuauuggauugaaucugagaagaaugaaaccuggaagcuggcccgggccuccuuuaucgaggugaaaacauguaucuggcccagaagccacacccuguggucuaacgggguccucgaauccgagaugauuaucccgaagauuuacggaggcccuaucagccaacauaauuaucgccccggguacuucacgcagaccgcuggaccuuggcaccugggcaaacuugagcuggauuucaaccucugcgaagggacaaccgugguuguggacgagcacugcggaaaucggggccccucucugagaacaaccacggucacaggcaagauuauccaugaaugguguugccggagcuguacccugccuccccuucgcuuuagaggggaggauggaugcugguacggcauggagauccggccggugaaagaaaaggaggaaaaccucguuagauccauggugagcgccgggucuggagaggucgacuccuucagccugggccugcucuguguguccauuaugaucgaagagguuaugcgcucucgguggagcagaaagaugcugaugacagggacccuugcgguguuuuuccugcucauuaugggacagcugaccuggaaugaccugauccgccuuugcauuauggucggcgcuaacguguccgauagaaugggcauggggacaacguaucuggcccucauggccaccuuuaaaaugcggccuauguucgcugugggacugcucuuucgcagacugacaucucgggagguccuucugcucaccaucggccugagccugguugccuccguggaacuucccaacucucuggaggaacucggggacggacuggcgaugggcauuaugaugcucaagcugcuuacagauuuccaaagccaccagcuguggaccacgcuccugucccugacauuuaucaaaaccacccuuagccuggacuacgcuuggaagacaauggccauggugcucucuaucgucucccuguucccccucugucugagcaccacaucucagaaaacgaccuggcuuccugugcugcugggguccuuuggaugcaagccgcucacaauguuccugauuaccgagaauaagaucuggggccgcaaaagcuggccccuuaacgaaggcauuauggccguugggaucgugucuauucugcucuccagccugcucaagaaugaugucccucuggcuggaccccuuaucgccggcgggaugcugaucgcuuguuaugugauuuccggaagcucugccgaccugagccucgagagagcggccgagguuuccugggaagaggaagcugagcauucuggcgccagccacaacauccugguggaaguccaggaugacgggacaaugaaaauuaaggaugaggagcgggacgauacccuuacgauccugcucaaagcuacccugcucgccguguccggagucuacccuaugucuauucccgccacacuguuugugugguauuucuggcaaaagaaaaagcagcgcagcggcguucuuugggacaccccuagcccucccgaaguggagagagcuguccuggaugacggcaucuaccggauccugcagcgcgggcuccugggaagaucucaggugggcguugggguguuccaagacggagucuuucauacaauguggcacgugacccggggcgcggugcuuauguaucaggggaagagacuggaacccagcugggccuccguuaaaaaggaucucauuagcuacggaggcggcuggcgcuuccaggggucuuggaauacaggagaggagguccaggugaucgcuguggaacccggcaaaaacccuaagaauguccaaacgacccccgggacauuuaaaaccccggagggagaagugggcgccauugcccuggacuucaagccugggaccuccggaagccccaucguuaaccgggagggcaagauugugggccucuacgggaauggagucgugacaacgucuggcaccuauguuuccgcuaucgcccaggcgaaagcuagccaggaagggccucugcccgagauugaggaugaaguguuuaagaaaagaaaccuuacaaucauggaccugcaccccggauccggcaagacccgccgguaccugccugccaucgucagagaggccauuaaacgcaagcuccggacacugauccuugcuccgaccagagugguugccucugaaauggcggaggcucugaaggggaugcccauucgcuaucaaacgacagccgugaaaagcgaacauaccggcaaggagaucgucgaucucaugugccacgccaccuucacaaugcggcugcuguccccugugagagugcccaauuacaacaugauuaucauggacgaggcucauuuuaccgauccugccagcaucgcugcccggggauauauuucuacacgcgucggcaugggggaagcggccgcuaucuucaugaccgccacgcccccuggauccguugagagcuuuccgcagucuaaugcugugauucaggacgaagagagagauauccccgaacggagcuggaacuccggcuacgacuggauuacagauuucccugggaaaaccgugugguuuguccccucuaucaagagcggaaaugacaucgccaacugucuccgcaaaaacggcaagagagugauucagcuuucccggaagacauucgacaccgaguaucagaagacgaagaauaacgauugggacuacguugugaccacagauaucucugagaugggggccaauuucagagcugaccgcgucauugauccucggagaugccugaaacccgugauccugaaggacggcccggaacgcguuauucucgcgggaccuaugcccgugaccgccgcuagcgccgcccagcggagaggccgcaucgggcggaaccagaauaaagagggagaucaguacauuuauaugggccaaccccugaacaaugacgaagaucacgcucauuggacagaggccaagaugcuucuggacaacaucaauaccccugaggggaucauucccgcgcucuuugaaccugagagagaaaaguccgcugccaucgauggagaguaccgccugagaggcgaagcccggaaaacauucgucgagcugaugcgcagaggggaccucccgguguggcuuagcuauaaggucgcuucugagggcuuucaguacuccgaucggcgcuggugcuucgacggagaaagaaacaaucaggugcuggaggaaaacauggacguugagauuuggaccaaagaaggcgagcggaagaaacugagaccccgcuggcucgaugcccggacguauagcgacccucuggcgcuuagagaguuuaaggaguucgccgcugggcgccgguccgugucuggagaucugauccucgagauuggcaaacugccccagcaccugacacucagagcccaaaaugcucuugacaaccuggugaugcugcacaauagcgaacaagggggaaaggccuaccggcaugcuauggaggaacucccugauaccaucgagacccugaugcuucuggcccucaucgcgguccugacaggcggcguuacccuguuuuuccucuccgggaagggacuuggcaaaacaucuauugggcugcugugugugauggccagcuccgugcuccuguggauggcuagcgucgagccccacuggaucgccgcuucuauuauccuugaauuuuuccugauggugcuccugauuccggagccugaccgccagagaacgccccaggauaaccaacuggccuauguugugaucggacuccuuuuuaugauccugaccgucgccgcuaacgaaaugggccugcucgagacaaccaagaaagaccuggggauuggacauguggucgcggagaaucaccaccaugccacaaugcuugauaucgaccugcacccugcuuccgccuggacccucuacgccguggcuacgaccauuaucacacccaugaugcggcauaccauugaaaacacaaccgccaauaucagccugacggcgauugccaaccaggcugccauccugaugggccucgauaagggcuggccuaucucuaaaauggacauugggguuccccuucuggcucugggaugcuacucccaggugaauccgcucacacugaccgccgcgguccuuaugcugguggcccacuaugcuaucauuggcccugggcuccaagccaaggcuacacgcgaggcccagaagagaaccgcugccggaaucaugaaaaaccccaccguugauggcauuguggcgaucgaccuggaccccgucguguacgaugccaaguucgaaaaacagcuggggcagaucaugcuccuuauucuguguacaagccaaauccugcucaugcggacgaccugggcucugugcgagucuauuacacuugccaccggaccucugacaacccucugggaaggcagcccgggcaaguuuuggaauacgacaaucgcuguguccauggccaacauuuuccgcgggucuuaucuggccggagcgggccuggcuuucagccucaugaaaucccuugggggaggcagacgggggaccggagcccagggcgagacccugggcgagaaguggaagcgccagcugaaucagcucagcaaauccgaauuuaacacauacaagagaucugggaucauggagguugaccggagcgaagcuaaagagggacugaagagaggcgaaaccacaaaacaugccgucucccgcgggacggccaaacuucggugguucguggagagaaaucuggugaagcccgagggaaaagucaucgaucucggcugugggcgcggaggcuggucuuauuacugcgcuggccugaagaaaguuaccgaagugaagggguauacaaaaggaggcccugggcacgaggaacccauuccuauggccaccuacggauggaacaucgugaagcugcacagcggccgggacgucuuuuucacacccccugagaaaugugauacccuccuuugcgacauuggggaauccucuccgaaucccacgaucgaggagggaagaacccugcgcgugcugaagaugguugaaccuuggcuccggggcaaccaauuuuguauuaagauccugaaucccuacaugccuagcguggucgagacacuugaacagaugcagagaaaacauggcgggaugcuggugcgcaacccccucucccggaauagcacccacgagauguauuggguuucuugcggaacaggcaacauuguguccgcggucaacaugaccagcagaaugcugcugaaucgcuucacaauggcccaucggaagccgaccuacgagagagauguggaccucggggcuggaacgcgccacguggccgucgaaccugagaucgcuaaccuggauaucauuggccagagaaucgaaaauauuaaaaacgagcacaagucuacauggcauuaugacgaagauaaucccuacaaaaccugggccuaucacggguccuacgagguuaagcccagcggaucugcguccagcauggugaacggcgugguccggcuucugaccaagccuugggacgugauccccaugguuacacaaauugccaugacggacaccacaccuuuuggccagcagcgcguguucaaagagaaggucgauaccagaacaccgcggcccaaaagagggaccgcucaaaucauggaagugacagccaaguggcucuggggauuucugucccggaauaaaaagccucgcaucuguaccagagaggaguucacgcggaagguucgcagcaacgcugccauuggcgcuguguuugucgacgagaaucaguggaacucugccaaagaagcgguggaggaugagagauucugggaccuuguucaucgggaacgcgagcugcacaagcaggggaaaugcgcuaccugcguguauaauaugaugggaaagagagagaaaaagcucggcgaguuugggaaggcuaaaggcagccgggccaucugguacauguggcugggagcucgcuuccuggaguucgaggcccucggcuuuaugaacgaggaucauugguucuccagagaaaauucucugagcggggucgagggagaaggccuucacaagcugggguacauucuccgggacaucuccaaaauucccggaggcaacauguaugccgaugacacagcggggugggauacccgcaucacagaggacgaucugcagaaugaggcuaagaucaccgacauuauggaaccugagcacgcccuucuggccacgucuaucuuuaaacucacauaccaaaacaagguggucagagugcagcggcccgcuaaaagcggcaccguuauggaugugauuucccgcagagaccagcggggaucuggccaggucgggacauauggacugaacaccuucacgaauauggaagugcaacugaucagacagauggagagcgaaggcaucuuuuccccgagcgagcucgagaacucuaaucuggccgaacgcgugcuugacuggcuggagaagcaugggguugaacggcucaagagaauggcuaucuccggagaugacuguguggucaaaccuaccgaugaccgcuucgccacagcgcugaccgcccuuaacgauaugggcaaggugcggaaagacaucccccagugggagccuagcaagggguggaaugauuggcagcaaguucccuuuugcucucaccauuuccaccagcugauuaugaaagacggcagagaaaucguggucccuugucgcaaccaggaugagcucgugggacgggcuagagucucccagggcgccggguggagccugcgcgagacagcuugccugggaaaguccuacgcccaaauguggcagcucauguauuuucaccggagagaccugcgccuugcggccaaugcuauuuguucugccgugcccguuaacugggugccgaccagccggacaaccugguccauccaugcucaccaucaguggaugacgacagaagauaugcugagcgucuggaauagaguguggauugaggaaaacccuuggauggaggacaagacccacguuucuuccugggaagacgugcccuaccucggcaaacgggaggaucaauggugcgggagccugaucggacuuaccgccagagcuacaugggccaccaauauucaggucgcgaucaaccaggugcgccggcugaucggcaaugagaacuaucucgacuacaugacaucuaugaagagauucaaaaaugaaagcgaucccgagggggcccugugguga

SEQ ID NO: 19497 - RNA, 9879 nt, Artificial Sequence
  derived and/or modified CDS sequence (opt5) from DENV-1__KR024705__SS-prME
uccgugaccaugcugcucaugcugcuucccaccgcucuggcuuuccaccucacgacccggggcggggaaccucauaugaucgucuccaagcaggaacggggaaaaucucugcuuuuuaagacaagcgcuggcguuaacaugugcacccugauugcgauggaccucggggaacugugugaagauaccaugaccuacaaaugcccgcgcaucaccgaagcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaaugccaccacggacucccgcuguccgacacaaggagaggcuacccucguggaagaacaagaugccaacuucgugugcagacggaccuuugucgaccgcggcuggggcaauggguguggacuguucggcaaggggagccuucugacaugcgcuaaguuuaaaugcgugaccaagcucgagggaaaaauuguucaguacgaaaaccugaaguauucugugaucgucacagugcacacgggcgaucagcaucaaguugggaaugagaccacagaacacggaaccaucgccacaauuacaccccaggccccuacguccgagauccagcugaccgacuacggcgcucucacacuggacuguagccccagaaccggccuugauuucaacgaaauggugcugcucacaaugaaagagaagucuuggcugguccauaaacagugguuucuugaccugccucuccccuggaccuccggggcgagcacgucccaagagacauggaaucggcaggaucugcuggugaccuucaagacagcccacgcuaagaaacaggaagucgugguucucggaucucaagagggcgccaugcacaccgcccugaccggggcuacagaaauucagacgagcggaaccacaaccaucuuugccggccaucuuaagugccgccugaaaauggacaagcucacacugaaagggguguccuaugucauguguaccggcagcuucaagcuggagaaggaaguggcggagacgcagcacggaacaguucuugugcaggucaaauacgagggcaccgaugcuccgugcaagauuccuaucucuacccaagacgaaaaaggggugacacagaacggaagacucaucaccgccaaucccauugugacagauaaggagaaaccuguuaacaucgaaacggagccgcccuucggcgaguccuauauugucaucggggccggagaaaaggcucugaagcugagcugguuuaaaaagggcucuagcauugggaaaauguucgaggccaccgcucggggcgccagacgcauggcgauccucggagacacagccugggauuuuggcuccaucgggggaguguucaccucugugggcaagcugguccaucagguguuugggacagcuuacggaguucuuuucagcggcguguccuggaccaugaaaauugggaucggcauucugcucacguggcugggacugaauagccggucuaccucccuuagcaugacauguaucgccgucggcauggugacccucuaccuggggguuauggugcaggcugacucuggaugcgucauuaacuggaagggcagagaacugaaguguggguccggaaucuuugugacaaacgagguucacaccuggacagaacaauauaaauuccaggccgauagcccuaagcgccucuccgcggccauuggcaaggcuugggaggagggggugugcggcauccggucugccaccagacuggaaaauaucauguggaagcagauuagcaacgagcuuaaucauauccugcucgaaaacgacaugaaauuuacggucguggugggagacgcuaauggcauucugacacaggggaagaaaaugauccgcccgcaacccauggagcacaaguacuccuggaagucuuggggaaaagccaagauuaucggcgccgauacccagaacaccacauucaucauugacgggccugauacccccgaauguccugacgaucagcgggcuuggaauaucugggaggucgaggacuauggauuuggcguuuucacgacaaacauuuggcugaaacuuagagauagcuacacccagaugugcgaccaccgccucauguccgcggccaucaaggauagcaaagcugugcaugccgacaugggcuauuggauugaaucugagaagaaugaaacauggaagcuggcccgggcuuccuuuaucgaggugaaaaccuguaucuggcccagaagccacacacuguggucuaacgggguccucgaauccgagaugauuaucccgaagauuuacggaggcccuaucagccaacauaauuaucgccccggguacuucacccagacggccggaccuuggcaccugggcaaacuugagcuggauuucaaccucugcgaagggaccacagugguuguggacgagcacugcggaaaucggggccccucucugagaaccacaaccgucacgggcaagauuauccaugaaugguguugccggagcuguacacugccuccccuucgcuuuagaggggaggauggaugcugguacggcauggagauccggccggugaaagaaaaggaggaaaaccucguuagauccauggugagcgcggggucuggagaggucgacuccuucagccugggccugcucuguguguccauuaugaucgaagagguuaugcgcucucgguggagcagaaagaugcugaugaccgggacacuugcuguguuuuuccugcucauuaugggacagcugaccuggaaugaccugauccgccuuugcauuauggucggcgccaacguguccgauagaaugggcauggggaccacauaucuggcccucauggcuacguuuaaaaugcggccuauguucgccgugggacugcucuuucgcagacugaccucucgggagguccuucugcucacaaucggccugagccugguugcguccguggaacuucccaacucucuggaggaacucggggacggacuggcuaugggcauuaugaugcucaagcugcuuaccgauuuccaaagccaccagcuguggacaacccuccugucccugacguuuaucaaaacaacccuuagccuggacuacgccuggaagaccauggccauggugcucucuaucgucucccuguucccccucugucugagcacaaccucucagaaaacaacguggcuuccugugcugcugggguccuuuggaugcaagccgcucaccauguuccugauuacagagaauaagaucuggggccgcaaaagcuggccccuuaacgaaggcauuauggcuguugggaucgugucuauucugcucuccagccugcucaagaaugaugucccucuggccggaccccuuaucgcuggcgggaugcugaucgccuguuaugugauuuccggaagcucugcggaccugagccucgagagagccgcugagguuuccugggaagaggaagccgagcauucuggcgcuagccacaacauccugguggaaguccaggaugacgggaccaugaaaauuaaggaugaggagcgggacgauacacuuaccauccugcucaaagccacgcugcucgccguguccggagucuacccuaugucuauucccgcuacccuguuugugugguauuucuggcaaaagaaaaagcagcgcagcggcguucuuugggacacaccuagcccucccgaaguggagagagcgguccuggaugacggcaucuaccggauccugcagcgcgggcuccugggaagaucucaggugggcguugggguguuccaagacggagucuuucauaccauguggcacgugacacggggcgccgugcuuauguaucaggggaagagacuggaacccagcugggcuuccguuaaaaaggaucucauuagcuacggaggcggcuggcgcuuccaggggucuuggaauaccggagaggagguccaggugaucgccguggaacccggcaaaaacccuaagaauguccaaacaacgcccgggaccuuuaaaacaccggagggagaagugggcgccauugcucuggacuucaagccugggaccuccggaagccccaucguuaaccgggagggcaagauugugggccucuacgggaauggagucgugaccacaucuggcacguauguuuccgccaucgcgcaggcuaaagccagccaggaagggccucugcccgagauugaggaugaaguguuuaagaaaagaaaccuuaccaucauggaccugcaccccggauccggcaagacacgccgguaccugccugccaucgucagagaggcuauuaaacgcaagcuccggacccugauccuugccccgacaagagugguugcgucugaaauggcugaggcccugaaggggaugcccauucgcuaucaaaccacggccgugaaaagcgaacauacaggcaaggagaucgucgaucucaugugccacgcuaccuucaccaugcggcugcuguccccugugagagugcccaauuacaacaugauuaucauggacgaggcccauuuuacagauccugcuagcaucgccgcgcggggauauauuucuacccgcgucggcaugggggaagccgcugccaucuucaugacagcuacacccccuggauccguugaggccuuuccgcagagcaaugccgugauucaggacgaagagagagauauccccgaacggucuuggaacagcggcuacgacuggauuacggauuucccugggaaaacagugugguuuguccccuccaucaagucuggaaaugacaucgcuaacugucuccgcaaaaacggcaagagagugauucagcuuagccggaagaccuucgacacagaguaucagaaaaccaagaauaacgauugggacuacguugugacgaccgauaucuccgagaugggggcgaauuucagagccgaccgcgucauugauccucggagaugccugaaacccgugauccugaaggacggcccggaacgcguuauucucgcuggaccuaugcccgugacagccgccucugcugcccagcggagaggccgcaucgggcggaaccagaauaaagagggagaucaguacauuuauaugggccaaccccugaacaaugacgaagaucacgcgcauuggaccgaggcuaagaugcuucuggacaacaucaauacaccugaggggaucauucccgcccucuuugaaccugagagagaaaagagcgccgcuaucgauggagaguaccgccugagaggcgaagcccggaaaaccuucgucgagcugaugcgcagaggggaccucccgguguggcuuuccuauaaggucgcgagcgagggcuuucaguacucugaucggcgcuggugcuucgacggagaaagaaacaaucaggugcuggaggaaaacauggacguugagauuuggacaaaagaaggcgagcggaagaaacugagaccccgcuggcucgaugcccggaccuauuccgacccucuggcucuuagagaguuuaaggaguucgccgcugggcgccggagcguguccggagaucugauccucgagauuggcaaacugccccagcaccugacgcucagagcccaaaaugcucuugacaaccuggugaugcugcacaauucugaacaagggggaaaggccuaccggcaugcgauggaggaacucccugauacaaucgagacccugaugcuucuggcccucaucgcuguccugaccggcggcguuacacuguuuuuccucagcgggaagggacuuggcaaaaccuccauugggcugcugugugugauggccucuagcgugcuccuguggauggcuuccgucgagccccacuggaucgccgccagcauuauccuugaauuuuuccugauggugcuccugauuccggagccugaccgccagagaacaccccaggauaaccaacuggcuuauguugugaucggacuccuuuuuaugauccugacggucgcggccaacgaaaugggccugcucgagaccacaaagaaagaccuggggauuggacauguggucgcugagaaucaccaccaugccaccaugcuugauaucgaccugcacccugccucugcuuggacacucuacgccguggcgaccacgauuaucacccccaugaugcggcauacaauugaaaacaccacagccaauaucucccugaccgcuauugccaaccaggcugccauccugaugggccucgauaagggcuggccuaucagcaaaauggacauugggguuccccuucuggcgcugggaugcuacucucaggugaauccgcucacgcugacagccgcuguccuuaugcugguggcccacuaugcuaucauuggcccugggcuccaagccaaggcuacccgcgaggcccagaagagaacagcggccggaaucaugaaaaaccccaccguugauggcauuguggcuaucgaccuggaccccgucguguacgaugccaaguucgaaaaacagcuggggcagaucaugcuccuuauucuguguaccucccaaauccugcucaugcggacaacgugggcucugugcgagagcauuacccuugccacaggaccucugaccacacucugggaaggcucuccgggcaaguuuuggaauaccacgaucgccgugagcauggcgaacauuuuccgcggguccuaucuggcuggagccggccuggcuuucucucucaugaaaagccuugggggaggcagacgggggacaggagcccagggcgagacccugggcgagaaguggaagcgccagcugaaucagcucuccaaaagcgaauuuaacaccuacaagagauccgggaucauggagguugaccggucugaagccaaagagggacugaagagaggcgaaacaaccaaacaugcugucagccgcgggacagccaaacuucggugguucguggagagaaaucuggugaagcccgagggaaaagucaucgaucucggcugugggcgcggaggcugguccuauuacugcgcgggccugaagaaaguuacggaagugaagggguauaccaaaggaggcccugggcacgaggaacccauuccuauggccacauacggauggaacaucgugaagcugcacucuggccgggacgucuuuuucacacccccugagaaaugugauacacuccuuugcgacauuggggaaagcuccccgaaucccaccaucgaggagggaagaacgcugcgcgugcugaagaugguugaaccuuggcuccggggcaaccaauuuuguauuaagauccugaaucccuacaugccuucuguggucgagacccuugaacagaugcagagaaaacauggcgggaugcuggugcgcaacccccucagcagaaauuccacacacgagauguauuggguuagcugcggaaccggcaacauugugucugcugucaacaugacauccagaaugcugcugaaucgcuucaccauggcccaucggaagccgacauacgagagagauguggaccucggggcuggaacccgccacguggccgucgaaccugagaucgcgaaccuggauaucauuggccagagaaucgaaaauauuaaaaacgagcacaagagcacguggcauuaugacgaagauaaucccuacaaaacaugggccuaucacgggucuuacgagguuaagcccuccggaagcgcuucuuccauggugaacggcgugguccggcuucugaccaagccuugggacgugauccccaugguuacccaaauugccaugacagacacgaccccuuuuggccagcagcgcguguucaaagagaaggucgauacaagaaccccgcggcccaaaagagggacagcucaaaucauggaagugaccgccaaguggcucuggggauuucugagccggaauaaaaagccucgcaucuguacaagagaggaguucacccggaagguucgcuccaacgcugccauuggcgcgguguuugucgacgagaaucaguggaacagcgccaaagaagcuguggaggaugagagauucugggaccuuguucaucgggaacgcgagcugcacaagcaggggaaaugcgccacgugcguguauaauaugaugggaaagagagagaaaaagcucggcgaguuugggaaggcuaaaggcucucgggccaucugguacauguggcugggagcccgcuuccuggaguucgaggcgcucggcuuuaugaacgaggaucauugguucagcagagaaaauucccugucuggggucgagggagaaggccuucacaagcugggguacauucuccgggacaucagcaaaauucccggaggcaacauguaugcugaugacaccgccgggugggauacacgcaucaccgaggacgaucugcagaaugaggccaagaucacagacauuauggaaccugagcacgcccuucuggccaccuccaucuuuaaacucacguaccaaaacaagguggucagagugcagcggcccgcuaaaucuggcacaguuauggaugugauuagccgcagagaccagcggggauccggccaggucgggaccuauggacugaacacauucaccaauauggaagugcaacugaucagacagauggagucugaaggcauuuuuagcccguccgagcucgagaacagcaaucuggccgaacgcgugcuugacuggcuggagaagcaugggguugaacggcucaagagaauggcgaucucuggagaugacuguguggucaaaccuacggaugaccgcuucgccaccgcucugacagcccuuaacgauaugggcaaggugcggaaagacaucccccagugggagccuuccaagggguggaaugauuggcagcaaguucccuuuugcagccaccauuuccaccagcugauuaugaaagacggcagagaaaucguggucccuugucgcaaccaggaugagcucgugggacgggcuagagucucucagggcgccggguggucccugcgcgagaccgcgugccugggaaagagcuacgcccaaauguggcagcucauguauuuucaccggagagaccugcgccuugcugccaaugcuauuuguuccgccgugcccguuaacugggugccgacaucucggaccacauggagcauccaugcucaccaucaguggaugaccacggaagauaugcuguccgucuggaauagaguguggauugaggaaaacccuuggauggaggacaagacacacguuagcucuugggaagacgugcccuaccucggcaaacgggaggaucaauggugcgggucccugaucggacuuaccgccagagcgaccugggccacaaauauucaggucgcuaucaaccaggugcgccggcugaucggcaaugagaacuaucucgacuacaugaccagcaugaagagauucaaaaaugaaucugaucccgagggggcccugugguga

SEQ ID NO: 19498 - RNA, 9879 nt, Artificial Sequence
  derived and/or modified CDS sequence (opt5) from DENV-1__KR024706__SS-prME
agcgugaccaugcugcucaugcugcuucccacagcucuggcuuuccaccucacgaccagaggaggggagccucauaugaucguguccaagcaggaacggggaaaaucucugcuuuuuaagacaagcgccggcguuaacaugugcacccugauugcgauggaccucggggagcugugugaagauacaaugaccuacaaaugcccgcgcaucacaggagcugagcccgacgauguggacuguuggugcaaugccaccgauacgugggugaccuauggcacauguucccaaaccggggaacacagacgggacaagcgcucugucgcccuggcuccucaugugggacucggccuggagacaagaaccgagacguggaugagcuccgaaggcgccuggcggcaaauucagaaaguugagacaugggcccuucgccaccccggguucaccgugaucgccuuuuuccuggcgcaugccauuggaacaucuaucacccagaagggcaucauuuuuauccuccugaugcuugucaccccuagcauggcuaugagaugcguggggauuggaaaccgggauuucguugaaggccuguccggggccacauggguggacgucgugcucgagcacggaagcugugugacgaccauggcuaagaauaaacccacacuggauaucgagcugcucaagaccgaagucacaaacccugccguucugcgcaaacuuugcauugaggcgaagaucucuaauaccacgacagacuccagauguccgacccaaggcgaagccacccugguggaggaacaggaugcuaacuuugugugccggcgcacacucgucgacagaggcugggggaauggauguggccuguucgggaaaggaagccuucugaccugcgccaaguuuaagugcgugacaaaacucgagggcaagauuguucaguacgagaaccugaaauauucugugaucgucacggugcacaccggggaucagcaucaaguuggaaaugaaacaaccgagcacggcacaaucgcuaccauuacgccccaggccccuaccuccgaaauccagcugacagacuacggcgcccucacccuggacuguagcccccggacagggcuugauuucaacgagauggugcugcucaccaugaaggaaaaaucuuggcugguccauaagcagugguuucuugaccugccucuccccuggacguccggagcuagcacaucccaagagaccuggaaucgccaggaucugcuggugacauucaaaaccgcgcacgccaagaagcaggaggucgugguucucggcucucaagaaggggcuaugcacaccgcccugacaggagccacggagauucagaccagcggcacaaccacaaucuuugcugggcaucuuaaaugcagacugaagauggacaaacucacccugaagggcguguccuaugucauguguacgggguccuucaaacuggaaaaggagguggccgaaacacagcacggcaccguucuugugcaggucaaguacgaggggaccgaugcgccgugcaaaauuccuaucucuacacaagacgagaagggagugacccagaacggccggcucaucacagcuaaucccauugugacggauaaagaaaagccuguuaacaucgagaccgaaccgcccuucggggaguccuauauugucaucggagccggcgagaaagcccugaagcugagcugguuuaagaaagggucuagcauuggcaagauguucgaagcuacagccagaggagcucgccggauggccauccucggcgacaccgcgugggauuuuggguccaucggaggcguguucacaucuguggggaaacugguccaucagguguuuggaaccgccuacggcguucuuuucagcgggguguccuggacgaugaagauuggcaucggcauucugcucaccuggcugggccugaauagcagaucuacaucccuuagcaugaccuguaucgcugucgggauggugacacucuaccugggaguuauggugcaggccgacucuggcugcgucauuaacuggaaagggcgcgagcugaaguguggauccggcaucuuugugaccaacgaaguucacacauggaccgagcaauauaaguuccaggcugauagcccuaaacggcucuccgccgcgauugggaaggccugggaagagggcgugugcggaaucagaucugcuacgcgccuggagaauaucauguggaaacagauuagcaacgaacuuaaucauauccugcucgagaacgacaugaaguuuacagucguggugggcgacgccaaugggauucugacccagggcaagaagaugauccggccgcaacccauggaacacaaauacuccuggaagucuuggggcaaggcuaaaauuaucggggccgauacccagaacacaaccuucaucauugacggaccugauacgcccgaguguccugacgaucagagagccuggaauaucugggaagucgaggacuauggcuuuggcguuuucacaaccaacauuuggcugaaacuucgcgauagcuacacacagaugugcgaccaccggcucauguccgcugcgaucaaagauagcaaggccgugcaugcugacaugggguauuggauugagucugagaagaaugagaccuggaagcuggccagagccuccuuuaucgaagugaagacauguaucuggccccgcagccacacccuguggucuaacggaguccucgaguccgaaaugauuaucccgaaaauuuacggcgggccuaucagccaacauaauuaucggcccggauacuucacgcagaccgcuggcccuuggcaccuggggaaacuugagcuggauuucaaccucugcgagggaacaaccgugguuguggacgaacacugcggcaauagaggccccucucugcggacaaccacggucacagggaaaauuauccaugagugguguugccgcagcuguacccugccuccccuuagauuucggggagaagauggcugcugguacgggauggagaucagaccggugaaggagaaagaagagaaccucguucgcuccauggugagcgccggaucuggcgaagucgacuccuucagccuggggcugcucuguguguccauuaugaucgaggaaguuaugcggucuagauggagccgcaagaugcugaugacaggaacccuugcgguguuuuuccugcucauuaugggccagcugaccuggaaugaccugaucagacuuugcauuauggucggcgcuaacguguccgaucggauggggaugggaacaacguaucuggcccucauggccaccuuuaagaugcgcccuauguucgcugugggccugcucuuuagacggcugacaucucgcgagguccuucugcucaccaucgggcugagccugguugccuccguggagcuucccaacucucuggaggaacucggagacggccuggcgauggggauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggauccuuuggcugcaaaccgcucacaauguuccugauuaccgaaaauaagaucuggggcagaaagagcuggccccuuaacgaggggauuauggccguuggaaucgugucuauucugcucuccagccugcucaaaaaugaugucccucuggcuggcccccuuaucgccgggggaaugcugaucgcuuguuaugugauuuccggcagcucugccgaccugagccucgaacgggcggccgagguuuccugggaggaagaggcugaacauucuggggccagccacaacauccugguggagguccaggaugacggaacaaugaagauuaaagaugaggaacgcgacgauacccuuacgauccugcucaaggcuacccugcucgccguguccggcgucuacccuaugucuauucccgccacacuguuugugugguauuucuggcagaagaagaaacagagaagcggcguucuuugggacaccccuagcccucccgagguggaacgggcuguccuggaugacgggaucuaccgcauccugcagagaggacuccugggccggucucagguggggguuggaguguuccaagacggcgucuuucauacaauguggcacgugaccagaggggcggugcuuauguaucagggaaagcgccuggagcccagcugggccuccguuaagaaagaucucauuagcuacggcggcggguggcgguuccagggaucuuggaauacaggcgaagagguccaggugaucgcuguggagcccgggaagaacccuaaaaauguccaaacgacccccggaacauuuaagaccccggaaggcgaggugggggccauugcccuggacuucaaaccuggaaccuccggcagccccaucguuaacagagaaggcaagauuguggggcucuacggaaauggcgucgugacaacgucugggaccuauguuuccgcuaucgcccaggcgaaggcuagccaggagggaccucugcccgaaauugaggaugagguguuuaaaaagcgcaaccuuacaaucauggaccugcaccccggcuccgggaaaacccggagauaccugccugccaucguccgcgaagccauuaagcggaaacucagaacacugauccuugcuccgacccgcgugguugccucugagauggcggaagcucugaagggcaugcccauucgguaucaaacgacagccgucaagagcgagcauaccggaaaagaaaucgucgaucucaugugccacgccaccuucacaaugagacugcuguccccugugcgggugcccaauuacaacaugauuaucauggacgaggcucauuuuaccgauccugccagcaucgcugcccgcggcuauauuucuacaagagucgggaugggagaggcggccgcuaucuucaugaccgccacgcccccuggcuccguugaggcuuuuccgcagagcaaugccgugauucaggacgaggaacgggauauccccgagcgcucuuggaacagcggguacgacuggauuacagauuucccuggaaagaccgugugguuuguccccuccaucaaaucuggcaaugacaucgccaacugucucagaaagaacgggaaacgggugauucagcuuagcagaaagacauucgacaccgaauaucaaaagacgaaaaauaacgauugggacuacguugugaccacagauaucuccgagaugggcgcuaauuuccgcgcggaccgggucauugauccuagacgcugccugaagcccgugauccugaaagacggaccggagcggguuauucucgccggcccuaugcccgugaccgcugccucugccgcucagagacgcgggcggaucggaagaaaccagaauaaggaaggcgaucaguacauuuauauggggcaaccccugaacaaugacgaggaucacgcccauuggacagaagcgaaaaugcuucuggacaacaucaauaccccugagggaaucauucccgcucucuuugagccugaacgcgaaaagagcgccgccaucgauggcgaauacagacucgggggagaggcucggaagacauucgucgaacugaugaaacgcggagaccugccgguguggcuuuccuauaaggucgccagcgagggcuuucaguacucugauagacgguggugcuucgacggggagcgcaacaaucaggugcuggaagagaacauggacguugaaauuuggaccaaagagggagaaagaaagaaacugcggcccagauggcucgaugcgcgcacguauuccgacccucuggcccuucgggaguuuaaggaguucgcugccggcagacgcagcguguccggggaucugauccucgaaauuggaaaacugccccagcaccugacacuccgggcucaaaaugcccuugacaaccuggugaugcugcacaauucugagcagggcggcaaggcuuacagacaugccauggaggaacucccugauaccaucgaaacccugaugcuucuggcgcucaucgccguccugacagggggaguuacccuguuuuuccucagcggcaaggggcuuggaaaaacauccauuggccugcugugugugauggcuucuagcgugcuccuguggauggccuccgucgagccccacuggaucgcugccagcauuauccuugaguuuuuccugauggugcuccugauuccggaaccugaccggcagcgcacgccccaggauaaccaacuggccuauguugugaucgggcuccuuuuuaugauccugaccgucgcugcgaacgagaugggacugcucgaaacaaccaagaaagaccugggcauuggccauguggucgccgagaaucaccaccaugcuacaaugcuugauaucgaccugcacccugccucugccuggacccucuacgcuguggccacgaccauuaucacacccaugaugagacauaccauugagaacacaaccgcgaauaucucccugacggccauugcuaaccaggccgcuauccugauggggcucgauaagggauggccuaucagcaaaauggacauuggcguuccccuucuggcccuggggugcuacucucaggugaauccgcucacacugaccgcggccguccuuaugcugguggcucacuaugccaucauuggaccuggccuccaagcuaaggccacacgggaagcucagaagcgcaccgccgcggggaucaugaaaaaccccaccguugauggaauuguggccaucgaccuggaccccgucguguacgaugcuaaguucgagaaacagcugggccagaucaugcuccuuauucuguguacaucccaaauccugcucaugagaacgaccugggcccugugcgaaagcauuacacuugcuaccggcccucugacaacccucugggaggggucuccgggaaaguuuuggaauacgacaaucgccgugagcauggccaacauuuuccggggcuccuaucuggcgggggcuggacuggccuucucucucaugaaaagccuuggcgggggacgcagaggcaccggcgcucagggggaaacccugggagagaaguggaagcggcagcugaaucagcucuccaaaagcgaguuuaacacauacaagcgcuccggcaucauggaaguugacagaucugaggccaaagaagggcugaagcggggagagaccacaaaacaugccgucagcagaggcacggcuaaacuucgcugguucguggaacggaaucuggugaagcccgaggggaaagucaucgaucucggauguggcagaggcgggugguccuauuacugcgccggacugaagaaaguuaccgaggugaagggcuauacaaaagggggaccuggccacgaggaacccauuccuauggcgaccuacggguggaacaucgugaagcugcacucuggacgcgacgucuuuuucacacccccugaaaaaugugauacccuccuuugcgacauuggcgagagcuccccgaaucccacgaucgaagagggccggacccugagagugcugaagaugguugagccuuggcuccgcgggaaccaauuuuguauuaagauccugaaucccuacaugccuucuguggucgaaacacuugagcagaugcagcggaaacauggaggcaugcuggugagaaacccccucagccgcaauuccacccacgaaauguauuggguuagcugcgggacaggaaacauugugucugccgucaacaugaccucccggaugcugcugaauagauucacaauggcucaucgcaagccgaccuacgagcgggauguggaccucggcgccgggacgagacacguggcugucgagccugaaaucgccaaccuggauaucauuggacagcgcaucgagaauauuaaaaacgaacacaagagcacauggcauuaugacgaggauaaucccuacaaaaccugggcguaucacggcucuuacgaaguuaagcccuccggcagcgccucuuccauggugaacgggguggucagacuucugaccaagccuugggacgugauccccaugguuacacaaauugcuaugacggacaccacaccuuuuggacagcagcggguguucaaagagaaggucgauacccgcacaccgagacccaaacggggcaccgcccaaaucauggaggugacagcuaaguggcucuggggguuucugagcagaaauaaaaagccucggaucuguacccgcgaagaguucacgagaaagguucgguccaacgccgcuauuggagccguguuugucgacgaaaaucaguggaacagcgcgaaagaggccguggaagaugagcgcuucugggaccuuguucauagagagcgggaacugcacaagcagggcaaaugcgcuaccugcguguauaauaugauggggaagcgcgagaaaaagcucggcgaauuuggaaaggccaaaggcucuagagcuaucugguacauguggcugggggcccgguuccuggaguucgaagcccucggauuuaugaacgaggaucauugguucagccgcgaaaauucccugucuggcgucgaaggggagggacuucacaagcugggcuacauucucagagacaucagcaaaauucccgggggcaacauguaugcggaugacacagcuggaugggauacccggaucacagaagacgaucugcagaaugaggccaagaucaccgacauuauggagccugaacacgcccuucuggcuacguccaucuuuaaacucacauaccaaaacaaggugguccgcgugcagagacccgccaaaucuggcaccguuauggaugugauuagccggcgcgaccagagaggguccggacaggucggcacauaugggcugaacaccuucacgaauauggaggugcaacugauccggcagauggaaucugagggaauuuuuagcccguccgaacucgagaacagcaaucuggcugagagagugcuugacuggcuggaaaagcauggcguugagcgccucaagcggauggccaucucuggggaugacuguguggucaaaccuaccgaugacagauucgcgacagcccugaccgcucuuaacgauaugggcaaggugcgcaaagacaucccccagugggaaccuuccaagggauggaaugauuggcagcugguucccuuuugcagccaccauuuccaccaacucauuaugaaagacggccgggagaucguggucccuuguagaaaccaggaugaacugguggggcgcgcccgggucucucagggagcuggcuggucccugagagagacagccugccucggaaagagcuacgcgcagauguggcaacugauguauuuucaccgccgggaccuuagacuggccgcuaaugccauuuguuccgcugugcccguuaacugggugccgaccucucgcacaaccuggagcauccaugcccaccaucaguggaugacgacagaggauaugcucuccgucuggaaucggguguggauugaagagaacccuuggauggaagacaagacccacguuagcucuugggaggacgugcccuaccugggaaaaagagaagaucaguggugcggcucccuuaucgggcugaccgcucgggccacaugggcgaccaauauucaagucgccaucaaccaggugagacgccucaucggcaaugagaacuaucuggacuacaugacaagcaugaagcgguucaaaaaugagucugaucccgaaggagcucugugguga

SEQ ID NO: 19499 - RNA, 9879 nt, Artificial Sequence
  derived and/or modified CDS sequence (opt5) from DENV-1__KR024707__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacgucuauaugggccaaccccugaacaaugacgaagaucacgcccauuggacagaggcgaaaaugcuucuggacaacauuaauaccccugaggggaucauccccgcucucuuugaaccugagcgcgaaaagagcgccgccauugauggagaguacagacugcggggcgaagcucgcaagacauucguggagcugaugagaagaggggaccucccggucuggcuuuccuauaaaguggccagcgagggcuuucaguacucugaucgcagauggugcuucgacggagaacggaacaaucagguucuggaggaaaacauggacguggagaucuggaccaaggaaggcgagcgcaagaagcugcgcccccgguggcucgaugcgagaacguauuccgacccucuggcccuucgcgaguuuaaagaguucgcugccgggcggagaagcguguccggagaucugauucucgagaucggcaagcugccccagcaccugacacuccgggcucaaaaugcccuugacaaccuggucaugcugcacaauucugaacaagggggaaaggcuuaccgccaugccauggaggaacucccugauaccauugagacccugaugcuucugacacucaucgcgguucugaccggcggcgugacacuguuuuuccucagcgggaagggacuuggcaagacguccaucgggcugcugugugugauggccucuagcguccuccuguggauggcuuccguggagccccacuggauugccgcuagcaucauucuugaauuuuuccugaugguucuccugaucccggagccugacagacagcggacaccccaggauaaccaacuggccuauguggucauuggacuccuuuuuaugauccugacaguggccgcuaacgaaaugggccugcucgagaccaccaagaaggaccuggggaucggacaugucguggcggagaaucaccaccaugccaccaugcuugauauugaccugcacccugcuucugccuggacgcucuacgccguugcuaccacaaucauuacccccaugaugcgccauacaaucgaaaacaccacggccaauauuucccugacagcgaucgccaaccaggcugccauucugaugggccucgauaaaggcuggccuaucagcaagauggacaucggggugccccuucuggcucugggaugcuacucucaggucaauccgcucacccugacagccgcggugcuuaugcugguugcccacuaugcuauuaucggcccugggcuccaagccaaagcuaccagagaggcccagaagcggaccgcugccggaauuaugaagaaccccacaguggauggcaucgucgcgauugaccuggaccccgugguguacgaugccaaauucgaaaagcagcuggggcagaucaugcuccuuauccuguguacgucccaaauucugcucaugcgcaccacaugggcucugugcgagagcaucacccuugccacaggaccucugaccacgcucugggaaggcucuccgggcaaauuuuggaauacaaccauugcuguuagcauggccaacaucuucagaggguccuaucuggccggagcgggccuggcuuucucucucaugaaaagccuugggggaggccggcgcgggaccggagcccagggcgagacacugggcgagaaauggaagagacagcugaaucagcucuccaagagcgaauuuaacaccuacaaacgguccgggauuauggaggucgacagaucugaagcuaaggagggacugaaacgcggcgaaacaacgaagcaugccgugagccgggggaccgccaaacuuagaugguucguggagcgcaaucuggucaagcccgagggaaagguuaucgaucucggcugugggcggggaggcugguccuauuacugcgcuggccugaaaaaggugacagaagugaaaggguauaccaagggaggcccugggcacgaggaacccaucccuauggccacauacggauggaacauugucaaacugcacucuggcagagacguguuuuucacgcccccugagaagugugauacccuccuuugcgacaucggggaaagcuccccgaaucccaccauugaggagggacgcacacugcggguucugaaaaugguggaaccuuggcucagaggcaaccaauuuuguaucaagauucugaaucccuacaugccuucugucguggagacccuugaacagaugcagcgcaagcauggcgggaugcugguucggaacccccucagcagaaauuccacacacgagauguauugggugagcugcggaaccggcaacaucgucucugcggugaacaugacaucccgcaugcugcugaaucgguucaccauggcccauagaaaaccgacguacgagcgcgauguggaccucggggcuggaacaagacacgucgccguugaaccugagauugcuaaccuggauaucaucggccagcggauugaaaauaucaagaacgagcacaaaagcaccuggcauuaugacgaagauaaucccuacaagaccugggccuaucacgggucuuacgaggugaaacccuccggaagcgcgucuuccauggugaacggcgucgugcgccuucugacaaagccuugggacguuauucccauggugacgcaaaucgccaugaccgacacaaccccuuuuggccagcagagagucuucaaggagaaaguggauacacggaccccgagacccaagcgggggacagcucaaauuauggaaguuaccgccaaauggcucuggggauuucugagccgcaauaagaaaccuagaaucuguacgcgggaggaguucacccgcaaggugagauccaacgcugccaucggcgcugucuuuguggacgagaaucaguggaacagcgccaaggaagcgguugaggaugagcgguucugggaccuugugcaucgcgaaagagagcugcacaaacaggggaagugcgccacaugcgucuauaauaugaugggaaaacgggaaaagaaacucggcgaguuugggaaggcuaagggcucucgcgccauuugguacauguggcugggagcuagauuccuggaguucgaggcccucggcuuuaugaacgaggaucauugguucagccgggaaaauucccugucugggguggagggagaaggccuucacaaacugggguacauccuccgcgacauuagcaagauccccggaggcaacauguaugccgaugacaccgcggggugggauacaagaauuaccgaggacgaucugcagaaugaggcuaaaaucacggacaucauggaaccugagcacgcccuucuggccacauccauuuuuaagcucaccuaccaaaacaaagucgugcggguucagcgccccgcuaagucuggcacagugauggaugucaucagcagacgggaccagagaggauccggccagguggggaccuauggacugaacacguucaccaauauggaagugcaacugauucgccagauggagucugaaggcaucuuuagcccguccgagcucgagaacagcaaucuggccgaacggguucuugacuggcuggagaaacaugggguggaaagacucaagcgcauggcuauuucuggagaugacugugucgugaagccuacagaugaccgguucgccaccgcgcugacagcccuuaacgauaugggcaaaguuagaaaggacaucccccagugggagccuuccaaaggguggaaugauuggcagcaagugcccuuuugcagccaccauuuccaccagcugaucaugaaggacggccgcgaaauugucgugccuugucggaaccaggaugagcucgucggacgggcucgcgugucucagggcgccggguggucccugcgggagaccgcuugccugggaaaaagcuacgcccaaauguggcagcucauguauuuucacagacgcgaccugcggcuugcggccaaugcuaucuguuccgccguucccgugaacugggucccgacaucuagaaccacguggagcauucaugcucaccaucaguggaugacaaccgaagauaugcuguccguguggaaucggguuuggaucgaggaaaacccuuggauggaggacaagacccacgugagcucuugggaagacguccccuaccucggcaagagagaggaucaauggugcgggucccugauuggacuuacagcccgcgcuaccugggccacaaauauccagguggcgauuaaccaggugcggagacugaucggcaaugagaacuaucucgacuacaugacgagcaugaaacgcuucaagaaugaaucugaucccgagggggcccugugguga

SEQ ID NO: 19500 - RNA, 9879 nt, Artificial Sequence
  derived and/or modified CDS sequence (opt5) from DENV-1__KC172829__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcaccuucaaacucgagaaggaagucgccgagacccagcacggaacagugcugguucagauuaaguacgagggcaccgacgcgccgugcaaaaucccuuucucuacacaagaugaaaagggggugacgcagaacggacggcugaucaccgcuaaucccauugucacagacaaagagaagccugugaacaucgaagccgagccccccuuuggcgaguccuauauugugaucggggccggagaaaaagcucuuaagcucagcugguucaagaaaggcucuagcauugggaagauguuugaggccaccgcuagaggcgcccgccggauggcgauccugggagauacagccugggacuucggcuccaucgggggaguuuuuaccucugucggcaaacuggugcaucagauuuucgggacggcuuacggagugcucuuuagcggcgucuccuggaccaugaagaucgggauuggcgugcugcuuacauggcugggacucaauagcagaucuaccucccugagcaugacauguaucgccguuggccuggugacccuuuaccucggggucauggugcaggcugauucuggaugcguugugaacuggaaaggccgcgaacugaaguguggguccggaauuuucgucacaaaugaggugcacaccuggacggaacaauauaaguuucaggccgacagcccuaaacggcuguccgcggccaucggcaaggcuugggaggaggggguuugcggcauuagaucugccacacgccucgaaaacaucauguggaaacagaucagcaacgagcugaaucauauucuucuggaaaacgacaugaaguucaccguggucgugggagauguggcuggcauccucgcccaggggaaaaagaugauucggccgcaacccauggaguacaaauauuccuggaagucuuggggaaaggccaaaaucauuggcgcugacguccagaauaccacauuuaucaucgaugggccuaacacccccgaauguccugacgaucagagagcguggaauauuugggagguugaggacuacggauucggcaucuuuacgacaaacauuuggcugcgccugcgggauagcuauacccaggugugcgaccacagacuuauguccgccgcuaucaaggauagcaaagccgugcacgccgacaugggcuacuggauugaaucugagaagaaugaaacauggaaacucgcucgcgccuccuucaucgaggucaagaccuguaucuggcccaagagccauacacuguggucuaacggggugcuggaauccgagaugauuaucccgaaaauuuauggaggcccuaucagccaacacaauuaccggcccggguacuucacccagacggcgggaccuuggcaucucggcaagcuggagcuugauuuugaccugugcgaagggaccacaguuguggucgaugagcacugcggaaacagaggccccucucuccggaccacaaccgugacgggcaaaauuauccacgaaugguguugccgcagcuguacacugccuccccugagauuccggggggaggacggaugcugguauggcauggagaucagaccgguuaaggaaaaagaggaaaaucuugugaaguccauggucagcgcugggucuggagagguggacuccuuuagccucggccugcuguguauuuccaucaugauugaagagguuaugcgcucucgguggagcagaaagaugcucaugaccgggacacuggccguguucuuucuucugaucauuggacagcucaccuggaacgaucugauccgccuguccauuauggucggcgccaaugcuucugacaaaaugggcauggggaccacauaccuugcccugauggcgacguucaagaugagaccuauguuugcugugggacuccuguuccggcgccucaccagcagagaggugcugcuucugacaaucggccucucccuggucgccucuguugaacugcccaacagccuugaggaacugggggauggacucgccaugggcaucaugauucugaaacuccugaccgacuuucaaucccaucagcuuugggcuacacugcucagccugaccuucaucaagacgacauuuucucugcacuaugccuggaaaaccauggcuauggugcuuuccauugugagccuguucccccucugccugucuaccacaucccagaagaccacauggcucccuguccugcuugggagccugggauguaagccgcugacgauguuucucaucaccgagaauaaaauuuggggccggaagucuuggccccugaacgaaggcaucauggccguggggaucguuuccauucuucugagcucccuccugaaaaacgaugugccucucgcgggaccccugaucgccggcgggaugcuuauugcuugcuacgucaucagcggaucuagcgccgaccugucccuggagaaggcugccgaggugucuugggaagaggaagccgagcauagcggcgcuucccacaauauucucguugaagugcaggaugacgggacaaugaaaaucaaggaugaggagcgcgacgauacccugacaauccuucugaaagcgacccuccuggccgucucuggaguguauccucucagcauucccgcuacgcuguucgucugguacuucuggcaaaagaagaaacagagauccggcgugcuuugggacaccccuucucccccggaaguugagcgggccgugcuggaugacggcaucuaucgcauuaugcagagagggcugcucggacggagccaggucggcguggggguuuuucaagaaaacguguuccauacaauguggcacgucacccgcggagccgugcugauguaccagggcaagagacuugagccuuccugggcuagcgugaaaaaggaccugaucucuuacgggggaggcuggcggcuccagggcuccuggaauacaggggaggaaguucaggucauugccguggagcccggaaaaaacccuaagaaugugcaaaccgcgcccggcacauuuaagacgaccgaaggggaggucggagcuaucgcccuggauuucaaaccgggcacaagcgggucuccuauugugaacagagaaggaaagaucguuggccucuauggcaaugggguggucaccaccuccggaacauacgugagcgccaucgcucaggccaaagcgucccaggagggcccccugccugagauugaagacgagguuuuucgcaagcggaaccuuacgaucauggaucugcaccccgggucuggaaaaaccagacgcuaucugcccgcuauugugcgggaagccaucaagagaaagcuccgcacacugauucuugccccuacccgggucguggcuagcgagauggccgaagcucugaaaggcaugccgaucagauaccaaacaaccgccguuaaguccgagcauacggggaaagagaucguggaccucaugugucacgcgacauucaccaugcgccugcugagccccguccgggugccuaauuauaacaugauuaucauggaugaagcccauuuuaccgaccccucuuccauugcugccagaggcuacaucagcacacgggugggaaugggcgaggcugccgccauuuucaugaccgcuacaccucccgggucugucgaagcguuuccucagagcaaugccguuauccaggaugaggaacgcgacaucccggagagauccuggaacucuggauaugaguggauuaccgauuucagcggcaagacggugugguuugugcccuccaucaaaucugggaaugacauugcuaacugccuccggaagaauggaaagcgcgucauccagcuuagcagaaaaacauucgauaccgaauaccaaaagacaaaaaacaacgacugggacuacgugguuaccacggauauuuccgagaugggcgccaauuuccgggccgacagagugaucgauccucgccggugucugaagcccgucauucugaaagacgggccugaaagagugauccucgcuggccccaugccgguuaccguggccagcgcggcucagcgccggggaagaaucggccgcaaccacaauaaggagggggaucaguauauuuacaugggacagccucugaacaaugacgaggaucaugcccacuggacagaagccaagaugcuucuggacaacaucaauacccccgagggcauuauccccgcucucuuugaaccugagcgggaaaaaucugccgcgauugauggggaguauagacugcgcggagaggccagaaagacauucgucgaacugaugcggcgcggcgaccuccccguguggcuuuccuacaaagucgcuagcgagggguuucaauauuccgauagacgguggugcuucgacggcgaacgcaacaaucaggugcuggaggaaaacauggauguugagaucuggaccaaggagggagaaagaaaaaagcugcggccuagauggcucgacgcccgcacauacucugacccgcuggcucuucgggaguuuaaagaauucgccgcuggcagacgcagcguguccggggaucugauccucgagauuggaaagcugccccagcaccugacccagcgggcccaaaaugcgcucgacaaccuugugaugcugcauaauucugaacagggcgggagagccuaucggcacgcuauggaggagcugccugauacgaucgaaacacucaugcugcuugcccugauugcuguccucaccggaggcguuacccuguuuuuccugagcggccgcgggcucggaaagacauccaucggccuucugugcgugauggccagcucugugcugcucuggauggccuccgucgagccccauuggauugcugcgagcaucauccuggaauuuuuccuuauggugcugcucauuccugagcccgacagacagcggaccccgcaggauaaccaacuggccuacguugugaucgggcugcucuuuaugauucuuacagucgcugccaaugagaugggacugcuggaaacgaccaaaaaggaccucggcaucgggcacguggccgaugagaaccaccaucacgcugccaugcuggacgucgaucuucauccugcgucugccuggacacuguacgcuguggccaccacaauuaucacccccaugaugcgccacacgauugaaaacaccacagcuaauaucucccucaccgccaucgcgaaccaggccgcuauucugaugggacuggacaaaggcuggccuaucagcaagauggauauuggcguuccccuccuugcccugggguguuauucucaggugaauccucugacacucaccgcugccguccugaugcuuguggcucauuacgccaucauuggacccggccugcaagcgaaagccacgagagaggcucagaagcggacagccgcugggaucaugaagaacccgaccguugacggaaucguggccauugaucucgacccugucguguaugacgccaaauucgaaaagcagcugggccagaucaugcugcucauucuuugcacaagccaaauccugcugaugcgcaccaccugggcgcucugugaguccauuacacuggcuacggggccccuuaccacacugugggagggaucucccggcaaauuuuggaauaccacaaucgccgugagcauggcuaacaucuucagaggcuccuaccucgccggggccggacuggcuuucagccugaugaagucccucggcgggggacggcgcggcaccggggcccagggagaaacgcuuggcgagaaauggaagagacagcugaaucagcugucuaagagcgaauuuaacacauauaaacgguccggcauuauggagguugauagaucugaagcgaaggaggggcucaaacgcggagagaccaccaagcacgccgucagccggggcacagcuaaacugagaugguucguggaacgcaaucuugugaagccugaggggaaggucaucgaccugggaugcggccgggggggaugguccuacuauugugccggccucaaaaagguuaccgaagugaaaggcuacacaaaggggggaccgggccacgaggaacccauuccuauggcuacguacggguggaaccuggugaaacugcauucuggaaaggaugucuuuuucauccccccugagaaaugcgacacccuccuuugugauauuggcgagagcucccccaauccuacaaucgaagaggggagaacccugcgcgugcugaagaugguugaaccguggcuccggggaaaccaauuuugcauuaagauccugaaucccuauaugccuagcguggucgagacacuugagcagaugcagagaaaacacggcggcaugcuggugcgcaacccccucucucggaauuccacccaugaaauguacuggguuagcugugggacgggaaacaucgugucugccgucaauaugaccuccagaaugcugcugaaccgcuucacaauggugcaccggaagccuaccuaugagagagacguggaucucggcgcggggacacgccacgucgccguugaacccgagguggcuaaccuggacauuaucggacagagaauugaaaauaucaaacaugagcacaagagcaccuggcauuacgaugaggacaacccguauaaaacaugggccuaccacggcucuuaugaagugaagccuuccgggagcgcuuccagcauggucaauggagugguuaagcuucugaccaaacccugggaugugauucccauggucacgcaaaucgccaugacagacaccaccccuuuuggccagcagcggguguucaaggagaaaguugacacacgcacgcccaaggcuaaaagaggcaccgcccaaaucauggaagugacagcgcgguggcucuggggguuucugucuagaaacaagaagccucggauuugcacccgcgaggaauucacaagaaaaguccggagcaaugccgcuaucggagccguguuuguugaugagaaccaguggaauuccgcuaaggaggccguggaagacgagcgcuucugggaucuuguccauagagaacgggagcugcacaaacagggcaagugugccaccugcguguacaacaugauggggaaacgcgaaaagaagcucggagaguuuggcaaagcgaaggggucuagagcuauuugguacauguggcugggcgcccgguuccuggaguucgaagcccucggauuuaugaaugaggaccacugguucagccgcgaaaacucccugucuggcgucgagggggagggacuucauaaacugggcuauauccucagagauauuagcaagaucccggggggaaauauguacgcugacgauacagccggcugggacacccggaucacggaagaugaccugcagaacgaggcuaaaauuaccgauaucauggaauccgagcacgcccuucuggcgaagucuauuuuuaaacucacauaucaaaauaaggugguucgcgugcagagacccgccaagaacgggaccgucauggacgugaucagccggcgcgaucagagaggcuccggacaggugggcacauacgggcugaauaccuucacgaacauggaagcucaacugauucggcagauggagagcgagggaaucuuuucuccuuccgaacucgagacacccaaccuggccgaaagagcucuugacuggcuggagaaacauggcguugaacgccucaagcggauggccaucagcggggacgauugcguggucaaaccuauugacgauagauucgcgaccgcccugacagcucuuaaugacaugggaaaggugcgcaaagauaucccccagugggagccgucuaagggcuggaacgacuggcagcaaguuccuuuuuguucccaccacuuccaucagcugauuaugaaggaugggcgggagaucgugguccccugcagaaaucaggacgaacucgugggccgcgcccgggucagccagggagcuggcuggucccugagagagaccgccugucuggggaaaucuuaugcucaaauguggcagcucauguacuuucaccgccgggaucugagacuugccgcgaacgccauuugcagcgcugugccuguugacugggugcccacgucccgcaccacauggagcauccaugcccaccaucaguggaugaccacagaagauaugcugucugucuggaaucggguguggauugaggaaaacccuuggauggaggacaagacccacaucuccagcugggaggacguucccuaucucggaaaaagagaagaucaaugguguggcucucugaucgggcuuacagcccgggcuaccugggccacgaauauucagguggcgaucagccaggucagacgccugauuggaaacgagaauuaccucgacuacaugacauccaugaagcgguucaaaaacgaaucugauccggagggcgcucugugguga

SEQ ID NO: 19501 - RNA, 9879 nt, Artificial Sequence
  derived and/or modified CDS sequence (opt5) from DENV-1__EU359008__SS-prME
agcgugaccaugcugcugaugcugaugcccacagcccuugcuuuccaccugacgacccggggaggggaaccucauaugaucguguccaagcaggaacggggaaaaucucuccuguuuaagacaagcgccggcguuaacaugugcacccuuaucgcgauggaccugggggaacucugugaagauacacugaccuacaaaugcccgcgcaucacagaagcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggucccgggauuuuguugagggacucagcggcgccacauggguggacgucgugcuggagcacgggucuugugugacgaccauggcuaaggauaaacccacacuggacaucgaacuccugaagaccgaggucacaaacccugccguucuucgcaaacugugcauugaagcgaagaucuccaauaccacgacagauagcagauguccgacccaaggagaggccacccucguggaagaacaggacgcuaacuucgugugccggcgcacauuugucgauagaggcuggggcaauggguguggacuguucggcaaagggucucuuauuaccugcgccaaguuuaagugcgugacaaaacuggagggaaagaucguucaguacgaaaaccucaaauauuccgugaucgucacggugcacaccggcgaccagcaucaaguugggaaugagagcacagaacacggaaccacagcuaccauuacgccccaggccccuaccacagagauccagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccacacaagagaccuggaaucgccaggaccuccuggugaccuucaaaacagcgcacgccaagaagcaggaagucgugguucugggaucucaagagggcgcuaugcacacggcccucaccggggccacagaaauucagaccagcggaacaaccacgaucuuugcuggccaucugaaaugcagacuuaagauggauaaacugacacucaaggggauguccuaugugauguguaccggcagcuucaaacuggagaaggaagucgccgagacccagcacggaacagugcugguucagauuaaguacgagggcaccgacgcgccgugcaaaaucccuuuccuuacacaagaugaaaagggggugacgcagaacggacggcucaucaccgcuaaucccauugucacagacaaagagaagccugugaacaucgaagccgagccgcccuuuggcgagucuuauauugugaucggggccggagaaaaagcucugaagcuguccugguucaagaaaggcagcucuauugggaagauguuugaggccaccgcuagaggcgcccgccggauggcgauccucggagauacagccugggacuucggcagcaucgggggaguuuuuaccuccgucggcaaacuggugcaucagauuuucgggacggcuuacggagugcucuuuucuggcgucagcuggaccaugaagaucgggauuggcgcccugcucacauggcugggacucaauuccagaagcaccucucuuuccaugacauguaucgcugugggccucguuacccuguaccugggggugaugguccaggccgauagcggaugcgugauuaacuggaaaggccgcgaacucaagugugggucuggaaucuucguuacaaaugaggugcacaccuggacggaacaauauaaguuucaggcggacuccccuaaacggcugagcgccgcuauuggcaaggccugggaggagggggucugcggcaucagauccgcuacacgccuugaaaacaucauguggaaacagauuucuaacgagcugaaucauauccuccuggaaaacgacaugaaguucaccgugguugugggagaugucgccggcauucuggcccaggggaaaaagaugauccggccgcaacccauggagcacaaauacagcuggaaguccuggggaaaggcuaaaauuaucggcgcggacgugcagaauaccacauuuaucauugaugggccuaacacccccgaauguccugacgaucagagagccuggaauaucugggagguggaggacuauggauucggcauuuuuacgacaaacaucuggcuuaagcuccgcgauucuuacacccaggucugcgaccaccggcugaugagcgcugccauuaaagauuccaaggccguucaugcugacaugggcuauuggaucgaaagcgagaaaaaugaaacauggaagcuggccagagcgucuuucaucgaggugaagaccuguauuuggcccaaaucccacacacucuggagcaacggggugcuggaaucugagaugaucauuccgaagaucuacggaggcccuauuucccaacauaauuaucgccccggguacuucacccagacggcuggaccuuggcaccuuggcaaacuggagcucgauuuugaccugugcgaagggaccacagucgugguugaugagcacugcggaaaccggggccccagccugagaaccacaaccgugacgggcaagaucauccaugaaugguguugccggucuuguacacuuccuccccuccgcuucagaggggaggacggaugcugguacggcauggagauucggccggucaaagaaaaggaggaaaaucuggucaagagcaugguuuccgccgggagcggagagguggacucuuuuucccugggccuccuguguaucagcauuaugaucgaagaggucaugagaucccgcuggucucggaaaaugcuuaugaccgggacacuggccguguucuuucuccugauuaugggacagguuaccuggaacgaucugaucagacuuugcauuauggugggcgcuaaugccagcgaccgcaugggcauggggaccacauaucuggcgcucauggcuacguucaagaugagaccuauguuugccgucggacugcuuuuccggcgccugaccuccagagaggugcuucugcucacaaucggccugucucugguggccagcgucgaacuucccaacucccuggaggaacucggggauggacuggcuaugggcaucaugauucucaaacugcuuaccgacuuucaaucucaccagcugugggccacacuccugagccugaccuucaucaagacgacauuuucccuucauuacgcuuggaaaaccauggccaugguucugagcauugugucucucuucccccugugucucuccaccacaagccagaagaccacauggcugccugugcuucuggggucucugggaugcaagccgcucacgauguuucugaucgcggagaauaaaauuuggggccggaaguccuggccccuuaacgaaggcaucauggccgucgggaucgugagcauucugcucucuucccugcucaaaaacgauguuccucuggcuggaccccuuaucgccggcgggaugcugauugcuuguuaugugaucagcggauccagcgccgaccugucucucgagaaggccgcugaggucagcugggaagaggaagcggagcacuccggcgccucucauaauauucugguggaaguucaggaugacgggaccaugaaaaucaaggaugaggagcgcgacgauacacuuaccauccugcucaaagcuacacugcucgccgugagcggagucuacccucuguccauucccgccacccuuuucgugugguauuucuggcaaaagaagaaacagagaucuggcguccugugggacacgccuagcccucccgaaguggagcgggcuguucuggaugacggcaucuaccgcauuaugcagagagggcuccugggacggucccaggugggcgucgggguguuucaagaaaacguuuuccacaccauguggcacgugacacgcggagccguccuuauguaucagggcaagagacuggagcccucuugggcgagcgugaaaaaggaccucaucuccuacgggggaggcuggcggcugcagggcagcuggaauaccggggaggaagugcagguuauugcugucgagcccggcaagaacccuaagaaugugcaaacagcccccggcaccuuuaagacaccggaaggggaggugggagccaucgcucucgauuucaaaccuggcacgucugggucccccauugucaacagagaaggaaagaucgugggccuguacggcaaugggguugugaccacaagcggaaccuaugucucugccaucgcgcaggcuaaagccucccaggagggcccucuucccgagauugaagacgagguguuucgcaagcggaaccugaccaucauggaucugcaucccgggagcggaaaaacaagacgcuaccucccugccauuguucgggaagcuaucaagagaaagcugcgcacgcuuauucuggccccgacccggguggucgcuuccgagauggccgaagcgcucaaaggcaugcccaucagauaucaaacaaccgccgugaagucugagcacacagggaaagagaucguugaccugaugugccaugcuaccuucacgaugcgccugcucagcccugugcggguccccaauuacaacaugauuaucauggaugaagcccacuuuacagacccuuccagcauugcugccagaggcuauaucucuacccgggugggaaugggcgaggccgcugcgauuuucaugaccgccacacccccuggguccguggaggcuuuuccgcagagcaaugccgccauccaggaugaggaacgcgacauccccgagagaucuuggaacagcggauacgaguggauuaccgauuucccuggcaagacagucugguuuguucccuccaucaaaucugggaaugacauugcuaacugucuucggaagaauggaaagcgcgugauccagcugagcagaaaaaccuucgauacggaauaucaaaagaccaagaacaacgacugggacuacguggucaccacagauauuuccgagaugggcgccaauuuccgggcggacagagugaucgauccucgccggugccugaagcccguuauucucaaagacgggccggaaagagugauccuggcuggcccuaugcccgucaccguggccucugccgcucagcgccggggaagaaucggccgcaaccauaauaaggagggggaucaguacauuuauaugggacagccccuuaacaaugacgaggaucacgcccacuggacggaagcgaagaugcugcucgacaacaucaauaccccugagggcauuauccccgcccuguuugaaccugagcgggagaaaagcgcugccauugauggggaguacagacugcgcggagaggcuagaaagacauucguugaacucaugcggcgcggcgaccuuccgguguggcuguccuauaaagucgccagcgagggguuucaauacucugauagacgguggugcuucgacggcgaacgcaacaaucaggugcuggaggaaaacauggaugucgagaucuggaccaaggagggagaacgcaaaaagcuccggcccagauggcuggacgcucgcacauauuccgacccucuugcccugcgggaguuuaaagaguucgcggccggcagacgcagcguguccggggaucucauccuggagauuggaaagcugccccagcaucucacccagcgggcucaaaaugcccuugacaaccugguuaugcugcacaauucugaacagggcgggagagcuuaccggcaugccauggaggagcucccugauacaaucgaaacccugaugcuucuggcccucauugcugugcugacgggaggcgugacacuguuuuuccucagcggccgcgggcuuggaaagaccuccaucggccugcugugugucauggcgucuagcguucuccuguggauggccuccguggagccccacuggauugcugccagcaucauccuugaauuuuuccugauggugcuccugauuccggagccugacagacagcggacaccccaggauaaccaacuggccuaugucgugaucgggcuccuuuuuaugauucugacaguugcugccaaugagaugggacugcucgaaaccaccaaaaaggaccugggcaucgggcacguggcggucgagaaccaucaccaugccgcuaugcuugauguggaccugcacccugccucugcuuggacgcucuacgccgucgcgaccacaauuaucacccccaugaugcgccauacaauugaaaacaccacggccaauaucucccugaccgcuaucgccaaccaggcugccauucugaugggacucgauaaaggcuggccuaucagcaagauggacauuggcgugccccuucuggcucuggggugcuacucucagguuaauccgcucacacugaccgccgcggugcuuaugcuggucgcccacuaugcuaucauuggaccuggccuccaagccaaagcuacaagagaggcccagaagcggaccgccgcggggaucaugaagaaccccacgguggauggaaucguugcuauugaccuggaucccguggucuacgacgccaaauucgaaaagcagcugggccagaucaugcuccuuauucuguguacaucccaaauccugcucaugcgcaccacaugggcucugugcgagagcauuacccuugccaccgggccucugacaacgcucugggagggaucuccgggcaaauuuuggaauaccacaaucgccgugagcauggcuaacaucuucagaggcuccuaucuggccggggcgggacuggccuucucucucaugaaaagccuuggcgggggacggcgcggcaccggggcucagggagaaacacugggcgagaaauggaagagacagcugaaucagcucuccaagagcgaauuuaacaccuacaaacgguccggcauuauggagguggacagaucugaagccaaggaggggcugaaacgcggagagacgacaaagcacgcuguuagccggggcaccgccaaacuuagaugguucgucgaacgcaaucuggugaagcccgaggggaaggugaucgaucucggauguggcagagggggaugguccuauuacugcgcgggccugaaaaaggucaccgaaguuaaaggcuauacaaaagggggaccuggccaugaggaacccauuccuauggccaccuacggguggaaccuggugaaacuccacucuggaaaggacguguuuuucauucccccugagaaaugugauacacuucugugcgacauuggcgagagcuccccgaaucccacgaucgaagaggggagaacccugcgcguccucaagaugguggaaccuuggcugcggggaaaccaauuuuguauuaagauccuuaaucccuacaugccuucuguuguggagacacuggagcagaugcagagaaaacauggcggcaugcucguccgcaacccccugagcagaaauuccacccacgaaauguauugggugagcugcgggacaggaaacaucguuucugcugugaauaugaccuccagaaugcugcucaaccgcuucacgauggcccaccggaagccgaccuacgagagagaugucgaccugggcgcugggacacgccauguggccguggaaccugaggucgcuaaccuugauauuaucggacagagaauugaaaauaucaaacacgagcauaagagcaccuggcacuaugacgaggauaaccccuacaaaacaugggccuaucauggcucuuacgaaguuaagcccuccgggagcgcgucuuccauggugaauggaguggucaagcugcucaccaaaccuugggacgugauucccaugguuacacaaaucgccaugaccgauacgacaccuuuuggccagcagcggguguucaaggagaaagucgacacccgcaccccgaaggcuaaaagaggcacagcccaaaucauggaagugacggcucgguggcuguggggguuucuuagcagaaacaagaagccccggauuuguacccgcgaggaguucacaagaaaaguucgguccaaugccgccaucggagcgguguuugucgacgagaaccaguggaauagcgcuaaggaggccguggaagaugagcgcuucugggaccugguucacagagaacgggagcuccacaaacagggcaagugcgccacaugcguguauaacaugauggggaaacgcgaaaagaagcugggagaguuuggcaaagcuaaggggucuagagccauuugguacauguggcugggcgcucgguuccucgaguucgaagcccugggauuuaugaaugaggaucauugguucagccgcgaaaacucccuuucuggcgucgagggggagggacugcacaaacucggcuacauccugagagacauuagcaagaucccugggggaaauauguaugcggaugacacagccggcugggauacccggaucacagaagacgaucuucagaacgaggcuaaaauuaccgacaucauggaacccgagcaugcccugcucgcuaaggccauuuuuaaacugacguaccaaaauaaggugguccgcgugcagagaccugcgaagaacgggaccguuauggaugugaucucccggcgcgaccagagaggcucuggacaggucggcacauaugggcugaauaccuucacaaacauggaagcccaacucauucggcagauggagagcgagggaaucuuuucccccucugaacuggagaccccgaaccuugcugaaagagugcuggauuggcucgagaaauacggcguggaacgccugaagcggauggccaucagcggggacgacuguguugugaaaccuauugaugacagauucgcuacggcccuuacagcucugaaugauaugggaaagguccgcaaagacaucccccagugggagccuuccaagggcuggaacgauuggcagcaagugcccuuuugcagccaccacuuccaucagcucauuaugaaggacgggcgggagaucguugugccuuguagaaaucaggaugaacuggucggccgcgcccgggugucucagggagcgggcuggucccugagagagaccgccugccucgggaaaagcuaugcucaaauguggcagcugauguacuuucaccgccgggaccuuagacuggccgccaacgcuauuuguucugccguccccguggauuggguuccgacaucccgcaccacguggagcauccaugcgcaccaucaguggaugaccacagaagacaugcucuccguguggaaucgggucuggauugaggaaaacccuuggauggaggauaagacccacaucucuagcugggaggacgugcccuaucugggaaaaagagaagaccaauggugcggcucccuuaucgggcugacagcucgggccaccugggccacaaauauucagguugcuaucaaccaggugagacgccucauuggaaaugagaacuaccuggauuacaugaccagcaugaagcgguucaaaaaugaaucugaccccgagggcgcccugugguga

SEQ ID NO: 19502 - RNA, 9879 nt, Artificial Sequence
  derived and/or modified CDS sequence (opt5) from DENV-1__AY835999__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuuccuuacccaagaugaaaagggggugacacagaacggacggcucaucacggcuaaucccaucgucaccgacaaagagaagccugugaacauugaagccgagccccccuuuggcgaguccuauaucgugauuggggccggagaaaaagcucugaagcugagcugguucaagaaaggcucuagcaucgggaagauguuugaggccacagcuagaggcgcccgccggauggcgauucucggagauaccgccugggacuucggcuccguugggggagucuuuacaucugugggcaaacuggugcaucagaucuucgggaccgcuuacggaguccuuuuuagcggcguguccuggacgaugaagcuggggaucggcguucuccugaccuggcugggacuuaauagcagaucuacaucccucagcaugaccuguauugccgugggccuggucacacuguaccucggggugaugguucaggcugauucuggaugcgugaucaacuggaaaggccgcgaacugaaguguggguccggaauuuucgucaccaaugaggugcacacauggaccgaacaauauaaguuucaggccgacagcccuaaacggcuuuccgcggccaucggcaaggcuugggaggaggggguuugcggcauuagaucugccacgcgccuggaaaacaucauguggaaacagauuagcaacgagcucaaucauauccugcuggaaaacgacaugaaguucacaguggucgugggagauguggcuggcauccuuguccaggggaaaaagaugauucggccgcaacccauggaguacaaauauuccuggaagucuuggggaaaggccaaaaucauuggcgccgacguucagaauagcaccuuuaucauugaugggccuaacacccccgaauguccugacgaucagagagcuuggaauaucugggagguggaggacuacggauucggcaucuuuacaaccaacauuuggcucaagcugcgcgauuccuauacgcaggugugcgaccaccggcugaugagcgcggccaucaaagauucuaaggcuguccacgccgacaugggcuacuggauugaauccgagaaaaaugaaacauggaagcucgccagagcuagcuucaucgaggugaagaccuguauuuggcccaaaucucauacacugugguccaacgggguucuugaaagcgagaugaucaucccgaagauuuauggaggcccuaucucucaacacaauuaccgccccggguacuucacccagacagccggaccuuggcaucugggcaaacucgagcuggauuuugaccugugcgaagggaccacgguggucguggaugagcacugcggaaaccggggccccagccuuagaaccacaaccguuacaggcaagauuauccacgaaugguguugccgguccuguacccucccuccccugcgcuucagaggggagaauggaugcugguauggcauggagauucggccggugaaagaaaaggaggaaaaccuggucaagagcauggugucugcgggguccggagagguugacagcuuuucccucggccugcuuuguaucucuaucaugauugaagaggugaugagaagccgcuggucccggaaaaugcugaugacggggauccucgcugucuucuuucugcugauuaugggacagcuuacauggaaugaccugaucagacucugcauuauggugggcgccaacgccucugaucgcaugggcauggggaccacauaccuggcucucauggccaccuucaagaugagaccuauguuugcggugggacugcuuuuccggcgccugaccagcagagagguccuccugcugacaaucggccuuucccugguugcuucuguggaacuccccaauagccuggaggaacucggggacggacuggccaugggcauuaugauccuuaaacugcucacggauuuucaaucccaucagcugugggccacccugcuuagccugacauucaucaagaccacauuuucucuccacuaugcuuggaaaaccauggccauggugcuguccauugucagccucuucccccugugucuuucuacgacaucccagaagaccaccuggcugccugugcugcucgggagccugggaugcaagccgcuuacaauguuucugaucgcugagaacaaaauuuggggccggaagucuuggccccucaacgaaggcaucauggccguugggauuguguccauccugcucagcucccugcuuaaaaaugacgucccucuggcgggaccccugaucgccggcgggaugcucauugcuuguuacgugaucagcggaucuagcgccgaucugucccuugagaaggcugccgagguuucuugggaagaggaagccgagcauagcggcgcuucccacaacauucugguggaaguccaggacgaugggaccaugaaaaucaaggacgaggagcgcgaugacacacucacgauucugcucaaagcgacccugcuugccgugucuggagucuauccucugagcauccccgcuacacuguucgugugguacuucuggcaaaagaagaaacagagauccggcguucucugggauaccccuucucccccggaaguggagcgggccguccuggacgauggcaucuaucgcauuaugcagagagggcuucugggacggagccaggugggcguugggguguuucaagaaaaugucuuccauacaauguggcacgugacccgcggagccgugcucauguaccagggcaagagacuggagccuuccugggcuagcguuaaaaaggaccucaucucuuacgggggaggcuggcggcugcagggcuccuggaacacgggggaggaaguccaggugauugccguggagcccggaaaaaauccuaagaacguccaaaccgcgcccggcacauuuaagaccccggaaggggaggugggagcuaucgcccuugacuucaaaccuggcacaagcgggucucccauuguuaauagagaaggaaagaucgugggccuguauggcaacggggucgugaccacauccggaacguacguuagcgccauugcucagaccaaagccucccaggagggcccucugcccgagaucgaagaugagguguuucgcaagcggaaucucacaaucauggaccugcaccccgggucuggaaaaaccagacgcuaucuuccugcgauuguccgggaagcuaucaagagaaagcugcgcacccucauucuggccccgacacgggugguugccagcgagauggcugaagcccugaaaggcaugcccaucagauaccaaacgaccgcugugaaguccgagcauacagggaaagagauugucgaucucaugugccacgccaccuucacaaugcgccuucugagcccugugcgggugcccaacuauaauaugaucaucauggacgaagcgcauuuuaccgauccuucuuccauugccgcuagaggcuacaucagcacgcgggucggaaugggcgaggccgcugccauuuucaugacagccacccccccugggucuauggaagcuuuuccgcagagcaacgcgguuauccaggacgaggaacgcgauauucccgagagauccuggaauucuggauaugaguggaucaccgacuucccuggcaagacagugugguuugugcccagcaucaaagccgggaacgauauugcuaauugucugcggaagaacggaaagcgcgucauccagcucuccagaaaaaccuucgacacagaauaccaaaagaccaaaaacaaugauugggacuacgugguuacgacagacauuucugagaugggcgccaacuuccgggccgauagagugaucgacccucgccggugccugaagcccgucauucuuaaagaugggccggaaagagugauccuggcuggcccuaugcccguuaccguggccagcgcggcucagcgccggggaagaauuggccgcaaucacaacaaggagggggaccaguauaucuacaugggacagccccucaauaacgaugaggaccaugcccacuggacagaagccaagaugcugcuggauaauaucaacaccccugagggcauuauccccgcucucuuugaaccugagcgggaaaaauccgccgcgauugacggggaguauagacuucgcggagaggccagaaagacguucgucgaacugaugcggcgcggcgaucugccgguguggcucagcuacaaagucgcuucugagggguuucaauauuccgacagacgguggugcuucgauggcgaacgcaauaaccaggugcuggaggaaaauauggacguugagaucuggaccaaggagggagaaagaaaaaagcuucggcccagauggcuggaugcccgcacauacagcgacccucucgcucugcgggaguuuaaagaauucgccgcuggcagacgcuccgugucuggggaccugauucucgagaucggaaagcuuccccagcaccugacccagcgggcccaaaacgcgcuggauaaucucgugaugcugcauaacagcgaacagggcgggagagccuaucggcacgcuauggaggagcuuccugacacaaucgaaacccugaugcuccuggcccugauugcuguccucacaggaggcguuacccuuuuuuuccuguccggcaaggggcugggaaaaacgucuaucggccuccugugugugauggccagcuccgugcuucuguggauggccagcgucgagccccauuggauugcugcgucuaucauucucgaauuuuuccugauggugcugcucaucccggagccugaucgccagagaacaccccaggacaaucaacuugccuacguugugaucgggcugcuguuuaugauucucaccgucgcugccaacgagaugggacugcuugaaaccacaaagaaagaucugggcaucgggcacguggccgucgagaaccaccaucacgcugccaugcucgacguggaucugcauccugcguccgccuggacccuguacgcuguugccacaacgauuaucacccccaugaugcggcacacaauugaaaauaccacagcuaacaucagccucaccgccauugcgaaucaggccgcuauccuuaugggacuggacaagggcuggccuaucucuaaaauggauauuggcgugccccugcucgcccuggggugcuauucccaggucaacccgcuuacgcugaccgcugcccuccugaugcugguggcucauuacgccaucauuggaccuggccuccaagcgaaggccacacgcgaggcucagaagagaaccgccgcugggaucaugaaaaaucccacaauugacggaaucguugccaucgaucuugaccccguggucuaugaugccaaguucgaaaaacagcugggccagauuaugcugcucauccuguguaccagccaaauucuucugaugcggacgacaugggcgcucugcgagucuaucacccuggcuacagggccucugaccacccucugggagggaagcccgggcaaguuuuggaacacaacgauugccguguccauggcuaauaucuuccgcggcucuuaccuugccggggccggacuggcuuucagccugaugaaaucccucggcgggggaagacggggcaccggggcccagggagaaacacugggcgagaaguggaagcgccagcuuaaccagcugagcaaauccgaauuuaauaccuauaagagaucuggcaucauggagguggaccggagcgaagcgaaagaggggcucaagagaggagagacaaccaaacacgccguuucccgcggcacggcuaagcugcggugguucgucgaaagaaaccuggugaagcccgaggggaaagugauugaccucggauguggccgcgggggauggucuuacuauugcgccggccuuaagaaagucacagaaguuaagggcuacaccaaagggggaccuggccacgaggaacccaucccuauggcuaccuacggguggaaucuggugaagcugcauagcggaaaagauguguuuuucauucccccugagaagugugacacacuccugugcgauaucggcgaguccucuccgaaccccaccauugaagaggggcggacacuuagaguccugaagaugguggaaccuuggcuccgcggaaaucaauuuuguaucaaaauucugaaccccuauaugccuagcguuguggagacgcuggagcagaugcagcggaagcacggcggcaugcucgucagaaauccccugucccgcaacagcacccaugaaauguacugggugucuugcgggacaggaaauaucguuuccgccgugaacaugaccagccggaugcuucugaacagauucacaauggcgcaccgcaaaccgaccuaugagcgggacgucgaucucggcgccgggacgagacacguggcuguggaaccugaggucgccaaucuggacaucauuggacagcgcaucgaaaacauuaagcaugagcacaaaucuaccuggcauuacgaugaggacaaucccuauaagacaugggcuuaccacggcuccuaugaaguuaagcccagcgggucugccuccagcauggugaacggaguggucaaacuucugaccaagccuugggaugugauccccaugguuacacaaauugcuaugaccgacacaaccccuuuuggccagcagagaguguucaaagagaaggucgauacgcggacaccgaaagccaagcgcggcaccgcgcaaaucauggaagugaccgccagauggcucuggggguuucugucccggaauaagaaacccagaaucuguacacgggaggaauucacgcgcaagguuagaagcaacgcugccauuggagcuguguuugucgacgagaaucaguggaacucugccaaagaggccguggaagacgaucgguucugggaccugguucaucgcgagagagaacuccacaagcagggcaaaugcgcgaccugcguguacaauaugauggggaagcgggagaagaaacugggagaauuuggcaaggcuaaagggagccgcgccaucugguacauguggcuuggcgccagauuccuggaguucgaggcucucggauuuaugaacgaagaucacugguucucccgggagaauucucugagcggcgucgaaggggagggacuucauaagcugggcuauauucuccgcgacaucuccaaaauuccugggggaaacauguacgccgaugacacagcuggcugggauaccagaaucacagaggacgaucugcagaaugaagccaagaucaccgacauuauggagcccgaacacgcgcaacuggccaaaucuaucuuuaagcucacauaucagaacaaggugguccgggugcagcgcccugcuaaaaaugggaccguuauggaugugauuagcagacgggaccagcgcggcuccggacaagucggcacguacgggcugaacaccuucacaaacauggaggcccagcuuaucagacagauggaaucugagggaauuuuuagccccaaugagcuggaaaccccgaaccucgcugagcgggugcuggauuggcuugaaaaguauggcguggagagacugaaacgcauggccaucuccggggacgacuguguugugaagccuaucgaugaccgguucgcgacagcccucaccgcucugaaugauaugggaaaagucagaaaggacauuccccagugggaaccuagcaagggcuggaacgauuggcaacaggugcccuuuugcucucaucacuuccaccagcugaucaugaaagacgggcgcgagauuguugugccuugucggaaucaggaugagcucgucggcagagcccgcgugucccaaggagcuggcuggagccugcgggaaacggccugccuugggaagucuuacgcucagauguggcagcugauguauuuucauagacgcgaccuccggcuggccgcgaacgccaucuguuccgcuguccccguggauuggguuccgacaagcagaaccacaugguccauucacgcccaucaccaauggaugaccacggaggacaugcuuucuguguggaaucgcgucuggaucgaagagaacccuuggauggaagauaaaacccggauuagcuccugggaggacgugcccuaccugggaaagagagaggaccaguggugcggcagccucaucgggcugacagcccgggcuaccugggccacaaauauccagguugcgauuaaccaggugagacgccugaucggaaaugaaaacuacucugauuauaugaccuccaugaaacgguucaagaaugagagcgaacccgagggcgcucucugguga

SEQ ID NO: 19503 - RNA, 9879 nt, Artificial Sequence
  derived and/or modified CDS sequence (opt5) from DENV-1__KP686070__SS-prME
agcgugaccaugcugcucaugcugcuucccacagcccuggcuuuccaccucacgacccggggcggggagccucauaugauugucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagcugcgcccccgguggcucgaugcgagaacguauuccgacccucuggcccuucgcgaguuuaaagaguucgcugccgggcggagaagcguguccggagaucugauccucgagauuggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucaucgccguccugacaggcggcguuacccuguuuuuccucagcgggaagggacuuggcaagacauccauugggcugcugugugugauggcuucuagcgugcuccuguggauggccuccgucgagccccacuggaucgcugccagcauuauccuugaauuuuuccugauggugcuccugauuccggagccugacagacagcggacgccccaggauaaccaacuggccuauguugugaucggacuccuuuuuaugauccugaccgucgcugcgaacgaaaugggccugcucgagacaaccaaaaaggaccuggggauuggacauguggucgccgagaaucaccaccaugcuacaaugcuugauaucgaccugcacccugccucugccuggacccucuacgcuguggccacgaccauuaucacacccaugaugcgccauaccauugaaaacacaaccgcgaauaucucccugacggccauugcuaaccaggccgcuauccugaugggccucgauaaaggcuggccuaucagcaagauggacauugggguuccccuucuggcccugggaugcuacucucaggugaauccgcucacacugaccgcggccgucuccaugcuuguggcucacuaugccaucauuggcccugggcugcaagcuaaagccacaagagaggcucagaagcggaccgccgcgggaaucaugaagaaccccaccguugauggcauuguggccaucgaccucgaccccgucguguacgaugcuaaauucgaaaagcagcuggggcagaucaugcugcucauucuuuguacaagccaaauccugcugaugcgcacgaccugggcccucugcgagucuauuacacuggcuaccggaccucuuacaacccugugggaaggcagcccgggcaaauuuuggaauacgacaaucgccguguccauggccaacauuuucagagggucuuaucucgcgggagcuggccuggccuucagccugaugaagucccucgggggaggccggcgcgggaccggagcucagggcgagacccuuggcgagaaauggaagagacagcugaaucagcugagcaaguccgaauuuaacacauacaaacggucugggaucauggagguugacagaagcgaagccaaggagggacucaaacgcggcgaaaccacaaagcaugccgucucccgggggacggcuaaacugagaugguucguggagcgcaaucuugugaagcccgagggaaaggucaucgaucugggcugugggcggggaggcuggucuuauuacugcgccggccucaaaaagguuaccgaagugaaaggguauacaaagggaggcccugggcacgaggaacccauuccuauggcgaccuacggauggaacaucgugaaacugcacagcggcagagacgucuuuuucacacccccugagaagugugauacccugcucugcgacauuggggaauccucuccgaaucccacgaucgaggagggacgcacccuucgggugcugaaaaugguugaaccuuggcugagaggcaaccaauuuuguauuaagauccucaaucccuacaugccuagcguggucgagacacuggaacagaugcagcgcaagcauggcgggaugcuugugcggaacccccuguccagaaauagcacccacgagauguauuggguuucuugcggaacaggcaacauuguguccgccgucaacaugaccagccgcaugcuccugaaucgguucacaauggcucauagaaaaccgaccuacgagcgcgauguggaccugggggccggaacgagacacguggcugucgaaccugagaucgccaaccucgauaucauuggccagcggaucgaaaauauuaagaacgagcacaaaucuacauggcauuaugacgaagauaaucccuacaagaccugggcguaucacggguccuacgagguuaaacccagcggaucugccuccagcauggugaacggcgugguccgccugcuuaccaagccuugggacgugauccccaugguuacacaaauugcuaugacggacaccacaccuuuuggccagcagagaguguucaaggagaaagucgauacccggacaccgagacccaagcgggggaccgcccaaaucauggaagugacagcuaaauggcuguggggauuucucucccgcaauaagaaaccuagaaucuguacccgggaggaguucacgcgcaagguuagaagcaacgccgcuauuggcgccguguuugucgacgagaaucaguggaacucugcgaaggaagccguggaggaugagcgguucugggaccugguucaucgcgaaagagagcuucacaaacaggggaagugcgcuaccugcguguauaauaugaugggaaaacgggaaaagaaacugggcgaguuugggaaggccaagggcagccgcgcuaucugguacauguggcucggagccagauuccuggaguucgaggcccugggcuuuaugaacgaggaucauugguucucccgggaaaauucucucagcggggucgagggagaaggccugcacaaacuuggguacauucugcgcgacaucuccaagauucccggaggcaacauguaugcggaugacacagcugggugggauaccagaaucacagaggacgaucuccagaaugaggccaaaaucaccgacauuauggaaccugagcacgcccugcuugcuacgucuaucuuuaagcugacauaccaaaacaaagugguccgggugcagcgccccgccaagagcggcaccguuauggaugugauuuccagacgggaccagagaggaucuggccaggucgggacauauggacucaacaccuucacgaauauggaagugcaacugauccgccagauggagagcgaaggcaucuuuuccccgagcgagcuggagaacucuaaucucgcugaacgggugcuggacuggcuugagaaacaugggguugaaagacugaagcgcauggccaucuccggagaugacuguguggucaagccuaccgaugaccgguucgcgacagcccucaccgcucugaacgauaugggcaaagugagaaaggacaucccccagugggagccuagcaaaggguggaaugauuggcagcaaguucccuuuugcucucaccauuuccaccagcuuauuaugaaggacggccgcgaaaucguggucccuugucggaaccaggaugagcuggugggacgggcccgcgucucccagggcgcuggguggagccuccgggagacagccugccugggaaaauccuacgcgcaaauguggcagcugauguauuuucacagacgcgaccuccggcuggccgcuaaugccauuuguucugcugugcccguuaacugggugccgaccagcagaacaaccugguccauccaugcccaccaucaguggaugacgacagaagauaugcuuagcgucuggaaucggguguggauugaggaaaacccuuggauggaggacaagacccacguuucuuccugggaagacgugcccuaccugggcaagagagaggaucaauggugcgggagccucaucggacugaccgcucgcgccacaugggcgaccaauauucaggucgccaucaaccaggugcggagacuuaucggcaaugagaacuaucuggacuacaugacaucuaugaaacgcuucaagaaugaaagcgaucccgagggggcucucugguga

SEQ ID NO: 19504 - RNA, 9876 nt, Artificial Sequence
  derived and/or modified CDS sequence (opt5) from DENV-1__KF672760__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuuuggcgggccuaucagccaacauaauuaccggcccggauauuucacccagacggccggcccuuggcaccucgggaagcuggaacuugauuuugaccugugcgagggaaccacagugguuguggaugaacacugcggcaacagaggccccucucuccggaccacaaccgucacggggaaaauuauccaugagugguguugccgcagcuguacacugccuccccugagauuccggggagaggacggcugcugguacgggauggaaauuagaccggugaaggagaaagaagagaaucuuguucgcuccauggugagcgcgggaucuggcgaagucgauuccuuuagccucgggauccuguguguguccaugaugaucgaggagguuaugcggucuagauggagccgcaagaugcugaugaccggaacacucgcuguguuccugcuucugauuaugggccagcucaccuggaacgaccugaucagacugugcauuauggucggcgccaaugccuccgaccggauggggaugggaaccacauaccuugcucugauggccacguuuaagaugcgcccuauguucgcggugggccuccuguuuagacggcucaccucucgcgaagugcugcuucugacaaucgggcucagccuggucgcuuguguugagcugcccaacucccuugaagagcugggagauggccucgccauggggauuaugaugcugaaacuccugaccgaauuccaaccccaccagcuuuggacaacccugcucucucugacguuugugaagacaacccugagccuugacuaugccuggaaaaccacagcuauggugcuguccaucgucagccucuucccucugugccucucuaccacaucccagaagacgaccuggcugccggugcuucugggaagcuuuggcuguaaaccccugacaauguuccucauuaccgagaacaagaucuggggcagaaagucuuggccucugaaugaggggaucauggccauuggaaucguuuccauucuucugagcucucuccugaaaaacgaugugccccucgcuggcccucugaucgccgggggaaugcuuauugcgugcuacgucaucuccggcagcuccgccgaccugagccuggaaaaggcugccgaggugucuugggaacaggaggcugaacauagcggggccucccacaauauccucguugaggugcaagaugacggaacaaugaaaauuaaggaugaggaacgggacgauacccugacgauccuucugaaagccacccuccuggcugucucuggcguguaucccaugagcauuccugcgacacucuucgucugguacuuuuggcagaagaaaaagcagcgcuccggcgugcugugggacacccccucuccgccugagguugaaagagccgugcuugaugacgggaucuaucggauucugcagcgcggacugcucggcagaagccaagucggggugggaguuuuccaggauggcguguuucauacaauguggcacgucacccggggggcugugcugauguaccagggaaagagacuugagcccuccugggccucugugaaaaaggaccugaucagcuauggcggcggguggcgcuuccagggauccuggaacacaggcgaggaaguucaagucaucgccguggagccugggaaaaaucccaagaacgugcagacgaccccgggaacauuuaaaaccccugaaggcgaggucggggcuauugcccucgacuucaagcccggaaccagcggcucuccuaucgugaaucgggaaggcaagauuguugggcuguacggaaacggcguggucacaacguccgggaccuacgugagcgcgaucgcucaggccaaagccucucaagagggaccccuccccgagauugaagaugagguuuuuaagaaaagaaaucugacaaucauggaccuucacccuggcuccgggaagacccgccgguaucugccggcuauugugagagaagccaucaaacgcaagcugcggacacucauccuggcgcccaccagagucguggcuagcgagauggccgaagcccuuaagggcaugccuauucgcuaccagacgacagcuguuaaauccgagcauaccggacgggagaucguggaucugaugugucacgccaccuucacaaugagacuccugucucccguccgggugccuaacuauaauaugauuaucauggacgaagcucauuuuaccgaucccgccagcauugcggcccgcggcuacaucuccacaagaguggggaugggagaggcugccgcuaucuucaugaccgccacgccuccgggcagcgucgaagccuuuccccagucuaacgcuguuauucaggacgaggaacgggauaucccugagcgcuccuggaauagcggguaugacuggauuacagauuuccccggaaagaccgugugguucgugccuucuaucaaaagcggcaacgacauugcgaauugccugagaaagaacgggaaacgggucauccaacucuccagaaagacauuugauaccgaguaccagaagacgaaaaacaaugacugggacuaugugguuaccacagauaucucugaaaugggcgccaacuuccgcgcugaccgggugauugaucccagacgcugccuuaagccggucauccugaaagacggaccugagcgggugauucuggccggccccaugcccguuaccguggccagcgcugcccagagacgcgggcggaucggaagaaaucagaacaaggaaggcgaucaauacgucuacauggggcagccucucaauaacgacgaggaucacgcgcauuggacagaggcuaaaaugcugcuugacaauauuaacacccccgaaggaaucauuccugcccuguuugagccggaacgcgagaaguccgccgcuaucgauggcgaauauagacuccggggggaggcccgcaagacauucguggagcugaugagacggggcgaccugcccgucuggcucucuuacaaaguggcgagcgaaggauuucaguauuccgaucgcagaugguguuucgacggcgagcggaauaaccagguucuugaagagaauauggauguggaaaucuggaccaaggagggggagagaaaaaagcugcgcccucgguggcuggacgccagaacguacagcgacccccucgcucugcgcgaauuuaaagaguucgccgcuggacggagaucuguguccggcgaucuuauucuggaaaucgggaagcucccucaacaccugacacugcgggcccagaacgcucucgacaaucuugucaugcugcacaacagcgagcagggaggcaaagccuaucgccaugcgauggaagagcugcccgauaccauugagacccucaugcugcuugcccugaucgcuguucucacaggcggggugacccuguuuuuccuguccggaaagggccucgggaagacaucuauuggacuucugugcgugacggccagcuccgcucugcucuggauggccucugucgaaccgcacuggaucgccgcuagcaucauucuggaguuuuuccuuauggugcugcucaucccugaacccgacagacagcggaccccucaagauaaucagcuggcguacguugugauuggccugcucuuuaugauccuuacagucgccgcuaacgagauggggcugcuggagaccacaaaaaaggaccucggaauuggcuauguggccgccgaaaaccaucagcacgcuaccaugcuggaugucgaccuucaccccgccuccgcguggacgcuguacgccguggcuaccacaguuaucaccccuaugaugcgccauacaaucgagaauaccacggccaacauuagccucacagcuaucgccaaucaagcggccauucugaugggccuggauaaaggguggcccaucucuaagauggacauuggagugccgcuccuugcucugggcuguuacucccaggucaacccucugacccucacagccgcugugcugaugcuuguugcccacuaugcuaucauugggcccggacugcaggccaaagcgaccagagaagcccagaagcggaccgcugccggcaucaugaagaaucccacaguggaugggaucgucgcuauugaccucgauccugugguguacgacgccaaauucgagaagcaacugggacagaucaugcugcucauucuuugcacgagccagauccugcugaugcgcaccacaugggcccucugugaaucuauuacccuggcgacaggcccgcuuaccacgcugugggagggcucccccgggaaauucuggaacacaaccaucgcuguuagcauggccaauaucuuuagaggaucuuaucucgcuggcgccgggcuggccuucagccugaugaagucccucggaggcgggcggcgcggaaccggcgcucagggcgagacacuuggggaaaaauggaagagacaacugaaccagcugucuaagagcgaguuuaauaccuacaaacgguccggaauuauggaagucgacagaagcgaggccaaggaaggccucaaacgcggggagacaacgaagcaugcggugucccggggaaccgccaaacugagaugguucguggagcgcaaccuugucaagccugaaggcaagguuaucgaucuggggugcggacggggcggcuggucuuauuacugugcugggcucaaaaaggugacagaggugaaaggauauaccaagggcgggcccggacacgaagagccuauucccauggccacauacggcuggaaucuggucaaacugcauagcgggaaggacguguuuuucaugccuccggaaaaaugcgauacccuccuuugugacaucggagaguccucucccaacccuacgauugaggaaggcagaacccugcgcguucugaagaugguggagcccuggcuccggggcaaucaguuuugcaucaagauccugaacccuuacaugcccagcgucguggaaacacuugagagaaugcagcgcaaacacgggggaaugcugguucggaauccgcucuccagaaacucuacccacgagauguauugggugagcuguggcacagggaauauugucuccgcugugaacaugaccagccgcaugcugcugaaccgguucacaauggcccauagaaagccuaccuacgaacgcgauguggaccucggagcgggcacgagacacgucgccguugagcccgaaguggcuaaucuggauaucauugggcaacggaucgagaacauuaaaaaugaacauaagucuacauggcacuaugacgaggauaaccccuacaaaaccugggccuaucacggauccuacgaggugaagccuagcggcucugcuuccagcauggucaauggcgugguucgccuucugaccaagcccugggacgugaucccuauggucacacagauugccaugacggauaccacaccguuugggcagcaaagaguguucaaagaaaagguugacacccggacacccagagcuaaacggggaaccacacagaucauggaggugaccgccaaguggcucuggggcuuucugucucgcaacaaaaagccuagaaucugcacgcgggaagaguucacccgcaaggucagauccaaugcggccauuggggcuguguuuguugacgaaaaccaguggaauagcgccaaagaggcuguggaggaugaacgguucugggaccuuguccaucgcgagagagaacugcacaagcagggaaaaugcgccacauguguguauaacaugaugggcaagcgggagaaaaagcucggggaauucggcaaggccaaaggaucccgcgcgaucugguacauguggcugggcgcuagauuucuggaguucgaggcccucggguuuaugaaugaagaucauugguucagccgggagaacucucugagcggagucgaaggcgaggggcuucacaagcugggauacauucuccgcgacaucuccaaaauucccggcgggaauauguaugccgaugacaccgcuggcugggauacaagaaucaccgaggacgaucugcaaaacgaagccaagaucacggacauuauggagccugaacaugcucuucuggccacaucuaucuuuaaacucaccuaccagaauaaggugguucgggugcagcgccccgcgaaaaacggaacagucauggaugugauuagcagacgggaccagagaggcuccgggcaagugggaaccuauggccugaacacguucaccaauauggagguucagcugauccgccagauggaaucugaggggauuuuucucccgagcgagcuggaaacaccuaaccuugccgagcgggcucuggauuggcucgaaaagcacggagccgagagacugaagcgcauggcuaucuccggcgacgacugcguggucaaacccaucgaugaccgguucgccaccgcgcuuacagcccugaaugauauggggaaggugagaaaagacauuccucagugggaacccucuaagggcuggaacgauuggcaacagguuccuuuuuguagccaccauuuccaccagcucaucaugaaagacggacgcgagauugugguccccugccggaaucaggaugagcuggugggcagagcucgcgucucccaaggggccggauggagccugcgggaaaccgcuugucucggcaagucuuacgcccagauguggcagcugauguauuuucauagacgcgaccuucggcuggcugccaacgcgaucugcuccgccgugccgguugauugggugccugcuagcagaacaaccuggucuauucacgcccaccaucaauggaugacgacagaggacaugcucuccgucuggaaucggguguggaucgaagagaaccccuggauggaagauaagacccacguuagcuccugggaggaggugcccuaccuggggaaaagagaagaccagugguguggaucucuuaucggccugaccgcccgcgcuacaugggccaccaauauucaggucgcgaucaaccaggugcggagacucauugggaaugagaacuaucuggacuacaugacaagcaugaagcgcuucaaaaaugaauccgauccugagggcgcucugugg

SEQ ID NO: 19505 - RNA, 9876 nt, Artificial Sequence
  derived and/or modified CDS sequence (opt5) from DENV-1__KF672759__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucucacacacagaugugcgaccaccgccugaugagcgccgcuauuaaggauuccaaagcgguucaugccgacaugggcuauuggaucgaaagcgagaagaaugaaaccuggaagcucgcucgggccucuuucaucgaggugaaaacauguauuuggcccaagucccacacccuguggagcaacggggugcuugaaucugagauggucaucccgaaaauuuacggaggcccuaucucccaacauaauuauagacccggguacuucacacagaccgccggaccuuggcaccugggcaagcucgagcuggauuuugaccugugcgaagggacgaccgugguuguggaugagcacugcggauaccgcggccccagccuucggacaaccacagucaccggcaaaauuauccaugaaugguguugcagaucuuguacgcucccuccccugcgguuccgcggggaggacggaugcugguauggcauggagaucagaccggugaaggaaaaggaggaaaaccugguucggagcaugguguccgcugggagcggagaggucgacucuuuuucccucggcauucugugugugagcauccuuauugaagagguuaugagaucccgcuggucucggaaaaugcugaugacagggacccucgccguguuccugcugcuuaucaugggacagcugacauggaaugaucucauuagacugugcaucauggucggcgcgaacgcuagcgaccgcaugggcauggggaccaccuaccucgcccugauggccacauuuaagaugagaccuauguucgcugugggacuucuguuucggcgccucacguguagagaggugcugcugcuuaccgucggccugucccucguugccucuguggaacugcccaauagccucgaggaacugggggauggacuugcgaugggcauuaugaugcugaaacuccugacagacuuccaaccccaccagcuguggaccacacuucugucccucaccuuuauccggacgucucugagccucgauuaugcuuggaagacaauggccauggcccuguccaucgugagccuuuucccucugugccugucuaccaccucccagaaaacaaccuggcucccgguccugcuugggagcuuuggauguaagccccugacaauguuccucauuacggagaacaagaucuggggccgcaaaucuuggccuauuaacgaaggcaucauggcuguggggauuguuuccauccugcucagcucucugcuuaagaaugacgugccccuggccggaccucugaucgcuggcgggaugcucauugccugcuacgucaucuccggaagcuccgcggaucugagccuugagaaagccgcugaggugucuugggaagaggaagccgagcauagcggcaccucccacaacauucugguugaagugcaggacgaugggacaaugaagaucaaagacgaggagagagaugacacccucacaauucugcucaaggcuacccugcuugccgucucuggaguguaucccaugagcaucccugccacgcuguuugucugguacuucuggcaaaaaaagaagcagcgguccggcgugcugugggauacccccucuccgccuaaaguugaacgcgcugugcucgacgacggcaucuauagaauucugcagcgggggcuucugggacgcagccaggucggcguggggguuuuccaagauggaguguuucauacaauguggcacgucaccagaggcgcggugcucauguaccaggggaagcggcuggagcccuccugggccucugugaaaaaggaccucaucagcuacggaggcggcuggagauuccagggguccuggaauacaggagaagagguucaggucauugcuguggagccuggcaaaaaccccaagaaugugcaaaccacaccggggacguuuaagaccccugaaggagaggucggcgccaucgcccuggauuucaaacccgggacaagcggaucuccuauugugaaccgcgaaggcaagaucguuggccuuuaugggaauggaguggucaccaccuccggcacauacgugagcgcuauugcccaggcgaaagcuacgcaggaggggccccugcccgaaaucgaggacgagguuuuuaagaaacggaaccugaccaucauggaucuccacccuggaucuggcaagacaagacgcuaucugccggccauugugcgggaagccaucaagagaaaacuucgcacccugauucucgcucccacacgggucguggccuccgagauggcggaagcucugaaggggaugccuaucagauaccaaaccacggccguuaaaagcgagcauacaggccgcgaaauuguggaccugaugugucacgccaccuucaccaugcggcuccuuucccccgucagagugccuaauuauaacaugaucaucauggaugaggcucauuuuacagaccccgccucuauugcugcccggggauacaucagcacccgcgugggcaugggggaggcggccgcuauuuucaugacagccaccccuccgggauccgucgaagcuuuuccccagagcaaugccguuauccaggaugaggaaagagacauuccugagcggucuuggaacuccggcuaugauuggaucacggacuuccccgggaagacagugugguuugugccuagcaucaaaucuggaaaugacauugccaacugccugcgcaagaauggcaagagagucauccagcugagccggaaaaccuucgauacagaauaccaaaagaccaaaaacaacgacugggauuacgugguuacgaccgacauuuccgagaugggggcuaauuucagagcggaucgcgugaucgacccccggagaugccucaagccggucauucugaaagagggcccugaacgcgugauccuugccggacccaugcccguuacaguggcuucugccgcccagcggagaggccgcauugggcggaaccagaauaaggagggagaucaguauaucuacaugggccaaccucugaacaaugacgaagaucacgcucauuggaccgaggccaagaugcuccuggacaacaucaauacacccgaggggauuaucccugcgcuguuugaaccggagagagaaaaaagcgcugccauugauggagaguaucgccucagaggcgaagcccggaagaccuucgucgagcuuaugcgcagaggggaccugcccguguggcuguccuacaaagucgcuucugagggcuuucaguauagcgaucggcgcugguguuucgacggagaaagaaacaaucaggugcucgaggaaaacauggacguugagaucuggacaaaggaaggcgagcggaaaaagcugagaccucgcuggcuugaugcccggaccuacuccgacccccuggcgcucagagaguuuaaagaauucgccgcugggcgccggagcgugucuggagaucugauucuggagaucggcaagcucccucagcaccuuacgcugagagcccaaaaugcucuggacaaccucgugaugcugcacaauuccgaacaggggggaaaggccuaucggcaugcuauggaggaacuucccgauacaaucgagacccugaugcuccuggcccugauugcgguccucaccggcggcguuacacuuuuuuuccugagcgggaaaggacugggcaagaccuccaucgggcuccugugcgugauggccucuagcgcucuucuguggauggccuccguggagccgcacuggauugcugccucuaucauucucgaauuuuuccugaugguccugcucaucccugagcccgaccgccagagaacaccucaggauaaccaacuugccuacgugguuaucggacugcuguuuaugauucucacgguggcugcgaaugaaaugggccugcuugagaccacaaaaaaggaccuggggaucggacaugucgccguggagaaccaccaccaugcuaccaugcucgaugucgaccugcggcccgccagcgccuggacacuguacgcuguggccaccacgguuauuaccccuaugaugcgccacacaaucgaaaacaccacagcgaauauuucccucaccgccaucgcuaaccaggccgcuauucuuaugggccuggauaaaggcuggcccaucagcaagauggacaucggggugccgcugcucgcccugggauguuauucucaggucaauccucuuacgcugacagcggccgugcucaugcugguugcucauuacgccauuaucggccccgggcugcaagcuaaggccaccagagaggcucagaaacggacagccgcgggaauuaugaagaaccccaccguggauggcaucgucaccauugaccucgacccugugguguaugaugccaaauucgaaaagcagcuugggcagaucaugcugcugauccucugcacaucccaaauucugcuuaugcgcacgaccugggcucugugugagagcaucacacucgccaccggaccgcugacaacccugugggaaggcucucccggcaaauuuuggaauacgacaauugcuguuuccauggccaacaucuucagagggagcuaccucgccggagcgggccuugcuuucucucugaugaagagccuggggggaggccggcgcgggaccggagcccagggcgagacccucggcgagaaguggaaaagacagcugaaucagcuuuccaagucugaauuuaacacauauaaaaagagcgggauuauggaggucgaccgguccgaagcuaaagagggacugaagagaggcgaaaccacaaagcacgccgugagccgcgggacggccaaacuccggugguucguggagagaaaucuggucaagccugagggaaaaguuaucgaucugggcugcgggcgcggaggcugguccuacuauugugcuggccucaagaaagugaccgaagugaagggguacacaaaaggaggccccgggcaugaggaaccuauccccauggccaccuacggauggaaccuugucaagcugcacucuggcaaggacguguuuuucacaccuccggagaaaugcgauacccugcucugugacauuggggaaagcucccccaauccuacgaucgaggagggacggacccugagaguucuuaagaugguggaacccuggcugcgcggcaaccaauuuugcauuaaaauccucaauccuuauaugcccucugucguggagacacuggaacagaugcagcggaagcacggcgggaugcugguuagaaacccgcucagccgcaauuccacccaugagauguacugggugucuuguggaacaggcaacauugucagcgcggugaauaugaccucccggaugcugcuuaacagauucacaauggcccaccgcaaaccuaccuaugagcgggauguggaccugggggcuggaacgagacaugucgccguugaacccgagguggcuaaccucgauaucauuggccagcgcaucgaaaauaucaagaacgagcacaagagcacauggcacuacgacgaagauaaucccuauaaaaccugggccuaccaugggucuuaugaggugaagccuuccggaagcgcgucuuccauggucaacggcgugguuagacugcuuaccaaacccugggacgugauuccuauggucacacaaaucgccaugacggacaccacaccguuuggccagcagcggguguucaaggagaaaguugauacccgcacacccagagcuaagcgggggaccgcccaaauuauggaagugacagcuaaguggcuguggggauuucucagcagaaauaaaaagccucggaucugcacccgcgaggaauucacgagaaaaguccggucuaacgccgcuauuggcgccguguuuguugacgagaaucaguggaacuccgcgaaggaagccguggaggaugagcgcuucugggaccugguccacagagaacgggagcugcauaaacaggggaagugcgcuaccuguguguacaauaugaugggaaagcgcgaaaaaaagcucggcgaguuugggaaagccaagggcagcagagcuaucugguacauguggcugggagcccgguuccuugaauucgaggcccugggcuuuaugaacgaggaucacugguucucccgcgaaaauagccucucuggggucgagggagaaggccugcauaaacuuggguauauccugagagacauuagcaagauccccggaggcaacauguacgcggaugacacagcugggugggauacccggauuacagaggacgaucuccagaaugaggccaaaaucaccgacauuauggaaccugagcacgcccugcuggcuacguccaucuuuaagcucacauaucaaaacaaggugguucgcgugcagagacccgccaaaucuggcaccgucauggaugugaucagccggcgcgaccagagaggauccggccagguggggacauacggacugaauaccuucacgaacauggaaguucaacuuauucggcagauggagucugaaggcaucuuuagcccguccgagcuggagaccccuaaccucgcuaagaaagugcuggacuggcuugaaaagcacggggccgagagacugaaacgcauggcgauuucuggagaugacugcgucgugaagcccaucgaugaccgguucgccacagcucucaccgcccugaaugauaugggcaagguuagaaaagacauuccucagugggaacccagcaagggguggaacgauuggcagcaagugccuuuuuguucccaucacuuccaucagcugaucaugaaagacggccgcgagaucgucgugcccugccggaaucaggaugaacucgucggaagagcucgcgugagccagggcgccggguggucucugcgggagacagcgugucuuggaaaguccuaugcccaaauguggcagcugauguacuuucacagacgcgaccuccggcuggcugccaacgcuauuugcagcgccguuccgguggauugggucccuaccucuagaacaaccugguccauccacgcucaucaccaguggaugacgacagaggacaugcuuagcguguggaaucgcguuuggauugaagagaaccccuggauggaagacaaaacccauguguccucuugggaggaaguccccuaucugggcaagcgggaggaucaauggugugggagccucaucggacugaccgccagagcgacaugggccaccaauauucagguggcuaucaaccaggugcggagacugauuggcaaugagaacuaccucgacuacaugacauccaugaagcgcuucaaaaaugaaagcgauccugagggggcccugugg

SEQ ID NO: 19506 - RNA, 9876 nt, Artificial Sequence
  derived and/or modified CDS sequence (opt5) from DENV-1__KF672761__SS-prME
agcgugaccaugcuguucaugcuccugcccacagcccuugcuuuucaccugacgaccagaggcggggagccucauaugaucgucuccaagcaggaacggggaaaaucucuccuguucaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgggcacagacgggacaagcgcucugucgcccuggcuccucaugugggacugggccucgagacaagaaccgagacguggaugagcuccgaaggcgccuggaaacagauucagaagguugagacaugggcucugcggcaccccggguuuaccgugaucgcccuuuuccuggcgcaugccauuggaacaucuaucacccagaagggcaucauuuuuauccuccugaugcuugucaccccuagcauggcuaugcgcugcguggggauuggaaacagagauuucguugaaggccuguccggggccacauggguggacgucgugcucgagcacggaagcugugugacgaccauggcuaaaaauaagcccacacuggauaucgagcugcucaaaaccgaagucacaaacccugccguucugcggaagcuuugcauugaggcgaaaaucucuaauaccacgacagacucccgcuguccgacccaaggcgaagccacccugguggaggaacaggaugcuaacuuugugugcagacggacauucgucgaccgcggcugggggaauggauguggccucuuugggaagggaagccugcuuaccugcgccaaguucaaaugcgugacaaagcuggagggcaaaauuguucaguacgagaaccucaaguauucugugaucgucacggugcacaccggggaucagcaucaaguuggaaaugaaacaaccgagcacggcacaaucgcuaccauuacgccccaggccccuaccuccgaaauccagcugacagacuacggcgcccugacccucgacuguagccccagaacagggcuggauuuuaacgagauggugcuucugaccaugaaagaaaagucuuggcucguccauaaacagugguuccuggaccuuccucugcccuggacguccggagcuagcacaucccaagagaccuggaaucggcaggaucuccuggugacauuuaagaccgcgcacgccaagaaacaggaggucgugguucugggcucucaagaaggggcuaugcacaccgcccucacaggagccacggagauucagaccagcggcacaaccacaaucuucgcugggcaucugaagugccgccuuaaaauggacaagcugacccucaaaggcacguccuaugugauguguacaggaagcuucaagcuggaaaaggaggucgccgaaacccagcacggcaccgugcugguucaggugaaauacgaggggacagaugcgccgugcaagauuccuuuuucuacccaagacgagaaaggagucacacagaacggcagacuuaucacggcuaaucccaucgugaccgauaaggaaaaaccugugaacauugagacagaaccccccuucggggaguccuauaucguugucggagccggcgagaaggcccucaagcugagcugguuuaaaaaggggucuagcauuggcaaaauguucgaagcuaccgcccggggagcuagacgcauggccauccugggcgacacagcgugggauuuuggguccauuggaggcguguucaccucuguggggaagcucguccaucagguguuuggaacggccuacggcguucuguucagcgggguguccuggaccaugaaaaucggcaucggaauucuucugacauggcucggccugaauagccggucuaccucccugagcaugacauguaucgcugucgggauggugacccuuuaccucggaguuauggugcaggccgacucuggcugcgucauuaacuggaaggggagagagcugaaguguggauccggcaucuuugugacaaacgaaguucacaccuggacggagcaauauaaauuccaggcugauagcccuaagcgccuguccgccgcgauugggaaagccugggaagagggcgugugcggaauccggucugcuacaagacucgagaauauuauguggaagcagaucagcaacgaacugaaucauauccuucuggagaacgacaugaaauuuaccgucguggugggcgacgccaaugggauucucgcucagggaaagaaaaugauccgcccgcaacccauggaacacaaguacuccuggaagucuuggggcaaagccaagauuaucggggccgauauucagaacaccacauucaucaucgacggaccugauacccccgaguguccugacgaacagcgggcuuggaauauuugggaggucgaggauuauggcuuuggcaucuucacgacaaacauuuggcugaaacugagagacagcuacacccagaugugcgaucaccgccuuauguccgcggccaucaaggacagcaaagcuguucaugccgauaugggguauuggauugaaucugagaagaaugaaacauggaagcucgcccgggcuuccuucaucgaggugaaaaccuguaucuggcccaagagccacacacuguggucuaacggagugcuggaauccgagaugauuaucccgaaaauuuacggcgggccuaucagccaacauaauuauagacccggauacuuuacccagacggccggcccuuggcaccucgggaagcuggagcuugacuucgaucugugcgaaggaaccacagucgugguugacgagcacugcggcaaccgcggccccucucuccggaccacaaccgugacggggaaaauuauccaugaaugguguugcagaagcuguacacugccuccccugcgguuucgcggagaggauggcugcugguacgggauggagaucagaccggucaaggaaaaggaggaaaaucuugugcgguccaugguuagcgcgggaucuggcgagguggacuccuucagccucgggauucugugugucuccaucaugauugaagaggugaugagaucucgcuggagccggaaaaugcugaugaccggaacacucgcuguuuuucugcuucugaucaugggccagcucaccuggaacgaccugauuagacugugcaucauggugggcgccaaugccuccgauaagauggggaugggaaccacauaucuugcucugauggccacguucaaaaugcgcccuauguuugcggucggccuccuguucagacggcucaccucucgcgaggugcugcuucugacaauugggcucagccugguggcuuccgucgaacugcccaacucucuugaggaacugggagacggccucgccauggggaucaugaugcugaagcuccugaccgaguuucaaccccaccagcuuuggacaacccugcucagccugacguucaucaaaacaacccugucccuugauuacgccuggaagaccacagcuaugguucugagcauugugucucucuuuccucugugucucuccaccacaagccagaagacgaccuggcugccggugcuucugggaucuuucggcugcaaaccccugacaauguuucucaucaccgaaaacaagauuuggggcagaaaauccuggccucugaaugaggggaucauggccauuggaaucgucagcauccuucugucuucccuccugaagaacgacgugccccucgcuggcccucugauugccgggggaaugcuuaucgcguguuauguuauuagcggcuccagcgccgaucugucucuggagaaagcugccgaagugagcugggaggaagaggcugaacauuccgggacaucucacaauauccucgucgaggugcaggacgauggaaccaugaagauuaaagacgaggaacgggaugacacgcugaccauccuucugaaggccacacuccuggccguuagcggcguguaccccauguccaucccugcuacccucuucgucugguauuucuggcaaaagaaaaagcagcgcucuggcgugcugugggauacacccagcccgccugaggucgaaagagcggugcuugacgaugggauuuaccggauccugcagcgcggacugcucggcagaucccagguuggggugggagucuuucaagacggcguguuccauaccauguggcacguuacacggggggccgugcugauguaucagggaaaacgccuugagcccucuugggcuagcgucaagaaagaccugauuuccuacggcggcggguggagauuucagggaagcuggaacacgggcgaggaagugcaggugaucgccguugagccugggaagaaucccaagaacguccaaaccacaccgggaaccuucaaaaccccugaaggcgaggugggggccauugcucucgauuuuaagcccggaacaucuggcuccccuaucgugaaucgggaaggcaaaauugucgggcuguacggaaacggcgugguuacgaccagcgggacauaugugucugccaucgcgcaggcuaaggccucccaggagggaccccuccccgagaucgaagacgaggucuucaaaaagagaaaucugaccauuauggaucuucacccuggcagcgggaagacacgccgguaccugccggccaucgugagagaagcuauuaaacgcaagcugcggacccucauccuggcccccacgagaguuguggcguccgagauggcugaagcccuuaaaggcaugccuauucgcuaucaaacaaccgccgucaagucugagcauaccggacgggagaucguggaccugaugugccacgcuacauuuaccaugagacuccugagccccguucgcgugccuaacuacaauaugaucauuauggaugaagcccauuucacagaccccgcuuccaucgccgcgcggggcuauauuagcaccagagucgggaugggagaggccgcugccaucuuuaugacggcuacaccuccgggcucuguggaagccuucccccaguccaacgccgugauucaggaugaggaacgggacaucccugagcgcagcuggaauucuggguacgauuggaucaccgacuuucccggaaaaacagucugguucguuccuagcauuaaguccggcaacgauaucgcuaauugucugagaaagaacgggaaacgggugauucagcucucucgcaagaccuucgacacggaguaucaaaaaaccaagaacaaugacugggauuacguggucacaaccgacaucagcgaaaugggcgcgaacuuuagagccgaucgggugauugaccccagacgcugccuuaaaccgguuauccugaaggauggaccugagcgggugauucuggcuggccccaugcccgucacaguggccuccgccgcucagagacgcgggcggaucggaagaaaucagaacaaggaaggcgaccaguacguuuauauggggcaaccucucaauaacgaugaggaccacgcccauuggaccgaggcgaaaaugcugcuugauaauaucaacacacccgaaggaauuaucccugcucuguucgagccggaacgcgagaagucugccgccauugacggcgaauaccggcucagaggggaggcucgcaaaaccuuuguggagcugaugagacggggcgaucugcccgucuggcucagcuauaagguggccuccgaaggauuccaguacagcgaccgcagauggugcuuugauggcgagcggaauaaccagguccuugaagagaauauggacguggaaaucuggacgaaagagggggagcgcaagaaacugagaccucgguggcuggacgcgagaacauauucugauccccucgcccugcgcgaauucaaggaguuugcugccggacggagauccguuagcggcgaccuuauucuggaaaucgggaagcucccucagcaccugacccugcgcgcucaaaacgcccucgauaaucuugugaugcugcacaacuccgagcagggaggcaaagcuuaccggcaugccauggaagagcugcccgacaccaucgagacacucaugcugcuugcgcugauugccgugcucaccggcggggucacacuguucuuucugucuggaaagggccucgggaaaacgagcaucggacuucuguguguuaccgcuuccucugcccugcucuggauggcuagcguggaaccgcacuggauugccgccuccaucauucuggaguucuuucuuauggugcugcucaucccugaacccgauagacagcggacaccucaggacaaucaacuggcuuaugucgugaucggccugcucuucaugauucuuaccguugcggccaacgagauggggcugcuggagacaaccaagaaagaucucggaaucggccauguggcugccgaaaaccaccagcacgccacgaugcuggacgucgaucuucgccccgcuagcgccuggacccuguacgcgguggccacaaccgucauuacaccuaugaugagacauaccaucgagaauacgacagcuaacauuucucucaccgccaucgcuaaucaggccgcgauucugaugggccuggacaagggguggcccaucuccaagauggauaucggagugccgcuccuugcccugggcugcuacagccaaguuaacccucugacacucaccgcugccgugcugaugcuugucgcucacuaugccauuaucgggcccggacugcaggcuaaagccacccgggaagcgcagaagcgcacagccgcuggcauuaugaaaaaucccacgguggacgggaucguugccauugaucucgacccuguggucuacgacgcuaaguuugagaaacagcugggacaaaucaugcugcucauccuuuguaccucucagauucugcugaugagaacaaccugggcccucugcgaauccaucacacuggccaccggcccgcuuacgacacugugggagggcagccccgggaaguucuggaacaccaccauugcggugucuauggcuaauaucuuccggggaagcuaucucgccggcgcugggcuggccuuuucccugaugaagucucucggaggcgggcgcagaggaacaggcgcccagggcgagacccuuggggaaaaauggaagcggcagcugaaccaacugagcaaauccgaguucaauacauacaagcgcagcggaauuauggaaguggauagauccgaggcuaaagaaggccucaagcggggggagacgaccaagcaugccguuucuagaggaacagcgaaacugcgcugguuugucgagcggaaccuugugaagccugaaggcaaagugaucgaccugggguguggaagaggcggcuggagcuauuacugcgccgggcucaagaaagucaccgagguuaagggauauacaaaaggcgggcccggacacgaagagccuauccccauggcuaccuacggcuggaaucuggugaagcugcauuccgggaaggauguguucuuuaugccuccggaaaaaugugacacgcuccuuugcgauauuggagagucuagccccaacccuaccaucgaggaaggccgcacacugcggguccugaagaugguggagcccuggcucagaggcaaucaguucuguauuaaaauccugaacccuuacaugcccuccguuguggaaacccuugagcagaugcagcgcaagcacgggggaaugcugguccggaauccgcucucuagaaacagcacacacgagauguauuggguguccugcggcaccgggaauauuguuagcgccgugaacaugacaucucgcaugcugcugaaccgguuuaccauggcucauagaaaaccuacguacgaacgcgacgucgaucucggagccggcacacggcacguggcgguggagcccgaagucgccaaucuggacaucauugggcaaagaaucgagaacaucaagaaugaacauaaguccaccuggcacuaugaugaggacaaccccuacaaaaccugggcuuaucacggaagcuacgagguuaagccuucuggcuccgccagcucuauggugaauggcgugguccgccuucugacaaaacccugggaugugauuccuaugguuacgcagaucgcuaugaccgacacaaccccguucgggcagcaaagaguguuuaaggaaaaagucgacacacggaccccccgcgccaagagaggaacagcucagauuauggaggugaccgccaaguggcucuggggcuuccugucccggaacaaaaagccuagaaucuguacgcgggaagaguuuacccgcaaaguuagaagcaaugcggccauuggggcuguguucgucgaugaaaaccaguggaauuccgccaaggaggcuguggaggacgaacgguuuugggaucuuguucaucgcgagagagaacugcacaaacagggaaagugcgccacaugcguguauaacaugaugggcaagcgggagaaaaagcucggggaauucggcaaagccaagggaagccgcgcgaucugguacauguggcugggcgcuagauuccuggaguuugaggcccucggguucaugaaugaagaccauugguuuucucgggagaacagccuguccggagucgaaggcgaggggcuucacaaacugggauacauccuccgcgauauuucuaagauccccggcgggaauauguaugccgacgauaccgcuggcugggacacaagaauuaccgaggaugaccugcaaaacgaagccaaaaucacggauauuauggagccugaacaugcucuucuggccacaagcaucuucaagcucaccuaccagaauaaggugguccgggugcagcgccccgcgaaaaacggaacaguuauggacgugaucuccagacgggaucagcgcggcucugggcaagucggaaccuauggccugaacacguuuaccaauauggaggugcagcugauuagacagauggaaagcgaggggaucuuccucccguccgagcuggaaacaccuaaccuugccgagcgggugcuggacuggcucgaaaagcacggagcugagagacugaaacgcauggccauuucuggcgacgauuguguugugaagcccaucgacgaucgguuugcuaccgcccuuauugcgcugaaugacauggggaaagucagaaaggauaucccucagugggaacccagcaagggcuggaacgacuggcaacaggugccuuucugcucccaccauuuucaccagcucaucaugaaagauggacgcgagauuguugugcccugucggaaucaggacgagcuggucggcagagcccgcgugagccaaggggcuggauggucucugcgggaaacagccugccucggcaaguccuacgcucagauguggcagcugauguauuuccauagacgcgaucuucggcuggccgcuaacgccaucuguagcgcggucccgguggacuggguuccuaccucuagaacaaccugguccauucacgcccaccaucaauggaugacgacagaggauaugcucagcguguggaaucgcgucuggaucgaagagaaccccuggauggaagacaaaacccacguguccucuugggaggagguucccuaccuggggaagcgggaagaccaguggugcggaagccuuauuggccugaccgcuagagccacaugggccaccaauauccagguggcuauuaaccagguccggagacucaucgggaaugagaacuaucuggauuacaugacauccaugaaacgcuuuaagaaugaaagcgacccugagggcgcccugugg

SEQ ID NO: 19507 - RNA, 9876 nt, Artificial Sequence
  derived and/or modified CDS sequence (opt5) from DENV-1__KF672762__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcauugaugcgccgugcaagaucccuuucucuacacaagacgaaaaaggggucacccagaacggaagacucaucacagcuaaucccauugugacggauaaggagaaaccugugaacaucgaaaccgagccccccuuuggcgaguccuauauuguugucggggccggagaaaaggcccugaagcugagcugguucaaaaagggcucuagcaucgggaaaauguuugaggcuacagcccggggcgcuagacgcauggccauucucggagacaccgcgugggauuucggcuccaucgggggaguguuuacaucugugggcaagcugguccaucaggugcuugggaccgccuacggaguucuguucagcggcguguccuggacgaugaaaaucgggauuggcauccuccugaccuggcugggacuuaauagccggucuacaucccucagcaugaccuguauugcugucggcauggugacacuguaccuggggguuauggugcaggccgacucuggaugcgucaucaacuggaagggcagagaacucaaguguggguccggaauuuuugugaccaacgagguucacacauggaccgaacaauauaaauuccaggcugauagcccuaagcgccuguccgccgcgaucggcaaagccugggaggagggggugugcggcauucggucugcuacgagacuugaaaauaucauguggaagcagaucagcaacgagcugaaucauauucuccuggaaaacgacaugaaauuuacagucguggugggagacgccaauggcauccuggcucaggggaagaaaaugauucgcccgcaacccauggagcacaaguacuccuggaagucuuggggaaaagccaagaucauuggcgccgauauccagaacaccaccuucaucauugacgggccugauacacccgaauguccugacgagcagcgggcuuggaauaucugggaggucgaagauuauggauuuggcauuuucaccacgaacaucuggcuuaaacucagagacagcuacacacagaugugcgaucaccgccugauguccgcggccauuaaggacagcaaagcuguucaugccgauaugggcuauuggaucgagucugaaaagaaugagaccuggaagcuggcccgggcuuccuuuaucgaagugaaaacauguauuuggcccaagagccacacccucuggucuaacggggugcuggaguccgagaugaucauuccgaaaaucuacggaggcccuauuagccaacauaauuauagacccggguacuucacacagaccgccggaccuuggcaccuuggcaagcuggaacucgacuucgaucugugcgaggggacgaccgucgugguugacgaacacugcggaaaccgcggccccucucugcggacaaccacagugaccggcaaaaucauccaugagugguguugcagaagcuguacgcuuccuccccuccgguuucgcggggaggauggaugcugguacggcauggaaauuagaccggucaaggagaaggaagagaaucuggugcgguccaugguuagcgcggggucuggagaaguggacuccuucagccugggcauccucugugucuccauuaugaucgaggaggugaugagaucucgcuggagccggaaaaugcugaugacagggacccuugcuguuuuucugcuccugauuaugggacagcugacauggaacgaccuuaucagacugugcauuauggugggcgccaaugccuccgauaagaugggcauggggaccaccuaucucgcucugauggccacauucaaaaugcgcccuauguuugcggucggacuccuguucagacggcuuacgucucgcgaagugcugcuccugaccaucggccugagccuuguggcuuccgucgagcugcccaacucucucgaagagcugggggacggacucgccaugggcaucaugaugcugaagcuucugacagaauuucaaccccaccagcucuggaccacacugcugagccuuaccuucauuaaaacgacacugucccucgauuacgccuggaagaccaccgcuaugguucugagcaucgugucucucuuuccucugugucuuuccacaaccagccagaagacaacguggcugccggugcugcucgggucuuucggaugcaaaccccugaccauguuucuuauuacagagaacaagaucuggggcagaaaauccuggccucugaaugagggcauuauggccaucgggaucgucagcauucuccugucuucccuccugaagaacgacgugccccuugcuggaccucugaucgccggcgggaugcugauugcguguuauguuaucagcggauccagcgccgaucucucucuggaaaaagcugccgaggugagcugggaagaggaagcugagcauuccggcaccucucacaauauucuugucgaggugcaggacgaugggacaaugaagaucaaagacgaagagcgggaugacacccugacgauccuccugaaggccacccuccuggccguuagcggaguguaccccauguccauuccugcuacacuuuucgucugguauuuuuggcaaaagaaaaagcagcgcucuggcgugcugugggauacccccagcccgccugaagucgagagagcggugcuggacgauggcaucuaccggauucuccagcgcgggcugcuuggaagaucccagguuggcgugggggucuuccaagacggaguguuccauacaauguggcacguuacccggggcgccgugcugauguaucaggggaaacgccucgagcccucuugggcuagcgucaagaaagaccugaucuccuacggaggcggcuggagauuucaggggagcuggaacacaggagaagaggugcaggugauugccguugaaccuggcaagaaucccaagaacguccaaacgaccccggggacauucaaaaccccugagggagaagugggcgccaucgcucucgauuuuaagcccgggaccucuggauccccuauugugaaucgggagggcaaaaucgucggccuguacgggaacggagugguuacaacgagcggcaccuaugugucugccaucgcgcaggcuaaggccucccaggaggggccccuucccgaaauugaggacgaagucuucaaaaagagaaaucugacaaucauggaucugcacccuggaagcggcaagacccgccgguaccucccggccauugugagagaggcuaucaaacgcaagcugcggacacuuauucuggcccccaccagaguuguggcguccgaaauggcugaggcccucaaagggaugccuauccgcuaucaaacgacagccgucaagucugagcauaccggccgggaaaucguggaccugaugugccacgcuaccuuuacaaugagacugcucagccccguucgcgugccuaacuacaauaugauuaucauggaugaggcccauuucaccgaccccgcuuccauugccgcgcggggauauaucagcacaagagucggcaugggggaagccgcugccauuuuuaugaccgcuacgccuccgggaucuguggaggccuucccccaguccaacgccgugauccaggaugaagagcgggacaucccugagcgcagcuggaauucuggcuacgauuggauuacagacuuucccgggagaaccgucugguucguuccuagcaucaaauccggaaacgauauugcuaauugucuucggaagaacggcaagcgcgugauccagcugucuagaaaaacauuugacaccgaauaucaaaagacgaaaaacaaugacugggauuacguggucaccacagacauuagcgagaugggggcgaacuuccgggccgauagagugaucgacccccgccggugccugaagccgguuauucucaaagauggcccugaaagagugauccuggcuggacccaugcccgucaccguggccuccgccgcucagcgccggggcagaaucgggcgcaaucagaacaaggagggagaccaguacguuuauaugggccaaccucuuaauaacgaugaggaccacgcccauuggacagaagcgaagaugcugcucgauaauauuaacacccccgaggggaucauuccugcucuguucgaaccggagcgggaaaaaucugccgccaucgacggagaguacagacugcgcggcgaggcuagaaagacauuuguggaacucaugcggcgcggggaucuucccgucuggcugagcuauaaaguggccuccgagggcuuccaguacagcgacagacgguggugcuuugauggagaacgcaauaaccagguccuggaggaaaauauggacguggagauuuggaccaaggagggcgaaagaaaaaagcuccggccuagauggcuggacgcgcgcacguauucugauccccuugcccugcgggaguucaaagaauuugcugccgggagacgcuccguuagcggagaccucauccuggagaucggcaagcugccucagcaccucacacuucgggcucaaaacgcccuggauaaucuggugaugcuccacaacuccgaacaggggggaaaggcuuacagacaugccauggaggagcugcccgacaccauugaaacccuuaugcugcucgcgcugaucgccgugcugacaggcggcgucacccucuucuuucuuucugggaaaggacugggcaagacaagcauugggcugcucuguguuacggcuuccucugcccugcuuuggauggcuagcguggagccgcacuggaucgccgccuccauuauccuggaauucuuucucauggugcugcugaucccugagcccgaucggcagcgcaccccucaggacaaucaacucgcuuaugucgugauuggacuucuguucaugauccugacaguugcggccaacgagaugggccuccuggaaaccacaaaaaaggaucuugggauuggacauguggcugccgagaaccaccagcacgccaccaugcuggacgucgaucucagacccgcuagcgccuggacgcuguacgcgguggccaccacagucaucaccccuaugaugcggcauacaauugaaaauaccacggcuaacaucucucugacagccauugcuaaucaggccgcgauccucaugggccuugacaaaggcuggcccaucuccaagauggauauuggggugccgcugcuggcccucggaugcuacagccaaguuaacccucugacccuuacagcugccgugcugaugcucgucgcucacuaugccaucauuggccccgggcugcaggcuaaggccacccgcgaggcgcagaaaagaaccgccgcuggaaucaugaagaaucccacaguggacggcauuguugccaucgaucuggacccuguggucuacgacgcuaaauuugaaaagcagcucgggcaaaucaugcuucugauucuguguacgucucagauccuccugaugcggaccacaugggcccuuugcgaguccauuacccuggccacaggaccgcucaccacgcugugggagggcagccccggcaaauucuggaacacaaccaucgcggugucuauggcuaauauuuuucgcgggagcuaucuggccggagcuggccucgccuucucccuuaugaagucucuggggggaggcagacgggggaccggagcccagggcgaaacacugggcgagaaguggaaacgccagcucaaccaacugagcaaguccgaauucaauaccuacaaaagaagcgggaucauggagguggaucgguccgaagcuaaggagggacuuaaaagaggcgagacaacgaagcaugccguuucucgcgggaccgcgaagcugcggugguuugucgaaagaaaccucgugaaaccugagggaaaggugaucgaccugggcugugggcgcggaggcuggagcuauuacugcgccggccugaaaaaggucacagaaguuaaaggguauaccaagggaggccccgggcacgaggaaccuauucccauggcuacauacggauggaaucucgugaaacuucauuccggcaaggauguguucuuuaugccuccggagaagugugacacccugcugugcgauaucggggagucuagccccaacccuacgauugaagagggacggacccucagaguccugaaaaugguggaacccuggcuucgcggcaaucaguucuguaucaagauucugaacccuuacaugcccuccguuguggagacacucgagcagaugcagcggaaacacggcgggaugcuggucagaaauccgcugucucgcaacagcacccacgaaauguauuggguguccugcggaacaggcaauaucguuagcgccgugaacaugaccucucggaugcuccugaacagauuuacaauggcucaucgcaagccuaccuacgagcgggacgucgaucuuggggccggaacgagacacguggcgguggaacccgaggucgccaaucuggacauuaucggccaacgcaucgaaaacauuaaaaaugagcauaaguccacauggcacuaugaugaggacaaccccuacaagaccugggcuuaucacgggagcuacgaaguuaaaccuucuggauccgccagcucuauggugaauggcguggucagacuccugaccaagcccugggaugugaucccuaugguuacacagauugcuaugacggacaccacaccguucggccagcaacggguguuuaaagagaaggucgacacccgcacacccagagccaaacgggggaccgcucagaucauggaagugacagccaaguggcuuuggggauuccuguccagaaacaagaaaccucggauuuguacccgcgaggaauuuacgagaaagguucggagcaaugcggccaucggcgcuguguucgucgaugagaaccaguggaauuccgccaaagaggcuguggaagacgagcgcuuuugggaucucguucauagagaacgggagcugcacaagcaggggaaaugcgccaccugcguguauaacaugaugggaaagcgcgaaaagaaacugggcgaguucgggaaggccaaaggcagcagagcgaucugguacauguggcucggagcucgguuucuggaguucgaagcccuuggcuucaugaaugaggaccauugguuuucucgcgaaaacagccuguccggggucgagggagagggccuccacaagcugggguacauucuuagagauaucucuaaaauucccggaggcaauauguaugccgacgauacagcugggugggacacccggaucacagaagaugaccugcaaaacgaggccaagauuaccgauaucauggaaccugagcaugcucuccuggccacgagcaucuucaaacugacauaccagaauaaggugguccgcgugcagagacccgcgaagaacggcaccguuauggacgugauuucccggcgcgaucagagaggaucuggccaagucgggacauauggacucaacaccuuuacgaauauggaagugcagcugauccggcagauggagagcgagggcauuuuccuuccguccgaacuggagaccccuaaccucgccgaaagagugcuggacuggcuugagaaacacggggcugaacgccugaagcggauggccaucucuggagacgauuguguugugaaacccauugacgauagauuugcuacagcccucaucgcgcugaaugacaugggcaagguccgcaaagauaucccucagugggagcccagcaagggguggaacgacuggcaacaggugccuuucugcucccaccauuuucaccagcugauuaugaaggauggccgggagaucguugugcccuguagaaaucaggacgaacucgucggacgcgcccgggugagccaaggcgcuggguggucucugagagagaccgccugccuuggaaaauccuacgcucagauguggcagcugauguauuuccaucgccgggaucucagacuggccgcuaacgccauuuguagcgcggucccgaucgacugggugccuacaucucgcaccacaugguccauucacgcccaccaucaauggaugaccacggaagauaugcuuagcguuuggaaucggguguggaucgaggaaaaccccuggauggaggacaaggcucacgucuccucuugggaggaagugcccuaccugggcaaaagagaggaccaguggugcgggagccucauuggacugacagcccgggccaccugggcuaccaauauccagguugccaucaaccaggugagacgccugauuggcaaugaaaacuaucucgauuacaugacauccaugaagcgguuuaaaaaugagagcgacccugagggggcgcugugg

SEQ ID NO: 19508 - RNA, 9879 nt, Artificial Sequence
  derived and/or modified CDS sequence (opt5) from DENV-1__JF459993__SS-prME
agcgugaccaugcuguucaugcuccugcccacgucccuugccuuucaccugacgaccagaggcggggagccucauaugaucgugucuaagcaggaacggggaaagagccuccuguucaagaccuccgcuggcguuaacaugugcacccuuaucgccauggaccugggggagcucugugaagauacaaugaccuacaagugcccgcgcaucacagagaccgaacccgacgauguggacuguuggugcaaugcgacggagaccugggugacauauggaaccuguucucagacaggcgagcacagacgggauaagcgcagcgucgcucuggccccucauguggggcugggacucgaaaccagaacggagacauggauguccucugaaggcgccuggaagcagauucagaagguugagaccugggcucugggccaccccggguuuacagugaucgcccuuuuccuggcucaugccauuggaaccagcaucacccagaagggcaucauuuuuauccuccugaugcuugucacaccuuccauggcgaugcggugcguggggauuggaaaccgcgacuucguugagggccugagcggggccacguggguggaugucgugcucgaacacggaucuugugugaccacaauggcuaaagacaagcccacccuggauaucgagcugcucaaaacagaagucaccaauccugccauucugagaaaacuuugcaucgaggcuaaaauuuccaacacgacaaccgacagccgguguccgacccaaggcgaagccacacugguugaggagcaggauaccaauuuugugugccgcagaacauucguggaccggggcugggggaacggauguggccucuuugggaagggaucucugaucacgugcgcgaaguucaaaugcgucaccaaacuugaaggcaaaaucgugcaguacgagaaucugaaguauuccguuauugugacaguccacaccggggaucagcaucaagugggaaacgaaacaaccgagcacggcacgaccgccacaaucacaccccaagcuccuaccagcgaaauucagcucaccgacuacggcgcccugacgcuggacuguucuccccgcacagggcucgauuuuaaugagaugguucugcuuaccaugaaagagaaguccuggcuggugcauaaacagugguuccucgaccugccucuucccuggacaagcggagcuuccaccucucaagaaaccuggaacagacaggaucugcucgucacauuuaagacggcccacgccaagaaacaggagguggucgugcugggcagccaagaaggggcuaugcacaccgcgcugacaggagccaccgagauccagacauccggcaccacgacaauuuucgcugggcaucucaagugccggcugaaaauggacaaacuuacccugaaaggcguuagcuaugugauguguaccggaucuuucaagcucgaaaaggaggucgccgagacacagcacggcaccgugcugguucaggugaaauacgaagggacagaugccccgugcaagaucccuuuuuccagccaagacgagaaaggagucauccagaauggccgccugauuacggcuaaccccaucgugaccgauaaggaaaaaccugugaauauugaggccgagccgcccuucggggaaucuuauaucguugucggagcgggcgagaaggcucuuaagcucagcugguuuaaaaagggguccucuauuggcaaaauguucgaagccacagccagaggagcucggagaauggccauccugggcgacaccgcuugggauuuugggagcaucggaggcguguucacauccguggggaagcugguccaucagauuuuuggaaccgccuacggcguccuguucagcgggguuucuuggacgaugaaaaucggcauuggaauccugcuuaccuggcugggccucaacucccgcagcacaucucuguccaugaccuguauugcgguggggauggucacacuguaccuuggagugaugguucaggccgacagcggcugcgugaucaauuggaaggggcgggagcucaaguguggauccggcauuuuugucaccaacgaagugcacacauggaccgagcaauauaaauuccaggcugauucuccuaagagacugagcgccgcuaucgggaaagccugggaggaaggcguuugcggaauccgcuccgcgacgcggcuggagaacauuauguggaagcagaucucuaaugaacucaaccauauucugcuugagaaugacaugaaauuuacaguggucgugggcgacguggccgggauccuggcucagggaaagaaaaugauuagaccgcaacccauggaauacaaguauagcuggaaguccuggggcaaagccaagaucaucggggcugauguccagaacgccaccuucauuaucgacggaccuaauacccccgaguguccugaugaccagcgcgccuggaacauuugggagguugaagauuacggcuuuggcaucuucacaaccaauauuuggcucaaacugcgggacagcuauacacaggugugcgaucacagacugaugucugcugcgaucaaggacuccaaagccgugcacgcugauaugggguacuggaucgagagcgaaaagaacgagacauggaaacuugcccgcgccucuuucauugaagucaaaaccuguguguggcccaagucccauacacucuggagcaauggaguucuggagucugagaugaucauuccgaaaaucuauggcgggccuauuagccaacacaaccaucggcccggauacuuuacccagacagcuggcccuuggcaccuggggaagcucgaacuggacuucgaucuuugcgagggaaccacgguggucguggacgaacacugcggcaauagaggccccucccugcgcaccacaaccguuacagggaaaaucauccaugagugguguugccggagcuguacccucccuccccugagauuucggggagaggauggcugcugguacgggauggaaauucgcccggugaaggagaaggaagagaaccuggucaaaucuaugguguccgccggaagcggcgaaguugacuccuucucucuugggcuccuguguaucagcauuaugaucgaggaggugaugagaucccgguggucuagaaagaugcugaugacgggaacacucgcggucuuuuuccugcuuauuaugggccagcugaccuggaaugaccucauccgccugugcauuauggugggcgcuaacgccagcgaucggauggggaugggaacaaccuaucuggcccuuauggcuaccuuuaaaaugagaccuauguucgccgugggccugcucuuucgcagacugacaucccgggaaguccuccugcuuacgaucgggcugucucucguugcgagcguggagcugcccaauucccuggaggaacuuggagacggccuggcuauggggaucaugauucucaagcugcucaccgauuuccaaagccaccagcugugggccacacuucugucucucaccuuuaucaaaacaaccuucucccugcauuacgccuggaagacgauggcuauggugcugagcauugucucucuuuuuccccugugucucuccacaaccagccagaagaccacauggcugccugugcuccugggaucucuuggcugcaaaccgcugaccauguuccugaucgccgaaaacaagauuuggggccgcaaauccuggccccucaacgaggggaucauggcuguuggaaucgugagcauucugcuuuccagccugcucaagaaugacgucccucuggccggcccccucaucgccgggggaaugcugauugccuguuaugugaucucuggcagcuccgcugaucuuucucuggagaaagccgcugaaguuagcugggaggaagaggccgaacacuccggggccucucauaacauucugguggagguccaggacgauggaacaaugaagaucaaagacgaggaaagagaugacacgcucaccauccugcuuaaggcuacacugcucgcggugagcggcgucuacccucuguccauucccgccacccucuucgugugguauuuuuggcaaaagaaaaagcagcggucuggcguucugugggauacaccuagcccucccgagguggaacgcgcuguccuugacgaugggaucuacagaauuaugcagcggggacugcugggccgcucccagguggggguuggaguguuccaagagaaugucuuucacaccauguggcacgugacgagaggcgccgugcucauguaucaggggaaacggcuggagcccagcugggccucuguuaagaaagaccuuaucuccuacggaggcggcuggcgccugcaggggagcuggaacaccggagaagagguccaggugauugcuguggaacccggcaagaauccuaagaacguccaaacagcccccgggaccuucaaaacaccggagggagaagugggcgcgaucgcucucgacuuuaagccugggaccucuggaucccccauuguuaauagagagggcaaaaucgugggccuguacgggaacggagucgugacaacgagcggcaccuauguuuccgccaucgcccaggcuaaggccucucaggaggggccucuccccgaaauugaggaugaaguguuccggaaaagaaaucugacaaucauggaccuucaucccggaagcggcaagacccgccgguaccugccugcgauugucagagaggcuaucaagcgcaaacugcggacccucauucuggccccgacaagagugguugccuccgaaauggcugaggcccuuaaggggaugcccauccgcuaucaaacgaccgcugugaaaagcgagcacacaggcaaggaaaucgucgaucugaugugccaugccaccuuuacaaugcggcuccugucuccugugagagugcccaacuacaauaugauuaucauggacgaggcgcacuucaccgauccuuccagcauugccgcucgcggauauaucucuacgcgggucggcaugggggaagccgcugccauuuuuaugacagccacacccccuggaagcguugaggcuuucccgcaguccaacgcggugauccaggacgaagagagagauauccccgagcggucuuggaauagcggcuacgaauggauuaccgacuuuccugggaaaacagugugguucguccccuccaucaagucuggaaacgauauugccaauugucugcgcaagaacggcaaaagagugauccagcucagccggaagaccuucgacacagaguaucagaagaccaagaacaaugauugggacuacguugugacgacagacauuuccgaaaugggggcuaacuuucgcgccgauagagucaucgacccucggagaugccuuaaacccgugauucugaaggauggcccggagcgcguuauccuggccggaccuaugcccgugaccgucgcuagcgccgcgcagcggagaggccgcaucgggcggaaucauaacaaggagggagaccaguacauuuauaugggccagccccucaauaacgaugaagaccacgcucacuggacagaggccaaaaugcugcuugauaauaucaacaccccugaagggauuauccccgcccuguucgagccugaaagagagaagucugcugccauugacggagaguaccgccuccggggcgaagcgagaaaaacguuuguggagcugaugcgcagaggggaucugccggucuggcucuccuauaagguggccagcgaaggcuuccaauacuccgaccggcgcuggugcuuugauggagagagaaauaaccagguucuugaagagaauauggacguggagaucuggaccaaagaaggcgagcggaagaaacugcgccccagauggcuggaugcucggacauauucugacccucucgcccugagagaguucaaggaguuugcugccgggcgccggagcguguccggagaccuuauccuggaaauuggcaagcucccccagcaucugacccagagagcucaaaacgcccuggauaaucucgucaugcuucacaacucugagcaagggggacgcgcguaccggcaugcccuggaggaacugccugacacaaucgagacccucaugcugcuugcucugauugccguucucacaggcggcgugacccuguucuuucugagcgggagaggacucggcaaaacguccaucgggcuucugugugugauggcuagcucugcccugcucuggauggccuccgucgaaccccacuggauugcugcgagcaucauccuggaguucuuucuuauggugcugcucauuccggagccugaucggcagcgcacaccccaggacaaucaacuggccuauguugugaucggacuccucuucaugauucuuaccgucgcugccaacgaaaugggccugcuggagaccacaaagaaagaucucgggaucggacacguggccgucgaaaaccaucaccaugcuucuaugcuggacguggaucuucacccugccuccgcguggacccuguacgccguugcuacaacgauuaucacccccaugaugagacauacaauugagaauaccacagccaacaucagccucaccgcuaucgccaaucaggcggccauucugaugggccuggacaagggcuggccuaucucuaaaauggauauuggggugccccuccuugcucugggaugcuacagccaggucaacccgcugacgcucaccgccgcugugcugaugcuuguugcccacuaugcuaucauuggcccugggcugcaagccaaggcgacacgggaagcccagaagcgcaccgcugccggaaucaugaaaaaucccacaguggacggcaucgucgcuauugaucucgaccccgugguguacgaugccaaguuugagaaacagcuggggcagaucaugcugcucauucuuuguaccucccaaauccugcugaugagaacgacaugggcccucugcgagucuauuacccuggcgacaggaccucuuaccacccugugggaaggcagcccgggcaaguucuggaacacaacgaucgcuguuuccauggccaauaucuuccgggggagcuaucucgcuggagccggccuggccuuuucccugaugaaaucucucgggggaggccgcagagggaccggagcucagggcgagacacuuggcgaaaaguggaagcggcagcugaaccagcugagcaaauccgaguucaauaccuacaagcgcucugggauuauggaagucgacagaagcgaggccaaagagggacucaagcggggcgaaacaaccaaacacgcgguguccagagggacggccaagcugcgcugguuuguggagcggaaccuugucaagcccgaaggaaaaguuaucgaccugggcugugggagaggaggcuggucuuauuacugcgcuggccucaagaaagugacagaggugaagggguauaccaaaggaggcccugggcaugaggaacccauuccuauggccaccuacggauggaaucuggucaagcugcacagcggcaaagauguguucuuuauucccccugagaagugugacacacuccuuugcgauauuggggaauccagcccgaaccccaccaucgaggaaggacgcacacugcggguucugaagaugguggagccuuggcucagaggcaaucaauucuguauuaaaauccugaaccccuacaugccuucugucguggagacgcuugaacagaugcagcgcaagcauggcgggaugcugguucggaauccccucuccagaaacagcacccacgagauguauugggugucuugcggaacaggcaauaucgucuccgcugugaacaugaccagccgcaugcugcugaaccgguuuacaauggcccacagaaaaccgaccuacgaacgcgacguggaucucggggcgggaacgcggcaugucgccguugagccugaaguggcuaaucuggacauuaucggccagagaauugagaacaucaagcacgagcauaaaucuaccuggcacuaugaugaagacaaucccuacaagacaugggccuaucauggguccuacgaggugaagcccagcggauccgcuagcucuauggucaacggcgugguuaaacuucugaccaagccuugggaugugauucccauggucacacaaaucgccaugaccgacacaaccccuuucggccagcagcgcguguuuaaagaaaagguugauacgagaacaccgaaagcuaagcgggggaccgcccaaaucauggaggugaccgcgcgcuggcucuggggauuccugagcagaaauaagaaaccccggauuuguacaagagaagaguuuacgcggaagguccgcuccaacgccgcuaucggcgccguguucguugacgagaaucaguggaacucugcuaaagaagccguggaggacgaaagauuuugggaucuuguccaccgggagcgcgaacugcacaagcaggggaaaugcgcgaccugcguguauaauaugaugggaaagagagagaagaaacucggcgaguucgggaaggcgaaaggcagccgggcuauuugguacauguggcugggagcccgcuuccuggaauuugaggcccucggcuucaugaacgaagaccauugguuuuccagagaaaauucucugagcggggucgagggagaaggccuucacaagcugggguacauccuccgggauauuuccaaaaucccuggaggcaacauguaugcugacgauacagccgggugggacacccgcaucacagaggaugaccugcagaaugaagcuaagauuaccgauaucauggagcccgaacaugcccuucuggcgaaaucuauuuucaagcucacauaccaaaacaaggugguuagagugcagcggccugccaaaaauggcaccgucauggacgugaucagccgcagagaucagcggggauccggccagguggggacguauggacugaacaccuuuacaaacauggaggcucaacugauucgccagauggagagcgaagagaucuucucucccuccgaacucgagaccccgaaucuggccgaaagaguucuugacuggcuggagaaguacggcguggagcggcucaaaagaauggcuaucagcggggaugacugugucgugaagccuauugacgaucgcuuugccacagcgcugaccgcccuuaacgacaugggaaaaguucggaaggauaucccccagugggaaccuucuaagggcuggaaugacuggcagcaagugcccuucugcucccaccacuuucaucagcugauuaugaaagaugggagagaggucguggucccuugucgcaaccaggacgaacucgugggccgggcuagaguuagccagggagccggcuggucccugcgcgagacggcuugccuggggaagucuuaugcccaaauguggcagcucauguacuuccaccggagagaucugcgccuugcugccaaugcgaucuguagcgccgugcccgucgacugggugccgacaucccggaccacauggagcauucaugcucaccaucaguggaugaccacggaagauaugcugucuguuuggaacagaguguggaucgaggagaauccuuggauggaagacaaaacccacgucuccagcugggaggaugugcccuaucucggaaagcgcgaagaccaauggugcggcucucugauugggcuuacagcccgggccaccugggcuacaaacauccagguggccaucaaucagguuagacggcugauuggaaacgagaauuaccucgacuacaugaccagcaugaaaagauuuaagaacgaguccgaucccgaaggcgcgcugugguga

SEQ ID NO: 19509 - RNA, 9876 nt, Artificial Sequence
  derived and/or modified CDS sequence (opt5) from DENV-1__KF672763__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggugggagaaaaggcccugaagcugagcugguucaaaaagggcucuagcauugggaaaauguuugaggccaccgcucggggcgccagacgcauggcuauccucggagacacagccugggauuucggcuccauugggggaguguuuaccucugucggcaagcuggugcaucagguuuucgggacggcguacggagugcuuuuuagcggcgucuccuggaccaugaaaaucgggaucggcauucugcucacauggcugggacugaauagccggucuaccucccuuagcaugacauguaucgccgugggcaugguuacccucuaccugggggugaugguccaggcugacucuggaugcgugauuaacuggaagggcagagaacugaaguguggguccggaaucuucguuacaaacgaggugcacaccuggacggaacaauauaaauuucaggccgauagcccuaagcgccucuccgcugccauuggccgggcgugggaggagggggucugcggcaucagaucugccacacgccuggaaaauauuauguggaaacagaucagcaacgagcuuaaucauauccugcucgaaaacgacauuaaguucaccgugguggucggaaaugcugacggcauccuggcccaggggaaaaagaugauucggccgcaacccauggagcacaaauacuccuggaagucuuggggaaaggcuaaaaucauuggcgccgauauccagaacaccacauuuaucauugacgggccugauacccccgaauguccugacgagcagagagccuggaauaucugggagguugaagauuauggauucggcauuuuuacgacaaacaucuggcugaagcuucgcgacagcuacacccagaugugcgaucaccggcucauguccgcugcgauuaaagacagcaaggccgugcaugcugauaugggcuauuggaucgagucugaaaaaaaugagacauggaagcuggccagagccuccuucaucgaagugaagaccuguauuuggcccaaaagccacacacuguggucuaacgggguccucgaguccgagaugaucauuccgaagauguacggaggcccuaucagccaacauaauuaucgccccggguacuucacccagacggcuggaccuuggcaccugggcaaacuugaacuggacuuugaucucugcgaggggaccacagugguuguggacgaacacugcggaucucggggccccagccugagaaccacaaccgucacgggcaagauuauccaugagugguguugccgguccuguacacugccuccccuucgcuucagaggggaggauggaugcugguacggcauggaaauccggccggugaaagagaaggaagagaaccucguuagaagcauggugucugccggguccggagaagucgacagcuuuucccugggcauucugugugugucuaucaugauugaggagguuaugcgcagccggugguccagaaagaugcucaugaccgggacacuggcgguguuccuucugcucaucaugggacagcugaccuggaaugaccugauucgccuuugcaucauggucggcgcuaacgccucugauaaaaugggcauggggaccacauaucuggcccucauggcuacguuuaagaugagaccuauguucgccgugggacugcucuuucggcgccugaccagcagagaagugcuucugcucacaauuggccugucccugauggcgucugucgagcuucccaauagccuggaagagcucggggacggacuggcuaugggcaucaugaugcucaaacugcuuaccgaauuccaaccccaccagcuguggacaacccuccugucccugacguuuaucaagacaacccuuagccuggauuacgccuggaaaaccacagccaugguucucucuauugugucccuguucccucucugucugagcaccacaucucagaagacgaccuggcuuccggugcugcugggguccuuuggaugcaagccccucacaauguuccugaucaccgagaacgagauuuggggccggaaaagcuggccucuuaacgaaggcaucauggcuauugggaucgucucuauccugcucuccagccugcucaagaaugacgugccccuggccggaccucuuauugcuggcgggaugcugaucgccuguuauguuauuuccggaagcucugcggaucugagccucgagaaagccgcugaaguguccugggaggaagaggccgagcauucuggcacaagccacaacauccuggucgaagugcaggacgaugggaccaugaagauuaaagacgaggaacgcgaugacacgcuuaccauccugcucaaggcuacacugcucgccguuuccggaguguaccccaugucuaucccugccacccuguuugucugguauuucuggcaaaaaaagaagcagagaagcggcgugcuuugggauacacccuccccgccugaggucgagcgggcugugcuggacgauggcauuuaccgcauccugcagagagggcuccugggacggucucagguuggcgugggggucuuccaagacggaguguuucauaccauguggcacguuacacgcggcgcggugcuuauguaucaggggaaaagacuggaacccagcugggccuccgucaagaaagaccucauuagcuacggaggcggcuggcgguuccaggggucuuggaauacgggagaggaagugcaggugaucgcuguugagccuggcaagaaccccaaaaauguccaaaccacaccggggaccuuuaagaccccugaaggagaggugggcgccauugcccuggauuucaagcccgggacauccggaagcccuaucgugaacagagagggcaaaauugucggccucuacgggaauggagugguuacgaccucuggcacauauguguccgcuaucgcccaggcgaaggcuagccaggaagggccccugcccgagaucgaagacgaggucuuuaaaaagcgcaaccuuaccauuauggaucugcacccuggauccggcaaaacacggagauaccugccggccaucgugcgcgaagccauuaagcggaagcucagaacccugauccuugcucccacgcgcguuguggccucugagauggcggaggcucugaaagggaugccuauucgguaucaaacaaccgccgucaagagcgaacauaccggcagagagaucguggaccucaugugccacgccacauucaccaugcgccugcugucccccguucgggugccuaauuacaacaugaucauuauggaugaagcucauuuuacagaccccgccagcaucgcugccagaggauauauuucuacccgggucggcaugggggaggcggccgcuaucuucaugacggccacaccuccgggauccguggaagcuuuuccccagagcaaugccgugauucaggaugaggagcgcgacaucccugaaagaucuuggaacagcggcuacgauuggaucaccgacuuccccgggaaaacagucugguuuguuccuuccauuaagucuggaaaugauaucgccaacugucuccggaaaaauggcaagcgcgugauucagcuuagcagaaagaccuucgacacggaguaucaaaaaaccaagaacaacgacugggauuacguggucacaaccgacaucuccgaaaugggggcuaauuuccgggcggauagagugauugacccccgccggugccugaaaccgguuauccugaaggauggcccugagagagugauucucgccggacccaugcccgucacaguggcuucugccgcccagcgccggggcagaaucgggcgcaaccagaauaaagagggagaccaguacguuuauaugggccaaccucugaacaaugaugaagaccacgcucauuggaccgaggccaagaugcuucuggauaacaucaauacacccgaagggauuaucccugcgcucuuugagccggaacgggagaagagcgcugccauugacggagaguacagacugcgcggcgaagccagaaaaaccuucguggagcugaugcggcgcggggaucuccccgucuggcuuuccuauaagguggcuagcgaaggcuuucaguacucugacagacgguggugcuucgauggagagcgcaacaaucagguccuggaagagaacauggacguggagaucuggacgaaagaaggcgagagaaagaaacugcggccuagauggcucgacgcccgcacauauuccgauccccuggcgcuucgggaauuuaaggaguucgccgcugggagacgcagcguuuccggagaccugauucucgaaaucggcaaacugccucagcaccugacccuccgggcccaaaaugcucuugauaaccuggugaugcugcacaauucugagcaggggggaaaggccuacagacaugcuauggaggaacuccccgacaccaucgagacacugaugcuucuggcccucauugcggugcugaccggcggcgucacacuguuuuuccucagcgggaagggacuuggcaaaacguccaucgggcugcuguguguuaccgccucuagcgcucuccuguggauggccuccguggaaccgcacuggauugcugccagcaucauucuugaguuuuuccugauggugcuccugaucccugagcccgaucggcagcgcacaccucaggacaaccaacuggccuaugucgugaucggacuccuuuuuaugauucugaccguugcugcgaaugaaaugggccugcucgagacaaccaagaaagaucuggggaucggacauguggccgcugaaaaccaccagcacgccacgaugcuugacgucgaucugcaucccgccucugcuuggacccucuacgccguggcgacaaccgucauuacaccuaugaugagacacaccaucgagaacacgacagccaauauuucccugaccgcuaucgccaaccaggcugccauucugaugggccucgacaagggcuggcccaucagcaaaauggaucuuggggugccgcugcuggcgcucggaugcuacucucaaguuaauccucugacacuuaccgccgcugugcugaugcucgucgcccauuaugcuaucauuggccccgggcugcaggccaaggcuacccgggaagcccagaagcgcacagcggccggaaucaugaaaaaccccacgauugacggcaucguggcuauugaucuggacccuguuguguacgacgccaaguucgagaaacagcucgggcaaaucaugcuucugauccuguguaccucccagauucuccugaugagaacaaccugggcucuuugcgagagcaucacacuggccaccggaccgcucacgacacugugggaaggcucucccggcaaguuuuggaauaccaccauugccgucagcauggcgaacaucuuccggggguccuaucuggcuggagccggccucgcuuucucucuuaugaaaagccuggggggaggccgcagagggacaggagcccagggcgagacccugggcgaaaaguggaagcggcagcucaaucaacuguccaaaagcgaguuuaacacauacaagcgcuccgggauuauggaaguggauagaucugaggccaaagagggacuuaagcggggcgaaacgaccaaacacgcugugagcagagggacagccaagcugcgcugguucguugagcggaaucucgucaagccugaaggaaaagugaucgaccugggcugugggagaggaggcugguccuauuacugcgcgggccugaagaaagugaccgaggucaagggguauacaaaaggaggccccgggcaugaagagccuauccccauggccaccuacggauggaaccucguuaagcuucacucuggcaaagauguguuuuucaugccuccggagaagugugacacgcugcugugcgauauuggggaaagcucccccaauccuaccaucgaggaaggacgcacacuccgggugcugaagauggucgagcccuggcuuagaggcaaccaguuuuguauuaaaauccugaauccuuacaugcccucugugguugagacccucgaacagaugcagcgcaagcacggcgggaugcuggugcggaacccgcugagcagaaauuccacacaugagauguauugggucagcugcggaaccggcaacauugugucugcuguuaauaugacaucccgcaugcuccugaaccgguucaccauggcccacagaaaaccuacguacgaacgcgacguggaucuuggggcuggaacacggcaugucgccguggagcccgaaguggcgaaccuggacaucauuggccaaagaaucgagaauaucaagaacgagcacaaaagcaccuggcacuaugaugaagacaaucccuacaagaccugggccuaucaugggucuuacgaggucaagccuuccggaagcgcuucuuccaugguuaacggcguggugcgccuccugacaaaacccugggaugucauuccuauggugacgcagaucgccaugaccgacacaaccccguuuggccagcaaagaguuuucaaggaaaaaguggacacacggaccccccgcgcuaagagagggacagcccagauuauggaggucaccgcuaaauggcuuuggggauuucugagccggaauaagaagccuagaaucuguacgcgggaagaguucacccgcaaagugagauccaacgccgcgauuggcgccguuuuuguggaugagaaucaguggaacagcgcuaaggaagccgucgaggacgaacgguucugggaucucgugcaccgcgagagagaacugcauaaacaggggaagugcgcuacaugcguuuauaauaugaugggaaaacgggagaagaagcugggcgaguuugggaaagccaagggcucucgcgccaucugguacauguggcucggagcgagauuccuggaauucgaggcucuuggcuuuaugaacgaagaccacugguucagccgggagaauucccugucugggguggagggagaaggccuccauaaacugggguacauccuucgcgauauuagcaagauccccggaggcaacauguaugccgacgauaccgccgggugggacacaagaauuaccgaggaugaccugcggaaugaagcuaaaaucacggauauuauggagccugaacacgcccuccuggcuacauccaucuuuaagcugaccuaccaaaacaaagucgugcgcguccagagacccgccaagaauggcacagugauggacguuaucucucggcgcgaucagagaggaagcggccagguggggaccuauggacucaacacguucaccaacauggagguccaacugauucggcagauggaguccgaaggcaucuuuuucccgucugagcuugaaagcccuaaucuggcggagagagugcucgacuggcuggaaaagcacggggccgagcgccuuaaacggauggcuauuuccggagacgauugugugguuaagcccaucgacgauagauuugccacagcucugauugcccucaacgacaugggcaaagugcgcaaggauaucccucagugggagcccagcaaaggguggaaugacuggcagcaagucccuuucugcucucaucacuuucaucagcugaucaugaaggauggccgggaaauugugguucccuguagaaaccaggacgagcuggugggacgcgcgcgggucucccagggcgccggguggagccucagagaaaccgcuugccugggaaagucuuacgcccaaauguggcagcuuauguauuuccaccgccgggaucugagacucgcugccaaugcuaucuguuccgccgugccggucgacugggugccuacaagccgcaccacaugguccauucacgcgcaucaccaguggaugaccacggaggauaugcugucuguuuggaaccggguguggaucgaagagaaucccuggauggaggacaaaacacaugucagcuccugggaagaggugcccuaccuuggcaagagagaagaccaauggugcgggagccugauuggacucaccgcccgggcuaccugggccacaaacauccagguugccauuaaucaggugagacgccugaucggcaacgagaauuaucuggauuacaugaccucuaugaaacgguuuaagaacgaguccgacccugaaggggcucucugg

SEQ ID NO: 19510 - RNA, 9876 nt, Artificial Sequence
  derived and/or modified CDS sequence (opt5) from DENV-1__KF672764__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccaacggcauccugacccaggggaaaaagaugauucggccgcaacccauggagcacaaauacuccuggaagucuuggggaaaggcuaaaaucauuggcgccgacauccagaauacaaccuuuaucauugaugggccugacacgcccgaauguccugaugagcagagagccuggaacaucugggaggucgaagacuauggauucggcauuuuuacaaccaauaucuggcugaagcuucgcgauagcuacacacagaugugcgaccaccggcucauguccgcugcgauuaaagauagcaaggccguucaugcugacaugggcuauuggaucgagucugaaaaaaacgagaccuggaagcuggccagagccuccuucaucgaagugaagacauguauuuggcccaaaagccacacccuguggucuaauggggugcucgaguccgagaugaucauuccgaagauguacggaggcccuaucagccaacauaacuaucgccccggguacuucacgcagaccgcuggaccuuggcaccugggcaaacuugaacuggauuuugaccucugcgaggggacaaccgucgugguugaugaacacugcggaucucggggccccagccugagaacaaccacggugacaggcaagauuauccaugagugguguugccgguccuguacccugccuccccuucgcuucagaggggaggacggaugcugguacggcauggaaauccggccggucaaagagaaggaagagaaucucgugaagagcaugguuucugccggguccggagaaguggauagcuuuucccugggcauucugugugucucuaucaugauugaggaggugaugagaagccgcuggucccggaaaaugcucaugacagggacccuggcgguuuuccuucugcucaucaugggacagcugaccuggaacgaccugauuagacuuugcaucauggugggcgcuaaugccucugacaagaugggcauggggacaacguaucuggcccucauggcuaccuuuaaaaugcgcccuauguucgccgucggacugcucuuuagacggcugacaagccgcgaagugcuucugcucaccauuggccugucccugguggcgucugucgagcuucccaacagccuggaagagcucggggauggacuggcuaugggcaucaugaugcucaagcugcuuacagaauuccaaccccaccagcuguggaccacgcuccugucccugacauuuaucaaaaccacccuuagccuggacuacgccuggaagacaaccgccaugguucucucuauugugucccuguucccucucugucugagcacaacgucucagaagaccacauggcuuccggugcugcugggguccuuuggaugcaaaccccucaccauguuccugaucacagagaacaagauuuggggcagaaaaagcuggccucuuaaugagggcaucauggcuauugggaucgucucuauccugcucuccagccugcucaagaacgaugugccccuggccggaccucuuauugcuggcgggaugcugaucgccuguuauguuauuuccggaagcucugcggaccugagccucgaaaaagccgcugagguguccugggaagaggaagccgagcauucuggcaccagccacaauauccuggucgaggugcaggaugacgggacgaugaagauuaaagaugaagagcgggacgauacccuuacaauccugcucaaggcuacccugcucgccguuuccggaguguaccccaugucuaucccugccacacuguuugucugguauuucuggcaaaagaaaaagcagcgcagcggcgugcuuugggacacccccuccccgccugaagucgagagagcugugcuggaugacggcauuuaccggauccugcagcgcgggcuccugggaagaucucagguuggcgugggggucuuccaagauggaguguuucauacaauguggcacguuacgcggggcgcggugcuuauguaucaggggaaacgccuggagcccagcugggccuccgucaagaaagaccucauuagcuacggaggcggcuggagauuccaggggucuuggaacaccggagaagaggugcaggugaucgcuguugaaccuggcaagaaucccaagaacguccaaacaaccccggggaccuuuaaaacaccugagggagaagugggcgccauugcccuggacuucaagcccgggacguccggaagcccuaucgugaaucgggagggcaaaauugucggccucuacgggaacggagugguuaccacaucuggcaccuauguguccgcuaucgcccaggcgaaggcuagccaggaggggccccugcccgaaaucgaggaugaagucuuuaaaaagagaaaucuuacaauuauggaccugcacccuggauccggcaagacccgccgguaccugccggccaucgugagagaggccauuaaacgcaagcuccggacgcugauccuugcucccacaagaguuguggccucugaaauggcggaggcucugaaagggaugccuauucgcuaucaaaccaccgccgucaagagcgagcauacaggccgggaaaucguggaucucaugugccacgccaccuucacaaugagacugcugucccccguucgcgugccuaacuacaauaugaucauuauggacgaggcucauuuuaccgaucccgccagcaucgcugcccggggauauauuucuacgagagucggcaugggggaagcggccgcuaucuucaugacagccaccccuccgggauccguggaggcuuuuccccagagcaacgccgugauucaggacgaagagcgggauaucccugagcgcucuuggaauagcggcuacgacuggaucacagauuuccccgggaaaaccgucugguuuguuccuuccauuaagucuggaaacgacaucgccaauugucucagaaagaacggcaaacgggugauucagcuuagccgcaagacguucgauaccgaauaucaaaaaacaaagaacaaugacugggacuacguggucaccacagauaucuccgagaugggggcuaacuucagagcggaccgggugauugaucccagacgcugccugaaaccgguuauccugaaggacggcccugaacgggugauucucgccggacccaugcccgucaccguggcuucugccgcccagagacgcggccggaucgggagaaaucagaacaaggagggagaucaguacguuuauaugggccaaccucugaauaacgacgaggaucacgcucauuggacagaagccaaaaugcuucuggacaauaucaacacccccgaggggauuaucccugcgcucuuugaaccggagcgcgaaaagagcgcugccauugauggagaguaccggcugagaggcgaggcccgcaaaacguucguggaacugaugagacggggggaccuccccgucuggcuuuccuauaagguggcuagcgagggcuuucaguacucugaucgcagauggugcuucgacggagaacggaauaaccagguccuggaggaaaauauggauguggagaucuggacaaaagagggcgaacgcaagaaacugagaccucgguggcucgacgccagaaccuauuccgacccccuggcgcuucgcgaguuuaaggaauucgccgcugggcggagaagcguuuccggagaucugauucucgagaucggcaagcugccucagcaccugacccuccgcgcccaaaacgcucuugacaaucuggugaugcugcacaacucugaacaggggggaaaagccuaccggcaugcuauggaggagcuccccgauacaaucgaaacccugaugcuucuggcccucauugcggugcugacaggcggcgucacgcuguuuuuccucagcgggaagggacuuggcaaaaccuccaucgggcugcuguguguuacagccucuagcgcucuccuguggauggccuccguggagccgcacuggauugcugccagcaucauucuugaauuuuuccugauggugcuccugaucccugagcccgacagacagcggaccccucaggauaaucaacuggccuaugucgugaucggacuccuuuuuaugauucugacaguugcugcgaacgagaugggccugcucgaaaccacgaagaaagaccuggggaucggacauguggccgcugagaaccaccagcacgccaccaugcuugaugucgaccugcaucccgccucugcuuggacacucuacgccguggcgaccacagucauuaccccuaugaugcgccacacgaucgaaaauacaaccgccaacauuucccugacagcuaucgccaaucaggcugccauucugaugggccucgauaagggcuggcccaucagcaagauggaccuuggggugccgcugcuggcgcucggaugcuacucucaaguuaacccucugacccuuaccgccgcugugcugaugcucgucgcccauuaugcuaucauuggccccgggcugcaggccaaagcuacaagagaggcccagaagcggacggcggccggaaucaugaaaaaucccaccguggauggcauuguugcuaucgaccuggauccuguggucuacgacgccaaguucgaaaaacagcucgggcaaauuaugcuucugauccuguguacaucccagauccuccugaugcgcaccacaugggcucuuugcgagagcauuacccuggccacgggaccgcucacaacccugugggagggcucucccggcaaguuuuggaacaccacaaucgccgugagcauggcgaauauuuucagaggguccuaucuggcuggagccggccucgcuuucucucuuaugaagagccuggggggaggccggcgcgggaccggagcccagggcgaaacacugggcgagaaauggaagagacagcucaaccaacuguccaaaagcgaauuuaauacguacaagcgguccgggaucauggagguggaccgcaccgaagccaaagagggacuuaagagaggcgagacaaccaagcacgcuguuucucgggggacagccaaacugagaugguucgucgaacgcaaccucgugaagccugagggaaaagugauugaucugggcugugggcggggaggcuggagcuauuacugcgcgggccugaagaaagucaccgaaguuaagggguauacgaaaggaggccccgggcaugaggaaccuauccccauggccaccuacggauggaaucucgugaagcuucacuccggcaaggacguguuuuucaugccuccggagaaaugugauacacugcugugcgacaucggggagucuagccccaacccuaccauugaagagggaagaacacuccgcguccugaagaugguggaacccuggcuucggggcaaucaguuuuguaucaaaauucugaacccuuacaugcccuccguuguggagacccucgagcagaugcagagaaagcacggcgggaugcugguccgcaauccgcugucucggaacagcacacaugaaauguauuggguguccugcggaaccggcaauaucguuagcgcugugaacaugacgucuagaaugcuccugaaccgcuucacaauggcccaccggaaaccuaccuacgagagagaugucgaccuuggggcuggaacccgccauguggccguggaacccgaggucgcgaaucuggauauuaucggccaacggauugaaaacaucaagaaugagcacaaguccacauggcacuaugacgaggauaaccccuacaaaacgugggccuaucaugggagcuacgaaguuaagccuucuggauccgcuagcucuauggugaauggcguggucagacuccugaccaaacccugggacgugaucccuaugguuacacagauugccaugaccgauacaaccccguuuggccagcaacgcguguucaaggagaaagucgacacaagaaccccccgggcuaagcgcgggacggcccagaucauggaagugaccgcuaaguggcuuuggggauuucuguccagaaacaaaaagccucggauuuguacaagagaggaauucacccggaaaguucgcagcaaugccgcgaucggcgccguguuugucgacgagaaccaguggaauuccgcuaaggaggccguggaagaugagagauucugggaccucguucaccgggaacgcgagcugcauaaacaggggaagugcgcuacaugcguguauaacaugaugggaaagagagaaaaaaagcugggcgaguuugggaaagccaagggcagccgggccauuugguacauguggcucggagcgcgcuuccuggaguucgaagcucuuggcuuuaugaaugaggaucacugguucucuagagaaaacagccuguccggggucgagggagagggccuccauaaacugggguacauccuucgggacaucucuaagauucccggaggcaauauguaugccgaugacaccgccgggugggauacgcgcaucacagaagacgaucugcaaaacgaggcuaaaauuaccgacaucauggaaccugagcacgcccuccuggcuacaagcauuuuuaagcugaccuaccagaauaagguggucagagugcagcggcccgccaaaaacggcacgguuauggaugugaucucccgcagagaccagcggggaucuggccaagucgggaccuauggacucaacacauucaccaauauggaagugcagcugauccgccagauggagagcgagggcauuuuuuucccguccgaacuugagucuccuaaccuggcggaaagagugcucgauuggcuggagaagcacggggccgaacggcuuaaaagaauggcuaucagcggagacgacuguguugugaagcccauugaugaccgcuuugccacagcucugaucgcccucaaugauaugggcaaaguccggaaggacauuccucagugggagcccuccaagggguggaacgauuggcaacaggugccuuucugcagccaucacuuucaucagcugaucaugaaagacggcagagagaucguugugcccugucgcaaucaggaugaacuggucggacgggcgagagugucucaaggcgccggguggucccuccgcgagaccgcuugccugggaaagagcuacgcccagauguggcagcuuauguauuuccaccggagagaccugcgccucgcugccaacgcuauuuguucugccgucccgguggauuggguuccuacaucccggaccacguggagcauccacgcgcaucaccaauggaugacaaccgaagacaugcuguccguguggaauagagucuggauugaggaaaaccccuggauggaggauaaaacccaugugucuagcugggaggaaguucccuaccuuggcaagcgcgaggaccaguggugcgggucccugaucggacucacagcccgggcuaccugggccacaaauauucagguggccaucaaccaggucagacggcugauuggcaaugaaaacuaucuggacuacaugacgagcaugaaaagauuuaagaaugagucugauccugagggggcucucugg
